United States Patent 8,183,436 (NUCLEOTIDE SEQUENCES AND POLYPEPTIDES ENCODED THEREBY USEFUL FOR MODIFYING PLANT CHARACTERISTICS) - sequence listing, part 2

SEQ ID NO: 1465 - DNA, 2773 bp, Arabidopsis thaliana
  misc_feature (1)..(2773): Ceres cDNA ID no. 12604179
  misc_feature (1)..(2773): Ceres CLONE  ID no. 1331407
  misc_feature (1)..(2773): Also known as  Ceres CDNA ID no. 12604179
aaaacgaaactcaagtcaatgaataaaaagacgaaacaatgctatgataagaaaagaaacaacactcgaaaaagttcttctttttcttccgcacatgtctgactctctcataagcgtaaatcgctctgtcaaatatctctgaccagagagacagagttgcctccacgtttcttcagacaagactcacgctcttccctttcaccacattcccttctccatttctcaatctcacttaccttctcgattcttgctccaatttcgaatcttccgagtgaaaaaagcttcaaagtttggaactttctagtgtttattaatctgggtctgctctgagtttcgtgtgtagctgcatatgagcttaaagctcgagtttttccatctgggtttggaattctagggctagtgattggagattttgggaatttaggttgattttagtaggtttgacttcaggttgcgtaatttaggttgattttgatccgatttgtggaattagggtttgtttgttcacaaagcttcaatttttggagtttaaatggatcgataacgactgtgttagaagaaagtttgctgcttcagattcgtattcgatatagaaatgagtttggttcctcctttaccgattttatcaccaccgtcgtcaaattcttcaacaactgcacctcctccgttacagactcagcccaccactccatctgctccacctccggttacaccacctccttctccgccgcaatctccgccgccggttgtatcatcatcaccaccaccaccggttgtttcgtcacctccaccgtcttcttctccaccaccgtcacctcctgtcatcacttcacctcctcccaccgttgcttcttcccctccacctcctgtggtgattgcttcccctcctccctcaactccggcgacaacaccaccagctcctccgcaaactgtctcacctccaccgcctcctgatgcttctccatcacctcccgcaccaacaacaacaaatcctcctcctaaaccttctccttcaccgccgggagaaacaccttcaccaccgggagaaacaccttcaccgcctaaaccttctccgtcaactccaactccaacaacaaccacatctcctcctcctcctccagctacctctgcttctcctccgtcttcaaatcctactgatccttctacgttagctcctcctccaactccattacctgttgttcccagagagaaaccaattgctaaaccaactggaccagcttcaaacaatggaaacaacactttgccgtctagttcaccaggtaaaagcgaagttggtactggaggtattgtagctatcggagtgattgtgggattggtttttcttagcctttttgtgatgggtgtgtggttcactcggaaacgaaagcgaaaggaccctggaacctttgttggatacacaatgcctccttccgcttattcatctcctcaaggctcagatgtagtgctcttcaactcgcgttcttcagctcctcctaaaatgagaagccattctggtagcgattacatgtatgcgtcatctgattcaggcatggttagcaaccaaagatcatggttttcatatgatgagttatctcaagttaccagtgggttctccgagaagaatcttctcggtgaaggagggtttggctgtgtatacaaaggcgttctttctgacggaagggaagtggcagttaaacagttaaagattggtggaagccaaggggagagagagttcaaagcagaagttgaaatcatttctcgggttcatcaccgccatttggttacactagttggttattgcatctcagagcaacataggttgcttgtatatgattatgtacctaacaacactctccattatcatctccatgctccaggaagaccagttatgacttgggaaactcgggtaagggtcgctgctggtgcagctcgtggaatcgcctacttacatgaagactgtcatccccgcattattcaccgtgacataaaatcttccaacatacttcttgataacagctttgaagccttggttgcggattttggacttgcaaaaattgcacaagaactggatttaaacacacacgtctcaacgcgcgtaatgggaacctttgggtacatggctcctgaatatgcaacaagtggaaagctgtctgaaaaagcagatgtttattcgtatggggtaatactgttggagcttataactggccgtaaacccgtagatacgtctcaaccacttggtgatgagagccttgttgaatgggcaagacccttgctgggtcaagcaatcgagaacgaagaattcgacgagctagtagatccgaggctagggaaaaacttcatcccaggagagatgttcagaatggtagaagctgcggctgcatgtgtccgccactcagctgcaaaaagaccaaagatgagtcaagtggtgagagctttggacacacttgaagaagcaacggacataaccaacggaatgagaccaggacagagccaagtgtttgactcgagacaacaatctgctcagataaggatgtttcaaagaatggcttttgggagtcaagattatagttctgacttctttgatcgctcacagtcacatagtagctggggcagtcgtgaccagtccagatttgtaccttagtagtttttattgcctttgcttctttcttctttccctttaaacatgtcctcgatcttgtatattcttttgcatgatataatgtatttttgaaatatacatacatacacacataaaatttggtagtcttttgaa

SEQ ID NO: 1466 - protein, 2773 aa, Arabidopsis thaliana
AAAACGAAACTCAAGTCAATGAATAAAAAGACGAAACAATGCTATGATAAGAAAAGAAACAACACTCGAAAAAGTTCTTCTTTTTCTTCCGCACATGTCTGACTCTCTCATAAGCGTAAATCGCTCTGTCAAATATCTCTGACCAGAGAGACAGAGTTGCCTCCACGTTTCTTCAGACAAGACTCACGCTCTTCCCTTTCACCACATTCCCTTCTCCATTTCTCAATCTCACTTACCTTCTCGATTCTTGCTCCAATTTCGAATCTTCCGAGTGAAAAAAGCTTCAAAGTTTGGAACTTTCTAGTGTTTATTAATCTGGGTCTGCTCTGAGTTTCGTGTGTAGCTGCATATGAGCTTAAAGCTCGAGTTTTTCCATCTGGGTTTGGAATTCTAGGGCTAGTGATTGGAGATTTTGGGAATTTAGGTTGATTTTAGTAGGTTTGACTTCAGGTTGCGTAATTTAGGTTGATTTTGATCCGATTTGTGGAATTAGGGTTTGTTTGTTCACAAAGCTTCAATTTTTGGAGTTTAAATGGATCGATAACGACTGTGTTAGAAGAAAGTTTGCTGCTTCAGATTCGTATTCGATATAGAAATGAGTTTGGTTCCTCCTTTACCGATTTTATCACCACCGTCGTCAAATTCTTCAACAACTGCACCTCCTCCGTTACAGACTCAGCCCACCACTCCATCTGCTCCACCTCCGGTTACACCACCTCCTTCTCCGCCGCAATCTCCGCCGCCGGTTGTATCATCATCACCACCACCACCGGTTGTTTCGTCACCTCCACCGTCTTCTTCTCCACCACCGTCACCTCCTGTCATCACTTCACCTCCTCCCACCGTTGCTTCTTCCCCTCCACCTCCTGTGGTGATTGCTTCCCCTCCTCCCTCAACTCCGGCGACAACACCACCAGCTCCTCCGCAAACTGTCTCACCTCCACCGCCTCCTGATGCTTCTCCATCACCTCCCGCACCAACAACAACAAATCCTCCTCCTAAACCTTCTCCTTCACCGCCGGGAGAAACACCTTCACCACCGGGAGAAACACCTTCACCGCCTAAACCTTCTCCGTCAACTCCAACTCCAACAACAACCACATCTCCTCCTCCTCCTCCAGCTACCTCTGCTTCTCCTCCGTCTTCAAATCCTACTGATCCTTCTACGTTAGCTCCTCCTCCAACTCCATTACCTGTTGTTCCCAGAGAGAAACCAATTGCTAAACCAACTGGACCAGCTTCAAACAATGGAAACAACACTTTGCCGTCTAGTTCACCAGGTAAAAGCGAAGTTGGTACTGGAGGTATTGTAGCTATCGGAGTGATTGTGGGATTGGTTTTTCTTAGCCTTTTTGTGATGGGTGTGTGGTTCACTCGGAAACGAAAGCGAAAGGACCCTGGAACCTTTGTTGGATACACAATGCCTCCTTCCGCTTATTCATCTCCTCAAGGCTCAGATGTAGTGCTCTTCAACTCGCGTTCTTCAGCTCCTCCTAAAATGAGAAGCCATTCTGGTAGCGATTACATGTATGCGTCATCTGATTCAGGCATGGTTAGCAACCAAAGATCATGGTTTTCATATGATGAGTTATCTCAAGTTACCAGTGGGTTCTCCGAGAAGAATCTTCTCGGTGAAGGAGGGTTTGGCTGTGTATACAAAGGCGTTCTTTCTGACGGAAGGGAAGTGGCAGTTAAACAGTTAAAGATTGGTGGAAGCCAAGGGGAGAGAGAGTTCAAAGCAGAAGTTGAAATCATTTCTCGGGTTCATCACCGCCATTTGGTTACACTAGTTGGTTATTGCATCTCAGAGCAACATAGGTTGCTTGTATATGATTATGTACCTAACAACACTCTCCATTATCATCTCCATGCTCCAGGAAGACCAGTTATGACTTGGGAAACTCGGGTAAGGGTCGCTGCTGGTGCAGCTCGTGGAATCGCCTACTTACATGAAGACTGTCATCCCCGCATTATTCACCGTGACATAAAATCTTCCAACATACTTCTTGATAACAGCTTTGAAGCCTTGGTTGCGGATTTTGGACTTGCAAAAATTGCACAAGAACTGGATTTAAACACACACGTCTCAACGCGCGTAATGGGAACCTTTGGGTACATGGCTCCTGAATATGCAACAAGTGGAAAGCTGTCTGAAAAAGCAGATGTTTATTCGTATGGGGTAATACTGTTGGAGCTTATAACTGGCCGTAAACCCGTAGATACGTCTCAACCACTTGGTGATGAGAGCCTTGTTGAATGGGCAAGACCCTTGCTGGGTCAAGCAATCGAGAACGAAGAATTCGACGAGCTAGTAGATCCGAGGCTAGGGAAAAACTTCATCCCAGGAGAGATGTTCAGAATGGTAGAAGCTGCGGCTGCATGTGTCCGCCACTCAGCTGCAAAAAGACCAAAGATGAGTCAAGTGGTGAGAGCTTTGGACACACTTGAAGAAGCAACGGACATAACCAACGGAATGAGACCAGGACAGAGCCAAGTGTTTGACTCGAGACAACAATCTGCTCAGATAAGGATGTTTCAAAGAATGGCTTTTGGGAGTCAAGATTATAGTTCTGACTTCTTTGATCGCTCACAGTCACATAGTAGCTGGGGCAGTCGTGACCAGTCCAGATTTGTACCTTAGTAGTTTTTATTGCCTTTGCTTCTTTCTTCTTTCCCTTTAAACATGTCCTCGATCTTGTATATTCTTTTGCATGATATAATGTATTTTTGAAATATACATACATACACACATAAAATTTGGTAGTCTTTTGAA

SEQ ID NO: 1467 - DNA, 1233 bp, Arabidopsis thaliana
  misc_feature (1)..(1233): Ceres cDNA ID no. 12604466
  misc_feature (1)..(1233): Ceres CLONE  ID no. 1200356
  misc_feature (1)..(1233): Also known as  Ceres CDNA ID no. 24380903
gaagaacaaaccctagctcctctctttttctctctctacctctctttctctatcttctcttatcactacttctctcgccgatcaatcatcatgaacgatcctgataatcccgatctgagcaacgacgactctgcttggagagaactcacactcacagctcaagattctgacttcttcgaccgagacacttccaatatcctctctgacttcggttggaacctccaccactcctccgatcatcctcacagtctcagattcgactccgatttaacacaaaccaccggagtcaaacctaccaccgtcacttcttcttgttcctcatccgccgccgtttccgttgccgttacctctactaataataatccctcagctacctcaagttcaagtgaagatccggccgagaactcaaccgcctccgccgagaaaacaccaccaccggagacaccagtgaaggagaagaagaaggctcaaaagcgaattcggcaaccaagattcgcattcatgaccaagagtgatgtggataatcttgaagatggatatcgatggcgtaaatatggacaaaaagccgtcaagaatagcccattcccaaggagctactatagatgcacaaacagcagatgcacggtgaagaagagagtagaacgttcatcagatgatccatcgatagtgatcacaacatacgaaggacaacattgccatcaaaccattggattccctcgtggtggaatcctcactgcacacgacccacatagcttcacttctcatcatcatctccctcctccattaccaaatccttattattaccaagaactccttcatcaacttcacagagacaataatgctccttcaccgcggttaccccgacctactactgaagatacacctgccgtgtctactccatcagaggaaggcttacttggtgatattgtacctcaaactatgcgcaacccttgaggtaagcttggtacgtaacaatagttaaggaggtgctaactcattatatatagaagatattgcagcccggaatatgcgcagggagggtttaacaatatggcgttgtaacaatggatctatatataactatatatatatattacttcattgttgatcaatagcacaccaccggtacgtttgcaatttcttcatgtatatttcttgttatataagtagttatatatccagatataattttgatgtaacacaacattaatcttaatcttggatccatcccac

SEQ ID NO: 1468 - protein, 1233 aa, Arabidopsis thaliana
  misc_feature: PFam Name: WRKY; PFam Description: WRKY DNA -binding domain
  misc_feature: GI Number: 46394312; NR Description: TPA: WRKY transcription
  misc_feature: GI Number: 30017307; NR Description: At2g47260 [Arabidopsis thaliana] >gi|26450898|dbj|BAC42556.1| putative WRKY-type DNA binding protein [Arabidopsis thaliana] >gi|2275204|gb|AAB63826.1| putative WRKY-type DNA binding protein transcription factor 23
  misc_feature: GI Number: 21536889; NR Description: putative WRKY-type DNA
  misc_feature: GI Number: 37910167; NR Description: transcription factor
  misc_feature: GI Number: 15991740; NR Description: WRKY transcription factor 71 [Arabidopsis thaliana] >gi|29839598|sp|Q93WV4|WR71_ARATH Probable WRKY transcription factor 71 (WRKY DNA-binding protein 71) >gi|15220582|ref|NP_174279.1| WRKY family transcription factor
GAAGAACAAACCCTAGCTCCTCTCTTTTTCTCTCTCTACCTCTCTTTCTCTATCTTCTCTTATCACTACTTCTCTCGCCGATCAATCATCATGAACGATCCTGATAATCCCGATCTGAGCAACGACGACTCTGCTTGGAGAGAACTCACACTCACAGCTCAAGATTCTGACTTCTTCGACCGAGACACTTCCAATATCCTCTCTGACTTCGGTTGGAACCTCCACCACTCCTCCGATCATCCTCACAGTCTCAGATTCGACTCCGATTTAACACAAACCACCGGAGTCAAACCTACCACCGTCACTTCTTCTTGTTCCTCATCCGCCGCCGTTTCCGTTGCCGTTACCTCTACTAATAATAATCCCTCAGCTACCTCAAGTTCAAGTGAAGATCCGGCCGAGAACTCAACCGCCTCCGCCGAGAAAACACCACCACCGGAGACACCAGTGAAGGAGAAGAAGAAGGCTCAAAAGCGAATTCGGCAACCAAGATTCGCATTCATGACCAAGAGTGATGTGGATAATCTTGAAGATGGATATCGATGGCGTAAATATGGACAAAAAGCCGTCAAGAATAGCCCATTCCCAAGGAGCTACTATAGATGCACAAACAGCAGATGCACGGTGAAGAAGAGAGTAGAACGTTCATCAGATGATCCATCGATAGTGATCACAACATACGAAGGACAACATTGCCATCAAACCATTGGATTCCCTCGTGGTGGAATCCTCACTGCACACGACCCACATAGCTTCACTTCTCATCATCATCTCCCTCCTCCATTACCAAATCCTTATTATTACCAAGAACTCCTTCATCAACTTCACAGAGACAATAATGCTCCTTCACCGCGGTTACCCCGACCTACTACTGAAGATACACCTGCCGTGTCTACTCCATCAGAGGAAGGCTTACTTGGTGATATTGTACCTCAAACTATGCGCAACCCTTGAGGTAAGCTTGGTACGTAACAATAGTTAAGGAGGTGCTAACTCATTATATATAGAAGATATTGCAGCCCGGAATATGCGCAGGGAGGGTTTAACAATATGGCGTTGTAACAATGGATCTATATATAACTATATATATATATTACTTCATTGTTGATCAATAGCACACCACCGGTACGTTTGCAATTTCTTCATGTATATTTCTTGTTATATAAGTAGTTATATATCCAGATATAATTTTGATGTAACACAACATTAATCTTAATCTTGGATCCATCCCAC

SEQ ID NO: 1469 - DNA, 976 bp, Arabidopsis thaliana
  misc_feature (1)..(976): Ceres cDNA ID no. 12604796
  misc_feature (1)..(976): Ceres CLONE  ID no. 152032
  misc_feature (1)..(976): Also known as  Ceres CDNA ID no. 12604796
atcaactaaactttgtattcatttccaagtatcactctaaatcatctttttcgaattcgcctcccaagatatgtcgacagagtcgtacgaagacgccattaaaagactcggagagcttctcagtaagaaatcggatctcgggaacgtggcagccgcaaagatcaagaagttaacggatgagttagaggaacttgattccaacaagttagatgccgtagaacgaatcaaatccggatttctccatttcaagactaataattatgagaagaatcctactttgtacaattcacttgccaagagccagacccccaagtttttggtgtttgcttgtgcggattcacgagttagtccatctcacatcttgaatttccaacttggggaagccttcatcgttagaaacattgcaaacatggtgccaccttatgacaagacaaagcactctaatgttggtgcggcccttgaatatccaattacagtcctcaacgtggagaacattcttgttattggacacagctgttgtggtggaataaagggactcatggccattgaagataatacagctcccactaagaccgagttcatagaaaactggatccagatctgtgcaccggccaagaacaggatcaagcaggattgtaaagacctaagctttgaagatcagtgcaccaactgtgagaaggaagccgtgaacgtgtccttggggaatcttttgtcttacccattcgtgagagaaagagtggtgaagaacaagcttgccataagaggagctcactatgatttcgtaaaaggaacgtttgatctttgggaacttgacttcaagactacccctgcctttgccttgtcttaaaagattcctcctactcaaatattttctctatgttgtttctaattatgttcttataatcttcttctgttgcttctgtaatgtcatctttgctacttctattccaatagaaatgaataaagctttaaagag

SEQ ID NO: 1470 - protein, 976 aa, Arabidopsis thaliana
ATCAACTAAACTTTGTATTCATTTCCAAGTATCACTCTAAATCATCTTTTTCGAATTCGCCTCCCAAGATATGTCGACAGAGTCGTACGAAGACGCCATTAAAAGACTCGGAGAGCTTCTCAGTAAGAAATCGGATCTCGGGAACGTGGCAGCCGCAAAGATCAAGAAGTTAACGGATGAGTTAGAGGAACTTGATTCCAACAAGTTAGATGCCGTAGAACGAATCAAATCCGGATTTCTCCATTTCAAGACTAATAATTATGAGAAGAATCCTACTTTGTACAATTCACTTGCCAAGAGCCAGACCCCCAAGTTTTTGGTGTTTGCTTGTGCGGATTCACGAGTTAGTCCATCTCACATCTTGAATTTCCAACTTGGGGAAGCCTTCATCGTTAGAAACATTGCAAACATGGTGCCACCTTATGACAAGACAAAGCACTCTAATGTTGGTGCGGCCCTTGAATATCCAATTACAGTCCTCAACGTGGAGAACATTCTTGTTATTGGACACAGCTGTTGTGGTGGAATAAAGGGACTCATGGCCATTGAAGATAATACAGCTCCCACTAAGACCGAGTTCATAGAAAACTGGATCCAGATCTGTGCACCGGCCAAGAACAGGATCAAGCAGGATTGTAAAGACCTAAGCTTTGAAGATCAGTGCACCAACTGTGAGAAGGAAGCCGTGAACGTGTCCTTGGGGAATCTTTTGTCTTACCCATTCGTGAGAGAAAGAGTGGTGAAGAACAAGCTTGCCATAAGAGGAGCTCACTATGATTTCGTAAAAGGAACGTTTGATCTTTGGGAACTTGACTTCAAGACTACCCCTGCCTTTGCCTTGTCTTAAAAGATTCCTCCTACTCAAATATTTTCTCTATGTTGTTTCTAATTATGTTCTTATAATCTTCTTCTGTTGCTTCTGTAATGTCATCTTTGCTACTTCTATTCCAATAGAAATGAATAAAGCTTTAAAGAG

SEQ ID NO: 1471 - DNA, 1610 bp, Arabidopsis thaliana
  misc_feature (1)..(1610): Ceres cDNA ID no. 12605501
  misc_feature (1)..(1610): Ceres CLONE  ID no. 1352621
  misc_feature (1)..(1610): Also known as  Ceres CDNA ID no. 23657854
aaaaaaaaaaaaaaaagtgggggaagagaacccaccattgaaattgggggaagaagagaagagaggctaacacacacaaaaagaaccccttctttttcgctggcttactcgtgcccttgtcggcttacttcgccggaaatctgaattatccttttgccggagactacttacccttctctttcttcttcttcgaaacgggtttttaaagctcagctcttggtgacgccgtcgtgagagagagagattgaagtagaagaagaagaaattgaggttgagagatgtatgtagtgcctccgcctcagcgatctgattctggatccaatggtgatttaagggtttaccaaacttggaaaggcagcaatatattctttcttcagggaaggtttgtatttgggccagatgttagatcactggcgctgaccatttgtctcattgctgtccctgttacaattttctgcatctttgtcgcaaggaagctaattgatgacttctccgatagctggggagtctcaatagtagctgtcgccgtcgtgttcaccatttatgatttaattcttctgctgcttacatccggaagagatccaggtattatcccaagaaatgctcatcctccagagcctgaaacccttgatggaaacatggatgcaggggctggccagactccgcagctgcgattgcctcgcattaaggaagtacagcttaatggaatcacatttaaggtcaagtactgtgacacttgcatgctctataggccgcctcgctgctcgcattgctcaatttgcaacaactgcgtagaaaggtttgaccatcactgcccttgggtcggccaatgtattgggatgaggaactaccgattcttcttcatgttcgtcttctccacgacccttctatgtatatatgtgtttgccttctgctgggtctatataagaaagattatggaatcagagcacacaaccacttggaaggcaatgcttaaaactcctgcctccattgttctaataatatacacattcatatcaatgtggtttgttggtggcttaacagttttccatttatatctcatcagcacgaaccagactacatacgagaatttccgatacagatatgatcggcgaagcaacccacataacaagggagtggttaataacttcaaagaaacatttttttccacaatccctccttcaaagaacgactttagagctatggtccagcgtgaacctccattacctcctagatctgtagcaggtggttttatgagtccaaacatgggtaaagccaatgatgagattgaaatgggaaggaaggctgtttgggcagacatgggtccagcaatgtcagatcatggtgacggtaaacatggtaacaatgagcggttacatgttaaggacggtgagttaggcgagctatctccagacattagggcaacagttgatgaacagagtgataggccaagtatgcacccgagacgctcaagctggggaaggaaaagcggaagctgggacatgtcaccagaagttatggccttagcagccagagtaggagaacaaaaccagaacggcggaggtagcagcagcggaagcggtttagtgacggagaaccggcctacataa

SEQ ID NO: 1472 - protein, 1610 aa, Arabidopsis thaliana
  misc_feature: PFam Name: zf-DHHC; PFam Description: DHHC zinc finger domain
  misc_feature: GI Number: 50947995; NR Description: putative DHHC-type zinc finger domain-containing protein [Oryza sativa (japonica cultivar-group)] >gi|38175527|dbj|BAD01220.1| putative DHHC-type zinc finger domain-containing protein [Oryza sativa (japonica
  misc_feature: GI Number: 57900122; NR Description: putative zisp [Oryza sativa (japonica cultivar-group)] gi|57899394|dbj|BAD88041.1|
  misc_feature: GI Number: 30688566; NR Description: zinc finger (DHHC type)
  misc_feature: GI Number: 30693084; NR Description: zinc finger (DHHC type)
  misc_feature: GI Number: 50948057; NR Description: putative DHHC-type zinc finger domain-containing protein [Oryza sativa (japonica cultivar-group)] >gi|50725676|dbj|BAD33142.1| putative DHHC-type zinc finger domain-containing protein [Oryza sativa (japonica
AAAAAAAAAAAAAAAAGTGGGGGAAGAGAACCCACCATTGAAATTGGGGGAAGAAGAGAAGAGAGGCTAACACACACAAAAAGAACCCCTTCTTTTTCGCTGGCTTACTCGTGCCCTTGTCGGCTTACTTCGCCGGAAATCTGAATTATCCTTTTGCCGGAGACTACTTACCCTTCTCTTTCTTCTTCTTCGAAACGGGTTTTTAAAGCTCAGCTCTTGGTGACGCCGTCGTGAGAGAGAGAGATTGAAGTAGAAGAAGAAGAAATTGAGGTTGAGAGATGTATGTAGTGCCTCCGCCTCAGCGATCTGATTCTGGATCCAATGGTGATTTAAGGGTTTACCAAACTTGGAAAGGCAGCAATATATTCTTTCTTCAGGGAAGGTTTGTATTTGGGCCAGATGTTAGATCACTGGCGCTGACCATTTGTCTCATTGCTGTCCCTGTTACAATTTTCTGCATCTTTGTCGCAAGGAAGCTAATTGATGACTTCTCCGATAGCTGGGGAGTCTCAATAGTAGCTGTCGCCGTCGTGTTCACCATTTATGATTTAATTCTTCTGCTGCTTACATCCGGAAGAGATCCAGGTATTATCCCAAGAAATGCTCATCCTCCAGAGCCTGAAACCCTTGATGGAAACATGGATGCAGGGGCTGGCCAGACTCCGCAGCTGCGATTGCCTCGCATTAAGGAAGTACAGCTTAATGGAATCACATTTAAGGTCAAGTACTGTGACACTTGCATGCTCTATAGGCCGCCTCGCTGCTCGCATTGCTCAATTTGCAACAACTGCGTAGAAAGGTTTGACCATCACTGCCCTTGGGTCGGCCAATGTATTGGGATGAGGAACTACCGATTCTTCTTCATGTTCGTCTTCTCCACGACCCTTCTATGTATATATGTGTTTGCCTTCTGCTGGGTCTATATAAGAAAGATTATGGAATCAGAGCACACAACCACTTGGAAGGCAATGCTTAAAACTCCTGCCTCCATTGTTCTAATAATATACACATTCATATCAATGTGGTTTGTTGGTGGCTTAACAGTTTTCCATTTATATCTCATCAGCACGAACCAGACTACATACGAGAATTTCCGATACAGATATGATCGGCGAAGCAACCCACATAACAAGGGAGTGGTTAATAACTTCAAAGAAACATTTTTTTCCACAATCCCTCCTTCAAAGAACGACTTTAGAGCTATGGTCCAGCGTGAACCTCCATTACCTCCTAGATCTGTAGCAGGTGGTTTTATGAGTCCAAACATGGGTAAAGCCAATGATGAGATTGAAATGGGAAGGAAGGCTGTTTGGGCAGACATGGGTCCAGCAATGTCAGATCATGGTGACGGTAAACATGGTAACAATGAGCGGTTACATGTTAAGGACGGTGAGTTAGGCGAGCTATCTCCAGACATTAGGGCAACAGTTGATGAACAGAGTGATAGGCCAAGTATGCACCCGAGACGCTCAAGCTGGGGAAGGAAAAGCGGAAGCTGGGACATGTCACCAGAAGTTATGGCCTTAGCAGCCAGAGTAGGAGAACAAAACCAGAACGGCGGAGGTAGCAGCAGCGGAAGCGGTTTAGTGACGGAGAACCGGCCTACATAA

SEQ ID NO: 1473 - DNA, 1475 bp, Arabidopsis thaliana
  misc_feature (1)..(1475): Ceres cDNA ID no. 12606233
  misc_feature (1)..(1475): Ceres CLONE  ID no. 1334322
  misc_feature (1)..(1475): Also known as  Ceres CDNA ID no. 23658938
aaacacttcccaatcgccattgttactctgttttgagatctccctccacgcacatatcatcagatctacacttcccactcaaaattttccagaattcccaaattcttctctgtatatttcctctaacactctcgaattcactccctaacttgtgatttaaaacaagtcttctcaaattttgttcatctccagctacaaaaaaaatggcgcagcaaaagttccttcaccagcgaccaatccaaaacccattcacaaacccattctcttcttctcctctttccacttcttcaatctcaaatcgtccaatctctctactcagccgcaacggtctcctcctccttctcgctctcctcgttatcctcggcgtattcttaccctgggcaggatctcctttattcccgtctccaaacaaactctctccttctcaatccaaatggcgcgactattccctccctcaagctgtcaaattcgtagctaagaacgggactgtgatcgtatgcgccgttagctatccttacttgccgtttctcaacaattggttgattagtgtttctagacagaagcatcaggatcaagttctcgtcatcgctgaggattacgctactctctacaaagttaacgagaaatggcctggtcacgccgttctcattcctccggcgctcgattctcagaccgctcacaaattcggttctcagggattcttcaatttcacagcacggaggccgcaacatctcttggaaattttggagttaggttacaatgttatgtacaacgatgttgatatggtttggttgcaagatccgtttcagtatttagagggaaagcacgatgcttacttcatggatgatatgactgcaattaagcctttggatcactctcatgatttaccacctccgggtaaaaaaggaaggacttatatttgtagctgtatgattttcttgcgtcccactaatggcgcaaaacttctcatgaagaaatggatcgaggagcttgaaacgcaaccttggtccagagctaagaaagcaaatgatcagcctggttttaactgggcacttaacaaaacagctaatcaggtatgttctttcttcctagttccacagtaaaacagtaacttctcttctctgtaaattggtctcaataagtagttactacacaattggtgaattcaatgaaattctagcgtaaaatctcaaaagactgaagcttttgctacgccgagagaggttccgctttatctaaccgtagctactcaagcttttaatcaactctgtaatctacttatgaatgtttagttacgataagcttttttggcacacacatggctgatcttatgaataacaaaagatagtgaacttgtggatgtagtagtagcagccatttttaccctgtttctgtatgtaataatatatatgttaagagcttgtattgcaatggaatcgattgtttaaactattttcagaggaattttatgacat

SEQ ID NO: 1474 - protein, 1475 aa, Arabidopsis thaliana
  misc_feature: GI Number: 28466905; NR Description: At1g56550 [Arabidopsis
AAACACTTCCCAATCGCCATTGTTACTCTGTTTTGAGATCTCCCTCCACGCACATATCATCAGATCTACACTTCCCACTCAAAATTTTCCAGAATTCCCAAATTCTTCTCTGTATATTTCCTCTAACACTCTCGAATTCACTCCCTAACTTGTGATTTAAAACAAGTCTTCTCAAATTTTGTTCATCTCCAGCTACAAAAAAAATGGCGCAGCAAAAGTTCCTTCACCAGCGACCAATCCAAAACCCATTCACAAACCCATTCTCTTCTTCTCCTCTTTCCACTTCTTCAATCTCAAATCGTCCAATCTCTCTACTCAGCCGCAACGGTCTCCTCCTCCTTCTCGCTCTCCTCGTTATCCTCGGCGTATTCTTACCCTGGGCAGGATCTCCTTTATTCCCGTCTCCAAACAAACTCTCTCCTTCTCAATCCAAATGGCGCGACTATTCCCTCCCTCAAGCTGTCAAATTCGTAGCTAAGAACGGGACTGTGATCGTATGCGCCGTTAGCTATCCTTACTTGCCGTTTCTCAACAATTGGTTGATTAGTGTTTCTAGACAGAAGCATCAGGATCAAGTTCTCGTCATCGCTGAGGATTACGCTACTCTCTACAAAGTTAACGAGAAATGGCCTGGTCACGCCGTTCTCATTCCTCCGGCGCTCGATTCTCAGACCGCTCACAAATTCGGTTCTCAGGGATTCTTCAATTTCACAGCACGGAGGCCGCAACATCTCTTGGAAATTTTGGAGTTAGGTTACAATGTTATGTACAACGATGTTGATATGGTTTGGTTGCAAGATCCGTTTCAGTATTTAGAGGGAAAGCACGATGCTTACTTCATGGATGATATGACTGCAATTAAGCCTTTGGATCACTCTCATGATTTACCACCTCCGGGTAAAAAAGGAAGGACTTATATTTGTAGCTGTATGATTTTCTTGCGTCCCACTAATGGCGCAAAACTTCTCATGAAGAAATGGATCGAGGAGCTTGAAACGCAACCTTGGTCCAGAGCTAAGAAAGCAAATGATCAGCCTGGTTTTAACTGGGCACTTAACAAAACAGCTAATCAGGTATGTTCTTTCTTCCTAGTTCCACAGTAAAACAGTAACTTCTCTTCTCTGTAAATTGGTCTCAATAAGTAGTTACTACACAATTGGTGAATTCAATGAAATTCTAGCGTAAAATCTCAAAAGACTGAAGCTTTTGCTACGCCGAGAGAGGTTCCGCTTTATCTAACCGTAGCTACTCAAGCTTTTAATCAACTCTGTAATCTACTTATGAATGTTTAGTTACGATAAGCTTTTTTGGCACACACATGGCTGATCTTATGAATAACAAAAGATAGTGAACTTGTGGATGTAGTAGTAGCAGCCATTTTTACCCTGTTTCTGTATGTAATAATATATATGTTAAGAGCTTGTATTGCAATGGAATCGATTGTTTAAACTATTTTCAGAGGAATTTTATGACAT

SEQ ID NO: 1475 - DNA, 1478 bp, Arabidopsis thaliana
  misc_feature (1)..(1478): Ceres cDNA ID no. 12606546
  misc_feature (1)..(1478): Ceres CLONE  ID no. 1148374
  misc_feature (1)..(1478): Also known as  Ceres CDNA ID no. 23656099
aagatttagggtttctcaaagagttttccttttccctctctctcccatgtcgatgtctccgatctccatcgtaattcagtttccttcaattgatgtgaccttcgattccaaactcgcaaacccagaaacgggttactcatagaaacagtgatagagagatatgaatgttgacgctagagtcggtgttgcggtcgatggagctcagagtgctcttaacactgcaaccactgttcatagtagcgtcgtcatgacgcagattaagccgcaggcaaagctaggaaccttccagaatctcctcgctggtggtattgccggcgccattagcaagacatgtaccgctcctcttgctcgcctcaccatcttgtttcagttgcaagggatgcaatcagaaggtgcagtgttaagccgtccaaacttacggcgtgaagcttcccgtattatcaacgaggaaggatatagagccttttggaaaggaaatttggttactgtagtacacaggattccttatactgcagtaaacttctatgcatatgagaagtacaatctatttttcaattcaaatccagtcgtacagagttttataggaaatacgagtggcaatccgatagtgcattttgttagtggtggcttggctggaattacagctgctacagctacatatcccctcgatcttgtcaggactcgtcttgctgcacagaggaatgcaatttactaccagggtattgagcatactttccgtaccatatgcagagaagagggaattttgggtctatataaaggacttggtgctacattattgggtgttggaccaagtcttgctatcaatttcgccgcgtacgagtctatgaaattgttttggcattctcataggccaaatgattcggatttggttgtttctcttgtttctggaggtctagctggagctgtttcttcaacagctacatacccattggatcttgtgagaagaagaatgcaagtggaaggagctggtggaagagcaagagtatacaacactggactctttggaacattcaaacacatattcaagtcagaaggcttcaaagggatatacagaggaatattgcctgaatattacaaagtagttcctggcgttggcatcgtcttcatgacatacgatgctttgcggagactcttaacttctctccccgattgacaactcccactcatatacttagaggaattttagctgcttatagagttagtagaagaaagaaacaacatgtttatttcacacttggtcatcttttcaaacactttggtagtaaattttacttttcttactgccgtagagaaaattttacagtgtataggttagttccacctggggtgttaaaaacattcataggcatcatatttaacactgtaccacgtgagcatatcttcaaacacgacacatttgttttgttctttctctgtttctacactcctatgatacttatgtaagtttttgtttgctt

SEQ ID NO: 1476 - protein, 1478 aa, Arabidopsis thaliana
  misc_feature: PFam Name: Mito_carr; PFam Description: Mitochondrial
  misc_feature: GI Number: 51970652; NR Description: mitochondrial carrier
  misc_feature: GI Number: 23197668; NR Description: putative mitochondrial carrier protein [Arabidopsis thaliana] >gi|22135876|gb|AAM91520.1| putative mitochondrial carrier protein [Arabidopsis thaliana] >gi|51968668|dbj|BAD43026.1|
  misc_feature: GI Number: 4895195; NR Description: putative mitochondrial carrier protein [Arabidopsis thaliana] >gi|25295875|pir||D84798 probable mitochondrial carrier protein [imported] - Arabidopsis
  misc_feature: GI Number: 17104715; NR Description: putative Ca-dependent solute carrier protein [Arabidopsis thaliana] >gi|13877985|gb|AAK44070.1| putative Ca-dependent solute carrier
  misc_feature: GI Number: 21554682; NR Description: Ca-dependent solute
AAGATTTAGGGTTTCTCAAAGAGTTTTCCTTTTCCCTCTCTCTCCCATGTCGATGTCTCCGATCTCCATCGTAATTCAGTTTCCTTCAATTGATGTGACCTTCGATTCCAAACTCGCAAACCCAGAAACGGGTTACTCATAGAAACAGTGATAGAGAGATATGAATGTTGACGCTAGAGTCGGTGTTGCGGTCGATGGAGCTCAGAGTGCTCTTAACACTGCAACCACTGTTCATAGTAGCGTCGTCATGACGCAGATTAAGCCGCAGGCAAAGCTAGGAACCTTCCAGAATCTCCTCGCTGGTGGTATTGCCGGCGCCATTAGCAAGACATGTACCGCTCCTCTTGCTCGCCTCACCATCTTGTTTCAGTTGCAAGGGATGCAATCAGAAGGTGCAGTGTTAAGCCGTCCAAACTTACGGCGTGAAGCTTCCCGTATTATCAACGAGGAAGGATATAGAGCCTTTTGGAAAGGAAATTTGGTTACTGTAGTACACAGGATTCCTTATACTGCAGTAAACTTCTATGCATATGAGAAGTACAATCTATTTTTCAATTCAAATCCAGTCGTACAGAGTTTTATAGGAAATACGAGTGGCAATCCGATAGTGCATTTTGTTAGTGGTGGCTTGGCTGGAATTACAGCTGCTACAGCTACATATCCCCTCGATCTTGTCAGGACTCGTCTTGCTGCACAGAGGAATGCAATTTACTACCAGGGTATTGAGCATACTTTCCGTACCATATGCAGAGAAGAGGGAATTTTGGGTCTATATAAAGGACTTGGTGCTACATTATTGGGTGTTGGACCAAGTCTTGCTATCAATTTCGCCGCGTACGAGTCTATGAAATTGTTTTGGCATTCTCATAGGCCAAATGATTCGGATTTGGTTGTTTCTCTTGTTTCTGGAGGTCTAGCTGGAGCTGTTTCTTCAACAGCTACATACCCATTGGATCTTGTGAGAAGAAGAATGCAAGTGGAAGGAGCTGGTGGAAGAGCAAGAGTATACAACACTGGACTCTTTGGAACATTCAAACACATATTCAAGTCAGAAGGCTTCAAAGGGATATACAGAGGAATATTGCCTGAATATTACAAAGTAGTTCCTGGCGTTGGCATCGTCTTCATGACATACGATGCTTTGCGGAGACTCTTAACTTCTCTCCCCGATTGACAACTCCCACTCATATACTTAGAGGAATTTTAGCTGCTTATAGAGTTAGTAGAAGAAAGAAACAACATGTTTATTTCACACTTGGTCATCTTTTCAAACACTTTGGTAGTAAATTTTACTTTTCTTACTGCCGTAGAGAAAATTTTACAGTGTATAGGTTAGTTCCACCTGGGGTGTTAAAAACATTCATAGGCATCATATTTAACACTGTACCACGTGAGCATATCTTCAAACACGACACATTTGTTTTGTTCTTTCTCTGTTTCTACACTCCTATGATACTTATGTAAGTTTTTGTTTGCTT

SEQ ID NO: 1477 - DNA, 1830 bp, Arabidopsis thaliana
  misc_feature (1)..(1830): Ceres cDNA ID no. 12639968
  misc_feature (1)..(1830): Also known as  Ceres CDNA ID no. 23656099
atgggatttggagtaggtggtggaggtggtagaatgttggatttgaggattgtccaaaatcacaagcgttcaaagagtgccagctttccagaaaagaaaagagttgaaggagataaaacctcaaatagttctcatgaagcctctcaacgaatgaagctggacatgggacgttcaaatgaatcaaagcataatcaatatcattcaaacacggagacttcattgaagcaagagattactcacctcgagacaagattacaagatcagtttaaggttcgttgtgcattagagaaagccttaggttatcgaacagcatcttcttacgtactgactgaaacaaacgacattgccatgcctaagccagctactgatttaatcaaagacgttgcggtgctcgaaatggaagttatacatttggaacagtatcttctttcattatacagaaaagcctttgagcagcaaatctcttctgtatctccaaatttagagaacaagaagccaaaatctcctcctgttacaacccctagaaggcgtctagacttttctgaagatgatgataccccctcgaaaacagatcaacacacagttcctctgcttgatgataatcaaaatcaatcaaagaaaacagagattgctgcggttgaccgagaccagatggaccccagttttcgccgtagtcactctcaacgttcggcatttgggagtagaaaagcttctcccgaagattcttggggtaaagccagccgctcttgtcactcacagccactgtatgtgcagaatggagataacctaatcagtctagctgaacatcttggcacccgaatctcggatcatgttccagaaacacccaacaagttatctgaaggaatggtcaagtgcatgtcagaaatatactgcaagcttgcagagccaccttctgtgctacatcgtgggctttcatctccaaactcgtctttatcatcaagtgcattttcgccctctgaccaatacgatacatcgagccctggattcggaaacagctcctcttttgatgttcggctagataactctttccatgtagaaggagaaaaggacttcagtggaccttacagcagcattgttgaagtgctttgcatttacagagacgccaaaaaggccagtgaggtggaagatcttctgcaaaacttcaaattggaggaagtcgatccaaggaagttgaaacatgaagagaagctagcgttttggataaatgtgcacaatgcacttgtgatgcatgcgtttttagcttatgggattccacagaacaatgtgaagagagtcttacttctactcaaggctgcatataacattggtggacacacaattagcgccgaagcgatacaaagttcgattcttgggtgcaaaatgtctcatcctggacagtggcttagactactatttgcttcgaggaaattcaaagcaggggatgaaagattagcttatgcaatcgatcatcctgagcctctcctgcattttgcacttacttcaggcagccactccgatcccgcggttcgtgtatatacaccgaaaagaatccagcaagagcttgaaacgtcgaaagaagagtacataagaatgaacttaagcatacgcaagcagagaatcctattgccaaagcttgtggagacgtttgcaaaagactccggtttatgtccggcgggtttgacagagatggttaaccggagtataccggagtcttcaaggaaatgtgtaaagagatgtcaatctagtactagtaaaccacgaaagacaattgattggatccctcacagctttacatttagatatcttattcttagagaagctgccaaatga

SEQ ID NO: 1478 - protein, 1830 aa, Arabidopsis thaliana
  misc_feature: PFam Name: Mito_carr; PFam Description: Mitochondrial
  misc_feature: GI Number: 51970652; NR Description: mitochondrial carrier
  misc_feature: GI Number: 23197668; NR Description: putative mitochondrial carrier protein [Arabidopsis thaliana] >gi|22135876|gb|AAM91520.1| putative mitochondrial carrier protein [Arabidopsis thaliana] >gi|51968668|dbj|BAD43026.1|
  misc_feature: GI Number: 4895195; NR Description: putative mitochondrial carrier protein [Arabidopsis thaliana] >gi|25295875|pir||D84798 probable mitochondrial carrier protein [imported] - Arabidopsis
  misc_feature: GI Number: 17104715; NR Description: putative Ca-dependent solute carrier protein [Arabidopsis thaliana] >gi|13877985|gb|AAK44070.1| putative Ca-dependent solute carrier
  misc_feature: GI Number: 21554682; NR Description: Ca-dependent solute
ATGGGATTTGGAGTAGGTGGTGGAGGTGGTAGAATGTTGGATTTGAGGATTGTCCAAAATCACAAGCGTTCAAAGAGTGCCAGCTTTCCAGAAAAGAAAAGAGTTGAAGGAGATAAAACCTCAAATAGTTCTCATGAAGCCTCTCAACGAATGAAGCTGGACATGGGACGTTCAAATGAATCAAAGCATAATCAATATCATTCAAACACGGAGACTTCATTGAAGCAAGAGATTACTCACCTCGAGACAAGATTACAAGATCAGTTTAAGGTTCGTTGTGCATTAGAGAAAGCCTTAGGTTATCGAACAGCATCTTCTTACGTACTGACTGAAACAAACGACATTGCCATGCCTAAGCCAGCTACTGATTTAATCAAAGACGTTGCGGTGCTCGAAATGGAAGTTATACATTTGGAACAGTATCTTCTTTCATTATACAGAAAAGCCTTTGAGCAGCAAATCTCTTCTGTATCTCCAAATTTAGAGAACAAGAAGCCAAAATCTCCTCCTGTTACAACCCCTAGAAGGCGTCTAGACTTTTCTGAAGATGATGATACCCCCTCGAAAACAGATCAACACACAGTTCCTCTGCTTGATGATAATCAAAATCAATCAAAGAAAACAGAGATTGCTGCGGTTGACCGAGACCAGATGGACCCCAGTTTTCGCCGTAGTCACTCTCAACGTTCGGCATTTGGGAGTAGAAAAGCTTCTCCCGAAGATTCTTGGGGTAAAGCCAGCCGCTCTTGTCACTCACAGCCACTGTATGTGCAGAATGGAGATAACCTAATCAGTCTAGCTGAACATCTTGGCACCCGAATCTCGGATCATGTTCCAGAAACACCCAACAAGTTATCTGAAGGAATGGTCAAGTGCATGTCAGAAATATACTGCAAGCTTGCAGAGCCACCTTCTGTGCTACATCGTGGGCTTTCATCTCCAAACTCGTCTTTATCATCAAGTGCATTTTCGCCCTCTGACCAATACGATACATCGAGCCCTGGATTCGGAAACAGCTCCTCTTTTGATGTTCGGCTAGATAACTCTTTCCATGTAGAAGGAGAAAAGGACTTCAGTGGACCTTACAGCAGCATTGTTGAAGTGCTTTGCATTTACAGAGACGCCAAAAAGGCCAGTGAGGTGGAAGATCTTCTGCAAAACTTCAAATTGGAGGAAGTCGATCCAAGGAAGTTGAAACATGAAGAGAAGCTAGCGTTTTGGATAAATGTGCACAATGCACTTGTGATGCATGCGTTTTTAGCTTATGGGATTCCACAGAACAATGTGAAGAGAGTCTTACTTCTACTCAAGGCTGCATATAACATTGGTGGACACACAATTAGCGCCGAAGCGATACAAAGTTCGATTCTTGGGTGCAAAATGTCTCATCCTGGACAGTGGCTTAGACTACTATTTGCTTCGAGGAAATTCAAAGCAGGGGATGAAAGATTAGCTTATGCAATCGATCATCCTGAGCCTCTCCTGCATTTTGCACTTACTTCAGGCAGCCACTCCGATCCCGCGGTTCGTGTATATACACCGAAAAGAATCCAGCAAGAGCTTGAAACGTCGAAAGAAGAGTACATAAGAATGAACTTAAGCATACGCAAGCAGAGAATCCTATTGCCAAAGCTTGTGGAGACGTTTGCAAAAGACTCCGGTTTATGTCCGGCGGGTTTGACAGAGATGGTTAACCGGAGTATACCGGAGTCTTCAAGGAAATGTGTAAAGAGATGTCAATCTAGTACTAGTAAACCACGAAAGACAATTGATTGGATCCCTCACAGCTTTACATTTAGATATCTTATTCTTAGAGAAGCTGCCAAATGA

SEQ ID NO: 1479 - DNA, 1416 bp, Arabidopsis thaliana
  misc_feature (1)..(1416): Ceres cDNA ID no. 12640413
  misc_feature (1)..(1416): Also known as  Ceres CDNA ID no. 23656099
atgggcattgcacggtggctcaaccgcaccgtgggcttctttgtcttcgctctcctcgacattgctgatttcttgctttgttacacttacaagactttggattacttcttggaatccgagaggaaaccttgctactgctcttctccaccagaggctaaagccaagaccgagaagatcatagtgtcggaacgaggcgggtactcaaaggttgtgtctctaacaagaagtaagatccatttcgatgagatctcggacacgctttactcacgtggcccttcacttctaacgaggctctctaagctcgtgaggtccgtgaaatgttttaattataagggtttgatcatgagaggcaatgtggtggaatcttgtgatcatcatgagtctaagaaaaagattagcaaaggtaaaaagagattaatgactttgaattctaccgtgattgagaaatcttcgacagctccaagatggtcggattgccattgcagtttctgcacttcttggcttacttctaccaacagagattctctgtttgttaaagttcaacaacccaaagataacaagaaggcccgagacaacgttgtgtttatacatggttttgtatcatcatccgcgttttggacggagactctcttcccaaacttttctgattcagccaaatcgaactataggttcatcgcagtcgatcttttgggctatggaagaagtcctaagccaaatgactcattatatactttaagagaacatttggagatgattgagaaatcggtgatctctaagttcaagctcaaaacgttccacatagtagctcattccctaggctgcattttggctcttgcactcgcagtaaaacatccgggagctatcaaatcccttactcttttggctcctccatattacaaggtgccaaagggagtccaaccagcgcaatacgtgatgagggaagtggctcggaaggaagtttggccaccgatgcagtttggtgcatcggtgcttagctggtatgagcacctaggccgcaccattggccttgtccttatcaagaaccatcaattgattgaatttgtcacccgcctccttaccctaaacaggatgcgaacgtatttgatagaaggattcttatgtcacacacataatggatcatttcacacattacacaacatcatcttcgggtcaggagccaagctcgactcgtatctcgaccatgtccgtgaccatgtggactgcgacgtcgccattttccacggtggcaaggacgagctcattcctgtggagtgtagttacagtgtgaagagcaaagtgccacgtgccactgtccacgtcatccctgacaaagaccacatcaccattgtcgtcggccgacaaaaagactttgcacgagagcttgagctcatttggcaaagaaccaaatcaacttaa

SEQ ID NO: 1480 - protein, 1416 aa, Arabidopsis thaliana
  misc_feature: PFam Name: Mito_carr; PFam Description: Mitochondrial
  misc_feature: GI Number: 51970652; NR Description: mitochondrial carrier
  misc_feature: GI Number: 23197668; NR Description: putative mitochondrial carrier protein [Arabidopsis thaliana] >gi|22135876|gb|AAM91520.1| putative mitochondrial carrier protein [Arabidopsis thaliana] >gi|51968668|dbj|BAD43026.1|
  misc_feature: GI Number: 4895195; NR Description: putative mitochondrial carrier protein [Arabidopsis thaliana] >gi|25295875|pir||D84798 probable mitochondrial carrier protein [imported] - Arabidopsis
  misc_feature: GI Number: 17104715; NR Description: putative Ca-dependent solute carrier protein [Arabidopsis thaliana] >gi|13877985|gb|AAK44070.1| putative Ca-dependent solute carrier
  misc_feature: GI Number: 21554682; NR Description: Ca-dependent solute
ATGGGCATTGCACGGTGGCTCAACCGCACCGTGGGCTTCTTTGTCTTCGCTCTCCTCGACATTGCTGATTTCTTGCTTTGTTACACTTACAAGACTTTGGATTACTTCTTGGAATCCGAGAGGAAACCTTGCTACTGCTCTTCTCCACCAGAGGCTAAAGCCAAGACCGAGAAGATCATAGTGTCGGAACGAGGCGGGTACTCAAAGGTTGTGTCTCTAACAAGAAGTAAGATCCATTTCGATGAGATCTCGGACACGCTTTACTCACGTGGCCCTTCACTTCTAACGAGGCTCTCTAAGCTCGTGAGGTCCGTGAAATGTTTTAATTATAAGGGTTTGATCATGAGAGGCAATGTGGTGGAATCTTGTGATCATCATGAGTCTAAGAAAAAGATTAGCAAAGGTAAAAAGAGATTAATGACTTTGAATTCTACCGTGATTGAGAAATCTTCGACAGCTCCAAGATGGTCGGATTGCCATTGCAGTTTCTGCACTTCTTGGCTTACTTCTACCAACAGAGATTCTCTGTTTGTTAAAGTTCAACAACCCAAAGATAACAAGAAGGCCCGAGACAACGTTGTGTTTATACATGGTTTTGTATCATCATCCGCGTTTTGGACGGAGACTCTCTTCCCAAACTTTTCTGATTCAGCCAAATCGAACTATAGGTTCATCGCAGTCGATCTTTTGGGCTATGGAAGAAGTCCTAAGCCAAATGACTCATTATATACTTTAAGAGAACATTTGGAGATGATTGAGAAATCGGTGATCTCTAAGTTCAAGCTCAAAACGTTCCACATAGTAGCTCATTCCCTAGGCTGCATTTTGGCTCTTGCACTCGCAGTAAAACATCCGGGAGCTATCAAATCCCTTACTCTTTTGGCTCCTCCATATTACAAGGTGCCAAAGGGAGTCCAACCAGCGCAATACGTGATGAGGGAAGTGGCTCGGAAGGAAGTTTGGCCACCGATGCAGTTTGGTGCATCGGTGCTTAGCTGGTATGAGCACCTAGGCCGCACCATTGGCCTTGTCCTTATCAAGAACCATCAATTGATTGAATTTGTCACCCGCCTCCTTACCCTAAACAGGATGCGAACGTATTTGATAGAAGGATTCTTATGTCACACACATAATGGATCATTTCACACATTACACAACATCATCTTCGGGTCAGGAGCCAAGCTCGACTCGTATCTCGACCATGTCCGTGACCATGTGGACTGCGACGTCGCCATTTTCCACGGTGGCAAGGACGAGCTCATTCCTGTGGAGTGTAGTTACAGTGTGAAGAGCAAAGTGCCACGTGCCACTGTCCACGTCATCCCTGACAAAGACCACATCACCATTGTCGTCGGCCGACAAAAAGACTTTGCACGAGAGCTTGAGCTCATTTGGCAAAGAACCAAATCAACTTAA

SEQ ID NO: 1481 - DNA, 1248 bp, Arabidopsis thaliana
  misc_feature (1)..(1248): Ceres cDNA ID no. 12640618
  misc_feature (1)..(1248): Also known as  Ceres CDNA ID no. 23656099
atcaactcctctaataagcttcttctttctatccctcacttttacaaacaaagggagaccaaaaatgggtctaagcaaaactattcccttagtgttactcccgattttgatgtttggggttttgagtaacgctcagcttacctctgatttttactccacgacatgccctaacgtcacagccattgctcggggactgatcgagcgagcaagccgtaacgacgtcagactcactgctaaagtcatgcgtcttcactttcatgactgtttcgtgaacgggtgcgatggttcggtactattggacgctgctccagcggatggggtagagggtgaaaaggaggctttccaaaacgcgggttctcttgatggattcgaagtgatcgatgatatcaaaaccgccctcgagaatgtttgtcccggagttgtctcttgtgctgatatcctcgctatcgcagctgaaatctctgttgcactggcgggagggccgtcattggacgtattgctaggaaggagagatggccggacagcgatccgtgcggacgcagtggctgcacttccactaggacctgattctctcgagattcttacttccaaattctccgtacataatcttgacactaccgatctcgtcgctttatctggtgctcataccttcgggagggttcagtgtggagtgataaacaatcgtctacacaactttagtggtaacagcggacagtccgacccaagtatcgaaccggagttcttgcaaacgttacgacgacaatgcccgcaaggcggagatctcaccgcaagggcgaatcttgatcctacgagccccgactcatttgataacgactatttcaagaaccttcaaaacaaccgcggagtgattgaatcagatcaaatcttgttctcttcgacaggagcgcctactgtgtctttggtgaatcgttttgctgagaaccaaaatgagttctttacaaattttgcgagatcaatgatcaagatgggaaatgtgaggattctcacaggacgtgagggagagatacgtagagactgcagacgcgtcaattaataagttttgcatggttaaatgatcaaacgtaacttattgttattcatgaaataagtgttctttagtttgtgcttctccacaattaattgtttttcttcttttgattttatttactgttaagcatgccattgttacttgtaattgtaaatcttatataatatttttctttttgaaaaaatccactatcatgtctg

SEQ ID NO: 1482 - protein, 1248 aa, Arabidopsis thaliana
  misc_feature: PFam Name: Mito_carr; PFam Description: Mitochondrial
  misc_feature: GI Number: 51970652; NR Description: mitochondrial carrier
  misc_feature: GI Number: 23197668; NR Description: putative mitochondrial carrier protein [Arabidopsis thaliana] >gi|22135876|gb|AAM91520.1| putative mitochondrial carrier protein [Arabidopsis thaliana] >gi|51968668|dbj|BAD43026.1|
  misc_feature: GI Number: 4895195; NR Description: putative mitochondrial carrier protein [Arabidopsis thaliana] >gi|25295875|pir||D84798 probable mitochondrial carrier protein [imported] - Arabidopsis
  misc_feature: GI Number: 17104715; NR Description: putative Ca-dependent solute carrier protein [Arabidopsis thaliana] >gi|13877985|gb|AAK44070.1| putative Ca-dependent solute carrier
  misc_feature: GI Number: 21554682; NR Description: Ca-dependent solute
ATCAACTCCTCTAATAAGCTTCTTCTTTCTATCCCTCACTTTTACAAACAAAGGGAGACCAAAAATGGGTCTAAGCAAAACTATTCCCTTAGTGTTACTCCCGATTTTGATGTTTGGGGTTTTGAGTAACGCTCAGCTTACCTCTGATTTTTACTCCACGACATGCCCTAACGTCACAGCCATTGCTCGGGGACTGATCGAGCGAGCAAGCCGTAACGACGTCAGACTCACTGCTAAAGTCATGCGTCTTCACTTTCATGACTGTTTCGTGAACGGGTGCGATGGTTCGGTACTATTGGACGCTGCTCCAGCGGATGGGGTAGAGGGTGAAAAGGAGGCTTTCCAAAACGCGGGTTCTCTTGATGGATTCGAAGTGATCGATGATATCAAAACCGCCCTCGAGAATGTTTGTCCCGGAGTTGTCTCTTGTGCTGATATCCTCGCTATCGCAGCTGAAATCTCTGTTGCACTGGCGGGAGGGCCGTCATTGGACGTATTGCTAGGAAGGAGAGATGGCCGGACAGCGATCCGTGCGGACGCAGTGGCTGCACTTCCACTAGGACCTGATTCTCTCGAGATTCTTACTTCCAAATTCTCCGTACATAATCTTGACACTACCGATCTCGTCGCTTTATCTGGTGCTCATACCTTCGGGAGGGTTCAGTGTGGAGTGATAAACAATCGTCTACACAACTTTAGTGGTAACAGCGGACAGTCCGACCCAAGTATCGAACCGGAGTTCTTGCAAACGTTACGACGACAATGCCCGCAAGGCGGAGATCTCACCGCAAGGGCGAATCTTGATCCTACGAGCCCCGACTCATTTGATAACGACTATTTCAAGAACCTTCAAAACAACCGCGGAGTGATTGAATCAGATCAAATCTTGTTCTCTTCGACAGGAGCGCCTACTGTGTCTTTGGTGAATCGTTTTGCTGAGAACCAAAATGAGTTCTTTACAAATTTTGCGAGATCAATGATCAAGATGGGAAATGTGAGGATTCTCACAGGACGTGAGGGAGAGATACGTAGAGACTGCAGACGCGTCAATTAATAAGTTTTGCATGGTTAAATGATCAAACGTAACTTATTGTTATTCATGAAATAAGTGTTCTTTAGTTTGTGCTTCTCCACAATTAATTGTTTTTCTTCTTTTGATTTTATTTACTGTTAAGCATGCCATTGTTACTTGTAATTGTAAATCTTATATAATATTTTTCTTTTTGAAAAAATCCACTATCATGTCTG

SEQ ID NO: 1483 - DNA, 891 bp, Arabidopsis thaliana
  misc_feature (1)..(891): Ceres cDNA ID no. 12641775
  misc_feature (1)..(891): Also known as  Ceres CDNA ID no. 23656099
atggaagaagacgggtctgattggggcggattggctccagagatactcatcaacatcatttcaaggcttacgattcaggagctatggaccggtccgatgttcgtccaaaaatcgtggctaactgtttgcagagatccgtatctctggtctatcttcgatctggagccatggttcgattcctatcccgagtcgactcacttgtggtcccctgagttcgagcagaaggtagacttaatgctacgatcagtcgttgattggagcgaaggtggtctcactaagatccgcgtccgccattgcagcgaccacgctctctcttacgcagccgatagatgcccgaatctacaggttcttgccattagaagcagtcctaacgtgacagacgcatcgatgacgaagatagcgtttcggtgcaggagtttaaaggaacttgatatcagttactgtcacgagatatctcacgacactcttgtgatgattggtagaaactgtcctaatctgaggatcttgaaacgtaatcttatggattggtcttctcggcacattggctctgttcctacagaatacttagacgcttgtcctcaagacggagacacagaagctgacgcgattgggaaacatatgatcaatctagagcatttggagattcagttctctagattatctgtcaagggtcttgcttcgatatgtgagggttgtcccaagctagagtacttggacttgtttgggtgtgtgcatttgtcaagccgtgacattacaagcaacgtgtcaaggcttaaatggcttaaggaggtaaagaagccagatgtgtatgtgccaaggtcaggggatgtggcacggagaggtatggacattggagactctatgacgagagatttgacatacaagccatga

SEQ ID NO: 1484 - protein, 891 aa, Arabidopsis thaliana
  misc_feature: PFam Name: Mito_carr; PFam Description: Mitochondrial
  misc_feature: GI Number: 51970652; NR Description: mitochondrial carrier
  misc_feature: GI Number: 23197668; NR Description: putative mitochondrial carrier protein [Arabidopsis thaliana] >gi|22135876|gb|AAM91520.1| putative mitochondrial carrier protein [Arabidopsis thaliana] >gi|51968668|dbj|BAD43026.1|
  misc_feature: GI Number: 4895195; NR Description: putative mitochondrial carrier protein [Arabidopsis thaliana] >gi|25295875|pir||D84798 probable mitochondrial carrier protein [imported] - Arabidopsis
  misc_feature: GI Number: 17104715; NR Description: putative Ca-dependent solute carrier protein [Arabidopsis thaliana] >gi|13877985|gb|AAK44070.1| putative Ca-dependent solute carrier
  misc_feature: GI Number: 21554682; NR Description: Ca-dependent solute
ATGGAAGAAGACGGGTCTGATTGGGGCGGATTGGCTCCAGAGATACTCATCAACATCATTTCAAGGCTTACGATTCAGGAGCTATGGACCGGTCCGATGTTCGTCCAAAAATCGTGGCTAACTGTTTGCAGAGATCCGTATCTCTGGTCTATCTTCGATCTGGAGCCATGGTTCGATTCCTATCCCGAGTCGACTCACTTGTGGTCCCCTGAGTTCGAGCAGAAGGTAGACTTAATGCTACGATCAGTCGTTGATTGGAGCGAAGGTGGTCTCACTAAGATCCGCGTCCGCCATTGCAGCGACCACGCTCTCTCTTACGCAGCCGATAGATGCCCGAATCTACAGGTTCTTGCCATTAGAAGCAGTCCTAACGTGACAGACGCATCGATGACGAAGATAGCGTTTCGGTGCAGGAGTTTAAAGGAACTTGATATCAGTTACTGTCACGAGATATCTCACGACACTCTTGTGATGATTGGTAGAAACTGTCCTAATCTGAGGATCTTGAAACGTAATCTTATGGATTGGTCTTCTCGGCACATTGGCTCTGTTCCTACAGAATACTTAGACGCTTGTCCTCAAGACGGAGACACAGAAGCTGACGCGATTGGGAAACATATGATCAATCTAGAGCATTTGGAGATTCAGTTCTCTAGATTATCTGTCAAGGGTCTTGCTTCGATATGTGAGGGTTGTCCCAAGCTAGAGTACTTGGACTTGTTTGGGTGTGTGCATTTGTCAAGCCGTGACATTACAAGCAACGTGTCAAGGCTTAAATGGCTTAAGGAGGTAAAGAAGCCAGATGTGTATGTGCCAAGGTCAGGGGATGTGGCACGGAGAGGTATGGACATTGGAGACTCTATGACGAGAGATTTGACATACAAGCCATGA

SEQ ID NO: 1485 - DNA, 1473 bp, Arabidopsis thaliana
  misc_feature (1)..(1473): Ceres cDNA ID no. 12642846
  misc_feature (1)..(1473): Also known as  Ceres CDNA ID no. 23656099
atgccttatgtatcatcaattatagaagatagaaaattagttatttgcctagattgcactgatttaatagtaatttacttgaatcgtaggtttatcttcccggctttgggaggattattgtttgggtatgacattggggctacctccggtgctacgctctcacttcagtcacctgcgcttagcggaactacatggtttaacttctcacctgttcagctaggacttgtggttagcggatccttgtatggagcccttcttggctcaatttctgtctatggcgttgctgatttccttggaagaaggcgggaacttattatagctgctgttctctatctcctcgggtctctgatcactggctgtgcccctgatcttaatattctcttagttggaaggcttctctatggctttggtattggtttggcaatgcatggggctcccctctatattgctgagacatgcccatctcaaatccgtggaactttgatatctctgaaagaactcttcatcgtattgggaattttgttgggtttttctgttggaagcttccagattgatgtagttggagggtggcgttacatgtatggatttggtacgcctgttgctttgctgatgggactaggcatgtggagtctccctgcatctcctcgctggttgctgcttagagctgtccaaggtaaaggacaattacaagaatacaaagagaaggccatgcttgccctcagcaaattacgtggcagacctccaggtgataaaatctcagagaagttggtagatgatgcctatttatctgtgaaaacggcctatgaagatgagaaatctgggggaaacttcctggaagtattccaagggcctaatttgaaagctttgacaattggtggaggtttagtcctcttccaacagataactggacagcctagtgttctttattatgcgggttcgattcttcagactgctggattctctgctgctgctgatgcaactcgagtctctgttattattggtgttttcaagttactgatgacatgggtagctgttgcgaaagttgatgatctcggcagacgacctttactgattggaggtgtcagcggcattgcgttgtccttgtttctactgtcagcatactacaagtttctcggaggctttccccttgtcgctgttggtgcactgcttctctatgttggttgttaccagcgcgaacagatctcatttggacccatcagctggctaatggtgtcagagattttcccgctccgcacaagagggagagggatcagtcttgcagttcttacaaactttggctccaatgctattgtgacatttgcattttcacctttaaaggaatttcttggagccgagaatcttttccttctctttgggggcatagcactggtatcactgctgtttgtaatactagtagttccagagaccaagggtctcagcttggaagaaattgaatcaaaaatcttgaagtga

SEQ ID NO: 1486 - protein, 1473 aa, Arabidopsis thaliana
  misc_feature: PFam Name: Mito_carr; PFam Description: Mitochondrial
  misc_feature: GI Number: 51970652; NR Description: mitochondrial carrier
  misc_feature: GI Number: 23197668; NR Description: putative mitochondrial carrier protein [Arabidopsis thaliana] >gi|22135876|gb|AAM91520.1| putative mitochondrial carrier protein [Arabidopsis thaliana] >gi|51968668|dbj|BAD43026.1|
  misc_feature: GI Number: 4895195; NR Description: putative mitochondrial carrier protein [Arabidopsis thaliana] >gi|25295875|pir||D84798 probable mitochondrial carrier protein [imported] - Arabidopsis
  misc_feature: GI Number: 17104715; NR Description: putative Ca-dependent solute carrier protein [Arabidopsis thaliana] >gi|13877985|gb|AAK44070.1| putative Ca-dependent solute carrier
  misc_feature: GI Number: 21554682; NR Description: Ca-dependent solute
ATGCCTTATGTATCATCAATTATAGAAGATAGAAAATTAGTTATTTGCCTAGATTGCACTGATTTAATAGTAATTTACTTGAATCGTAGGTTTATCTTCCCGGCTTTGGGAGGATTATTGTTTGGGTATGACATTGGGGCTACCTCCGGTGCTACGCTCTCACTTCAGTCACCTGCGCTTAGCGGAACTACATGGTTTAACTTCTCACCTGTTCAGCTAGGACTTGTGGTTAGCGGATCCTTGTATGGAGCCCTTCTTGGCTCAATTTCTGTCTATGGCGTTGCTGATTTCCTTGGAAGAAGGCGGGAACTTATTATAGCTGCTGTTCTCTATCTCCTCGGGTCTCTGATCACTGGCTGTGCCCCTGATCTTAATATTCTCTTAGTTGGAAGGCTTCTCTATGGCTTTGGTATTGGTTTGGCAATGCATGGGGCTCCCCTCTATATTGCTGAGACATGCCCATCTCAAATCCGTGGAACTTTGATATCTCTGAAAGAACTCTTCATCGTATTGGGAATTTTGTTGGGTTTTTCTGTTGGAAGCTTCCAGATTGATGTAGTTGGAGGGTGGCGTTACATGTATGGATTTGGTACGCCTGTTGCTTTGCTGATGGGACTAGGCATGTGGAGTCTCCCTGCATCTCCTCGCTGGTTGCTGCTTAGAGCTGTCCAAGGTAAAGGACAATTACAAGAATACAAAGAGAAGGCCATGCTTGCCCTCAGCAAATTACGTGGCAGACCTCCAGGTGATAAAATCTCAGAGAAGTTGGTAGATGATGCCTATTTATCTGTGAAAACGGCCTATGAAGATGAGAAATCTGGGGGAAACTTCCTGGAAGTATTCCAAGGGCCTAATTTGAAAGCTTTGACAATTGGTGGAGGTTTAGTCCTCTTCCAACAGATAACTGGACAGCCTAGTGTTCTTTATTATGCGGGTTCGATTCTTCAGACTGCTGGATTCTCTGCTGCTGCTGATGCAACTCGAGTCTCTGTTATTATTGGTGTTTTCAAGTTACTGATGACATGGGTAGCTGTTGCGAAAGTTGATGATCTCGGCAGACGACCTTTACTGATTGGAGGTGTCAGCGGCATTGCGTTGTCCTTGTTTCTACTGTCAGCATACTACAAGTTTCTCGGAGGCTTTCCCCTTGTCGCTGTTGGTGCACTGCTTCTCTATGTTGGTTGTTACCAGCGCGAACAGATCTCATTTGGACCCATCAGCTGGCTAATGGTGTCAGAGATTTTCCCGCTCCGCACAAGAGGGAGAGGGATCAGTCTTGCAGTTCTTACAAACTTTGGCTCCAATGCTATTGTGACATTTGCATTTTCACCTTTAAAGGAATTTCTTGGAGCCGAGAATCTTTTCCTTCTCTTTGGGGGCATAGCACTGGTATCACTGCTGTTTGTAATACTAGTAGTTCCAGAGACCAAGGGTCTCAGCTTGGAAGAAATTGAATCAAAAATCTTGAAGTGA

SEQ ID NO: 1487 - DNA, 2598 bp, Arabidopsis thaliana
  misc_feature (1)..(2598): Ceres cDNA ID no. 12642932
  misc_feature (1)..(2598): Also known as  Ceres CDNA ID no. 23656099
atggagagttcttttgggcttttgttggcactgttaactttgaccatcattcatattgttcaagctcaagacccacaagggttcatcagtttggattgcgggctacccgcaaatgagacgtctccttatacagagactcaaactggtctgttgttctcttcggacgcaacattcatccagagcggaaaaactggtagagtccaagcaaatcaagagagtaaattcttgaagccatacagaacgctgagatatttcccagagggagtacggaattgctacaatctgagtgtgttcaaggagcgtaaatatttgatcgctgctagttttttatatggaaattacgatggtcataacatagcccctgtgtttgatctttatcttggaccaaatttatgggcgaaaatagatttacaagatgtgaatggtacaggggaagagatcttacacatcccaacatcgaactcgttgcagatatgtcttgttcagactggggaaactacaccgctgatatcctctttggaattacggccaatgagaactggaagctataccactgtgtctggttccctgaaaacatacaggcgtttatattttaaaaagtctggatctaggctacggtacagtaaagatgtttatgatcgctcatggtttccgcgcttcatggacgaatggacccagatttccactgctctcggggtgattaataccaacatctaccaaccaccggaagatgcgctgaaaaatgctgccacgcctactgatgctagtgcgccactgacatttaaatggaattcagaaaaattggatgtccaatattacttttacgcacactatgctgagatccaagacttgcaggcaaatgataccagagaattcaacatcttattgaatggacaaaatttatctgtgactggccctgaagtcccagataagctaagtataaagaccttccaaagctcgtcaccgataagttgcaatggatgggcatgtaattttcagctgataagaaccaaaagatcaactcttccacctctacttaatgctttggaagtctacacagttattcagtttccacggtccgaaacagatgaaagcgacgtggttgctatgaaaaacatctcagccagctatggattgagtagaatcaactggcaaggcgatccatgcttccctcagcagcttaggtgggacgctttagactgcaccaacagaaatatctcccaaccaccaagaatcacttctttaaacttgtcttcaagtcgtttaaatggaaccatagcagctgccattcaaagtattacacaacttgaaacactggacttgtcgtataataacttaactggagaggtgccagagtttcttggcaaaatgaaatcgttaaacttaagcgggaacaatcttaatggttcaattccgcaagctcttcgaaagaaaagactaaaactataccttgaaggaaacccaaggcttataaaaccacctaagaaggaatttcctgtggcaattgttacattagttgtttttgtcacagtcattgtggttctttttcttgttttcagaaagaaaatgtccacgattgtaaaaggtctacgcctgccaccaaggacatcaatggtggatgttacattttctaataaaaaaagcaaaaggttcacatattcagaggtcgtccaagtgacaaagaacttccaaagagttttaggtaaaggagggttcggcatggtctatcacggtactgtaaagggttctgaacaggtggccgttaaggttctctctcaatcgtcaactcaaggctctaaggagttcaaagcagaggttgatctccttctgagagtgcaccatacaaatttggtgagcctggttgggtattgctgtgaaggagattacttggccctcgtctatgagtttcttcccaatggagacttaaaacaacatttgtcaggaaaaggaggtaattccatcatcaactggagtattcgactgcgaatagctttggaagcagcactaggtttggagtacttgcatattggatgcacaccaccgatggttcatagagatgtcaaaactgccaacatattgctcgacgagaattttaaggccaaactcgctgattttggtctttcaagatctttccaaggtgaaggcgaatctcaggaatcgacaacaattgctggtactcttggataccttgatcccgaatgttaccattcaggtcgattgggtgagaagagtgatgtctacagtttcgggatcgtgttattggagatgatcacaaaccaaccagtgatcaatcaaacctcgggagattctcacataacacaatgggttggctttcagatgaaccgaggtgatattcttgagattatggatccaaaccttcgcaaggattataacattaattctgcctggagagctttggaactggcaatgtcatgcgcgtatccttcttcctcaaaacgaccatccatgtctcaggttatacacgagctgaaagagtgtattgcgtgtgaaaacacagggataagtaagaatcgaagcttggaatatcaagaaatgaacgttagcttggacactacggcggttcccatggcaagatag

SEQ ID NO: 1488 - protein, 2598 aa, Arabidopsis thaliana
  misc_feature: PFam Name: Mito_carr; PFam Description: Mitochondrial
  misc_feature: GI Number: 51970652; NR Description: mitochondrial carrier
  misc_feature: GI Number: 23197668; NR Description: putative mitochondrial carrier protein [Arabidopsis thaliana] >gi|22135876|gb|AAM91520.1| putative mitochondrial carrier protein [Arabidopsis thaliana] >gi|51968668|dbj|BAD43026.1|
  misc_feature: GI Number: 4895195; NR Description: putative mitochondrial carrier protein [Arabidopsis thaliana] >gi|25295875|pir||D84798 probable mitochondrial carrier protein [imported] - Arabidopsis
  misc_feature: GI Number: 17104715; NR Description: putative Ca-dependent solute carrier protein [Arabidopsis thaliana] >gi|13877985|gb|AAK44070.1| putative Ca-dependent solute carrier
  misc_feature: GI Number: 21554682; NR Description: Ca-dependent solute
ATGGAGAGTTCTTTTGGGCTTTTGTTGGCACTGTTAACTTTGACCATCATTCATATTGTTCAAGCTCAAGACCCACAAGGGTTCATCAGTTTGGATTGCGGGCTACCCGCAAATGAGACGTCTCCTTATACAGAGACTCAAACTGGTCTGTTGTTCTCTTCGGACGCAACATTCATCCAGAGCGGAAAAACTGGTAGAGTCCAAGCAAATCAAGAGAGTAAATTCTTGAAGCCATACAGAACGCTGAGATATTTCCCAGAGGGAGTACGGAATTGCTACAATCTGAGTGTGTTCAAGGAGCGTAAATATTTGATCGCTGCTAGTTTTTTATATGGAAATTACGATGGTCATAACATAGCCCCTGTGTTTGATCTTTATCTTGGACCAAATTTATGGGCGAAAATAGATTTACAAGATGTGAATGGTACAGGGGAAGAGATCTTACACATCCCAACATCGAACTCGTTGCAGATATGTCTTGTTCAGACTGGGGAAACTACACCGCTGATATCCTCTTTGGAATTACGGCCAATGAGAACTGGAAGCTATACCACTGTGTCTGGTTCCCTGAAAACATACAGGCGTTTATATTTTAAAAAGTCTGGATCTAGGCTACGGTACAGTAAAGATGTTTATGATCGCTCATGGTTTCCGCGCTTCATGGACGAATGGACCCAGATTTCCACTGCTCTCGGGGTGATTAATACCAACATCTACCAACCACCGGAAGATGCGCTGAAAAATGCTGCCACGCCTACTGATGCTAGTGCGCCACTGACATTTAAATGGAATTCAGAAAAATTGGATGTCCAATATTACTTTTACGCACACTATGCTGAGATCCAAGACTTGCAGGCAAATGATACCAGAGAATTCAACATCTTATTGAATGGACAAAATTTATCTGTGACTGGCCCTGAAGTCCCAGATAAGCTAAGTATAAAGACCTTCCAAAGCTCGTCACCGATAAGTTGCAATGGATGGGCATGTAATTTTCAGCTGATAAGAACCAAAAGATCAACTCTTCCACCTCTACTTAATGCTTTGGAAGTCTACACAGTTATTCAGTTTCCACGGTCCGAAACAGATGAAAGCGACGTGGTTGCTATGAAAAACATCTCAGCCAGCTATGGATTGAGTAGAATCAACTGGCAAGGCGATCCATGCTTCCCTCAGCAGCTTAGGTGGGACGCTTTAGACTGCACCAACAGAAATATCTCCCAACCACCAAGAATCACTTCTTTAAACTTGTCTTCAAGTCGTTTAAATGGAACCATAGCAGCTGCCATTCAAAGTATTACACAACTTGAAACACTGGACTTGTCGTATAATAACTTAACTGGAGAGGTGCCAGAGTTTCTTGGCAAAATGAAATCGTTAAACTTAAGCGGGAACAATCTTAATGGTTCAATTCCGCAAGCTCTTCGAAAGAAAAGACTAAAACTATACCTTGAAGGAAACCCAAGGCTTATAAAACCACCTAAGAAGGAATTTCCTGTGGCAATTGTTACATTAGTTGTTTTTGTCACAGTCATTGTGGTTCTTTTTCTTGTTTTCAGAAAGAAAATGTCCACGATTGTAAAAGGTCTACGCCTGCCACCAAGGACATCAATGGTGGATGTTACATTTTCTAATAAAAAAAGCAAAAGGTTCACATATTCAGAGGTCGTCCAAGTGACAAAGAACTTCCAAAGAGTTTTAGGTAAAGGAGGGTTCGGCATGGTCTATCACGGTACTGTAAAGGGTTCTGAACAGGTGGCCGTTAAGGTTCTCTCTCAATCGTCAACTCAAGGCTCTAAGGAGTTCAAAGCAGAGGTTGATCTCCTTCTGAGAGTGCACCATACAAATTTGGTGAGCCTGGTTGGGTATTGCTGTGAAGGAGATTACTTGGCCCTCGTCTATGAGTTTCTTCCCAATGGAGACTTAAAACAACATTTGTCAGGAAAAGGAGGTAATTCCATCATCAACTGGAGTATTCGACTGCGAATAGCTTTGGAAGCAGCACTAGGTTTGGAGTACTTGCATATTGGATGCACACCACCGATGGTTCATAGAGATGTCAAAACTGCCAACATATTGCTCGACGAGAATTTTAAGGCCAAACTCGCTGATTTTGGTCTTTCAAGATCTTTCCAAGGTGAAGGCGAATCTCAGGAATCGACAACAATTGCTGGTACTCTTGGATACCTTGATCCCGAATGTTACCATTCAGGTCGATTGGGTGAGAAGAGTGATGTCTACAGTTTCGGGATCGTGTTATTGGAGATGATCACAAACCAACCAGTGATCAATCAAACCTCGGGAGATTCTCACATAACACAATGGGTTGGCTTTCAGATGAACCGAGGTGATATTCTTGAGATTATGGATCCAAACCTTCGCAAGGATTATAACATTAATTCTGCCTGGAGAGCTTTGGAACTGGCAATGTCATGCGCGTATCCTTCTTCCTCAAAACGACCATCCATGTCTCAGGTTATACACGAGCTGAAAGAGTGTATTGCGTGTGAAAACACAGGGATAAGTAAGAATCGAAGCTTGGAATATCAAGAAATGAACGTTAGCTTGGACACTACGGCGGTTCCCATGGCAAGATAG

SEQ ID NO: 1489 - DNA, 1502 bp, Arabidopsis thaliana
  misc_feature (1)..(1502): Ceres cDNA ID no. 12642995
  misc_feature (1)..(1502): Also known as  Ceres CDNA ID no. 23656099
atggccaagaagatgagttctctcatcatcatcttcaacattctccttctcctcacaactcaaacccacgcgcacaacgtcacgcgcctcctagcaaaccacccatcattctcttccttcagccatttcctaacacaaacacacctcgccgacgaaatcaaccggagaagaaccataaccgtttgcgcagtagataacgccgccatgtcagcattaacctctaaaggctatacactctcaactctcaaaaacattctctccctccacgtccttttagattacttcggaaccaaaaaactccaccagatccgtgacggctctgctctcgccgctactctgtttcaagccaccggagctgctcctggaacctcaggattcgttaacataacggatctgagaggtggtaaagttgggtttggtcctgacggtggagatctgtcttctttctttgttaaatctattgaagaagttccgtataacatctccattattcagatcagtagagttttaccgtcggagactgcggcggctccgactcctgctccggcggagatgaatcttaccggaataatgtcggctcatggatgcaaagtgtttgctgagactcttctcactaaccctggagcttcaaaaacctatcaggagagtttagaaggaggcatgacagtgttctgtccaggagatgatgcaatgaaaggtttcttgcccaaatacaagaacttgacagctccaaagaaagaagcatttctcgatttcctcgctgtcccgacatattactcaatggcgatgctcaaatccaacaatggtccgatgaacacacttgcgacagatggagctaacaagtttgagcttactgtacagaacgatggagagaaggttaccctcaagacaaggatcaacactgtcaagatcgttgatactcttattgatgagcagcctttagctatatatgcgactgataaggttttgttgcctaaagagttgtttaaggcttcggctgttgaagctccggctcctgctccggcaccagaggatggtgatgttgcggattctccaaaagcggctaaagggaaagcgaaaggaaagaagaagaaggctgcaccgtcgccagataatgatccttttggtgactcggattcgcctgccgaagggcctgacggagaggccgatgatgcgacggcagatgatgctggtgcggttaggatcatcggaggagctaaggctggtttggtggtgagcttgctctgcttgtttgcttcttcttggcttctatagtttcacttcgtttcttctattcttccatgtttttttttttgtgaatcttttatttatggtttttgggggaaagtaaatgaggattatttatttccctctattgttgagttttttttatttatttaaaagttggttgtcgaattaaatagtcggtagtttatatatttgtgtgttcttgtttcacgtgtttgtttagttgatgatgtaaacaagtcctgattttggtg

SEQ ID NO: 1490 - protein, 1502 aa, Arabidopsis thaliana
  misc_feature: PFam Name: Mito_carr; PFam Description: Mitochondrial
  misc_feature: GI Number: 51970652; NR Description: mitochondrial carrier
  misc_feature: GI Number: 23197668; NR Description: putative mitochondrial carrier protein [Arabidopsis thaliana] >gi|22135876|gb|AAM91520.1| putative mitochondrial carrier protein [Arabidopsis thaliana] >gi|51968668|dbj|BAD43026.1|
  misc_feature: GI Number: 4895195; NR Description: putative mitochondrial carrier protein [Arabidopsis thaliana] >gi|25295875|pir||D84798 probable mitochondrial carrier protein [imported] - Arabidopsis
  misc_feature: GI Number: 17104715; NR Description: putative Ca-dependent solute carrier protein [Arabidopsis thaliana] >gi|13877985|gb|AAK44070.1| putative Ca-dependent solute carrier
  misc_feature: GI Number: 21554682; NR Description: Ca-dependent solute
ATGGCCAAGAAGATGAGTTCTCTCATCATCATCTTCAACATTCTCCTTCTCCTCACAACTCAAACCCACGCGCACAACGTCACGCGCCTCCTAGCAAACCACCCATCATTCTCTTCCTTCAGCCATTTCCTAACACAAACACACCTCGCCGACGAAATCAACCGGAGAAGAACCATAACCGTTTGCGCAGTAGATAACGCCGCCATGTCAGCATTAACCTCTAAAGGCTATACACTCTCAACTCTCAAAAACATTCTCTCCCTCCACGTCCTTTTAGATTACTTCGGAACCAAAAAACTCCACCAGATCCGTGACGGCTCTGCTCTCGCCGCTACTCTGTTTCAAGCCACCGGAGCTGCTCCTGGAACCTCAGGATTCGTTAACATAACGGATCTGAGAGGTGGTAAAGTTGGGTTTGGTCCTGACGGTGGAGATCTGTCTTCTTTCTTTGTTAAATCTATTGAAGAAGTTCCGTATAACATCTCCATTATTCAGATCAGTAGAGTTTTACCGTCGGAGACTGCGGCGGCTCCGACTCCTGCTCCGGCGGAGATGAATCTTACCGGAATAATGTCGGCTCATGGATGCAAAGTGTTTGCTGAGACTCTTCTCACTAACCCTGGAGCTTCAAAAACCTATCAGGAGAGTTTAGAAGGAGGCATGACAGTGTTCTGTCCAGGAGATGATGCAATGAAAGGTTTCTTGCCCAAATACAAGAACTTGACAGCTCCAAAGAAAGAAGCATTTCTCGATTTCCTCGCTGTCCCGACATATTACTCAATGGCGATGCTCAAATCCAACAATGGTCCGATGAACACACTTGCGACAGATGGAGCTAACAAGTTTGAGCTTACTGTACAGAACGATGGAGAGAAGGTTACCCTCAAGACAAGGATCAACACTGTCAAGATCGTTGATACTCTTATTGATGAGCAGCCTTTAGCTATATATGCGACTGATAAGGTTTTGTTGCCTAAAGAGTTGTTTAAGGCTTCGGCTGTTGAAGCTCCGGCTCCTGCTCCGGCACCAGAGGATGGTGATGTTGCGGATTCTCCAAAAGCGGCTAAAGGGAAAGCGAAAGGAAAGAAGAAGAAGGCTGCACCGTCGCCAGATAATGATCCTTTTGGTGACTCGGATTCGCCTGCCGAAGGGCCTGACGGAGAGGCCGATGATGCGACGGCAGATGATGCTGGTGCGGTTAGGATCATCGGAGGAGCTAAGGCTGGTTTGGTGGTGAGCTTGCTCTGCTTGTTTGCTTCTTCTTGGCTTCTATAGTTTCACTTCGTTTCTTCTATTCTTCCATGTTTTTTTTTTTGTGAATCTTTTATTTATGGTTTTTGGGGGAAAGTAAATGAGGATTATTTATTTCCCTCTATTGTTGAGTTTTTTTTATTTATTTAAAAGTTGGTTGTCGAATTAAATAGTCGGTAGTTTATATATTTGTGTGTTCTTGTTTCACGTGTTTGTTTAGTTGATGATGTAAACAAGTCCTGATTTTGGTG

SEQ ID NO: 1491 - DNA, 906 bp, Arabidopsis thaliana
  misc_feature (1)..(906): Ceres cDNA ID no. 12643383
  misc_feature (1)..(906): Also known as  Ceres CDNA ID no. 23656099
atggctaattcctcctccttctccccctctaccaccgtaacagatttaatctccaccgtccatgacgacatcatagagtctcacatcttgacacgtctcgacggcgcaaccttagcatccgtctcttgcgcctcctcacatcttcatcatctcgcttccaatgagatcctctggtccaaaatctgccgatccacgtggccttcttgctccggtggttctcgttctttcttctccgacgcttattctatggtggaaaccgccggtacagtctctgatctcgaccgtccgtttccggaattgatctccgccgtggatcttcactacagagggaagttgatttttagtagagtcgtgaagacggagactacgacggcgtggtttaagagttcgccgttgaggattgatctggtggatacaaaggatacggtggcgacgccgattaagagaagacagaggacggaagacacgtgtcgtgatctagagaaggatttgactttgagctggatcgtgattgatccgatcgggaaacgagcggcgaatatttcgagtcaccggccggtgtcggtgcagaggaactggataagcggagaagtggaggcgcaattcgcgacggtggtgggggcggtggagtgtgtgatcacggtggtcacgtgcggtgaggaggagatgcacgtgagggaagtgagtctcaaggtagagaagatggagggaacgcatttaaacgggagggacagtttggttattttaaggagtgtcatggagggtaaaagggtaaatggaagtaggagggaagtagaatcgaagaagagacacgaagagtttatggagaagaagagagagatgaaggagaagaagatgagggtagaatcggtatttgacattttgactgtacttttggtattttag

SEQ ID NO: 1492 - protein, 906 aa, Arabidopsis thaliana
  misc_feature: PFam Name: Mito_carr; PFam Description: Mitochondrial
  misc_feature: GI Number: 51970652; NR Description: mitochondrial carrier
  misc_feature: GI Number: 23197668; NR Description: putative mitochondrial carrier protein [Arabidopsis thaliana] >gi|22135876|gb|AAM91520.1| putative mitochondrial carrier protein [Arabidopsis thaliana] >gi|51968668|dbj|BAD43026.1|
  misc_feature: GI Number: 4895195; NR Description: putative mitochondrial carrier protein [Arabidopsis thaliana] >gi|25295875|pir||D84798 probable mitochondrial carrier protein [imported] - Arabidopsis
  misc_feature: GI Number: 17104715; NR Description: putative Ca-dependent solute carrier protein [Arabidopsis thaliana] >gi|13877985|gb|AAK44070.1| putative Ca-dependent solute carrier
  misc_feature: GI Number: 21554682; NR Description: Ca-dependent solute
ATGGCTAATTCCTCCTCCTTCTCCCCCTCTACCACCGTAACAGATTTAATCTCCACCGTCCATGACGACATCATAGAGTCTCACATCTTGACACGTCTCGACGGCGCAACCTTAGCATCCGTCTCTTGCGCCTCCTCACATCTTCATCATCTCGCTTCCAATGAGATCCTCTGGTCCAAAATCTGCCGATCCACGTGGCCTTCTTGCTCCGGTGGTTCTCGTTCTTTCTTCTCCGACGCTTATTCTATGGTGGAAACCGCCGGTACAGTCTCTGATCTCGACCGTCCGTTTCCGGAATTGATCTCCGCCGTGGATCTTCACTACAGAGGGAAGTTGATTTTTAGTAGAGTCGTGAAGACGGAGACTACGACGGCGTGGTTTAAGAGTTCGCCGTTGAGGATTGATCTGGTGGATACAAAGGATACGGTGGCGACGCCGATTAAGAGAAGACAGAGGACGGAAGACACGTGTCGTGATCTAGAGAAGGATTTGACTTTGAGCTGGATCGTGATTGATCCGATCGGGAAACGAGCGGCGAATATTTCGAGTCACCGGCCGGTGTCGGTGCAGAGGAACTGGATAAGCGGAGAAGTGGAGGCGCAATTCGCGACGGTGGTGGGGGCGGTGGAGTGTGTGATCACGGTGGTCACGTGCGGTGAGGAGGAGATGCACGTGAGGGAAGTGAGTCTCAAGGTAGAGAAGATGGAGGGAACGCATTTAAACGGGAGGGACAGTTTGGTTATTTTAAGGAGTGTCATGGAGGGTAAAAGGGTAAATGGAAGTAGGAGGGAAGTAGAATCGAAGAAGAGACACGAAGAGTTTATGGAGAAGAAGAGAGAGATGAAGGAGAAGAAGATGAGGGTAGAATCGGTATTTGACATTTTGACTGTACTTTTGGTATTTTAG

SEQ ID NO: 1493 - DNA, 2458 bp, Arabidopsis thaliana
  misc_feature (1)..(2458): Ceres cDNA ID no. 12643515
  misc_feature (1)..(2458): Also known as  Ceres CDNA ID no. 23656099
atgcttaaacagtttacgcattattgcgaaatgcaagccgagctgatacccgaaggtcctaacggtgagggccgtttatcaaaccagaacagcaaccctaatttactctcttctgcttctatcagtattactcagtttcctgctaagaagccgactaggcaatgggctgcttggacacatcaagaagaggaaagtttcttcactgctcttcgtcaagttggaaagaattttgagaagataacttctcgtgttcagagcaaaaacaaggaccaggtcaggcattactattatcgtttagtgaggcgtatgaacaaacttttgggcccggatctgagccttgatgccaagaacccaaaggacaccaatgctgcaatgctacgatggtggtctttgcttgaaaagtatagctgcaaagcttcaaaacttcatctcaagccccggagattcaaactatttatagaggccttggaacaccaattgctgaaagaccgcagaaagagcataagaaaacggacttgccagggagaaaatctctcttctgcttccctcggaaacatctcaagtcatagtagagaaagaggattggataaccgtccatttaaacttattctctccgacggccaaaatgttaaaaagctagggcctggaagagcatctaccaaacatggtgaaagcttaagtgtcaaccttggtgacgaaaaagaagacacagcctttgggagaggtggaaggcaacggcgaaaacaaggttatagaaaatgggaaaaagctgcaatagatggggtctctctggttgctgatgctgcagagcatttggaacgaacatcaattgacaaagatatggatgatcaaacaggtcccacaagatatttaaccggaaagtctccactttctctatgctcagctggtgatgttcctctcagtgatgccaatatgcagttttctgccaagcttaaacttcagctgttcccgattgatgaatgtactcgaagatccttggaaatggataagcacaatccgcatcttgaacttactcttagtaatcgcaagaagatatcatctgtacttgaacatctcaatcgcaaatggggaagctcaagttgtgcgactggagagctattgctatttccttacaacgcacgaaaagaaactgtaacgtgccatcagaggtggacccatgactcttttctaagcgcagcagaagtgcattcaatggtcggaagtccttcggttttccgcttaaggtatggttggtttgtccatgatgcgtcaggttctattatttctcaagttccaacttcagatccttgcccttcactcgaggatgacatgaatgtggataggttgaacgaggtcaacatgctccttactgaatcaggacccttgtctgtgcattcaactgctgaacaaacgacatctgtagagcccagtcagggtctagtatgtgcatctggtgtccatgatcgtcccgcaagatctagagatgattatgaacctgcttcaacgagtattactccacttgagcatttgagcggcggtaatgcacaatcaccaggagaatgggctgatagtcttactaacataagtataggtgatctactttctgaagtgcccgatgacatagatagtgatggtgttgatccacctgccaccgaaggttcacattacctccttcgagatgtcccatttacctctgactcttttgatgctgcaattgctgctcatatactaagacaccagaacaagccaagtgctcaactaccgctgacttctggctcttcctctctgtgggatgatgaagaaacacgtgatgccttctctttccaaaaaaatcgtttcgcaaattccaccgagctggctagtgttgcttctcctaaaggtgttggcagagtaaatggagagccttcacagttggtggaggcttcatccggcgatgagggatcttataaccctcatgacgatggagatccaatggaagagggtccagcagaccctcatacgatggattctccagggaagaccccttgtggacttgcggatgtatactggcccgactcgttaggaccactggatttagacattagatcgtcaaagtatacagatgatttgatccttagtgagagcctcgggggattgagccgtctgatagcaaccagccttgatgcgtttcagaactgctcgctctttgggttcgacaataagaaggacaagtctaacatggtatgaaatggaaccaaagctaaagcatggggtccaaatgttgatagttgaaaaagaaagtgacttcttgccttttgaaaaaagaaacttttatcaccaactgatagcttcactgtacaaaaatttgatgtaaccttttactcttcctttcacacattcttttgtgttgatacatgtttctctgtgtacacttttactgttaatttacatgtttatttggctaccatgccttctttct

SEQ ID NO: 1494 - protein, 2458 aa, Arabidopsis thaliana
  misc_feature: PFam Name: Mito_carr; PFam Description: Mitochondrial
  misc_feature: GI Number: 51970652; NR Description: mitochondrial carrier
  misc_feature: GI Number: 23197668; NR Description: putative mitochondrial carrier protein [Arabidopsis thaliana] >gi|22135876|gb|AAM91520.1| putative mitochondrial carrier protein [Arabidopsis thaliana] >gi|51968668|dbj|BAD43026.1|
  misc_feature: GI Number: 4895195; NR Description: putative mitochondrial carrier protein [Arabidopsis thaliana] >gi|25295875|pir||D84798 probable mitochondrial carrier protein [imported] - Arabidopsis
  misc_feature: GI Number: 17104715; NR Description: putative Ca-dependent solute carrier protein [Arabidopsis thaliana] >gi|13877985|gb|AAK44070.1| putative Ca-dependent solute carrier
  misc_feature: GI Number: 21554682; NR Description: Ca-dependent solute
ATGCTTAAACAGTTTACGCATTATTGCGAAATGCAAGCCGAGCTGATACCCGAAGGTCCTAACGGTGAGGGCCGTTTATCAAACCAGAACAGCAACCCTAATTTACTCTCTTCTGCTTCTATCAGTATTACTCAGTTTCCTGCTAAGAAGCCGACTAGGCAATGGGCTGCTTGGACACATCAAGAAGAGGAAAGTTTCTTCACTGCTCTTCGTCAAGTTGGAAAGAATTTTGAGAAGATAACTTCTCGTGTTCAGAGCAAAAACAAGGACCAGGTCAGGCATTACTATTATCGTTTAGTGAGGCGTATGAACAAACTTTTGGGCCCGGATCTGAGCCTTGATGCCAAGAACCCAAAGGACACCAATGCTGCAATGCTACGATGGTGGTCTTTGCTTGAAAAGTATAGCTGCAAAGCTTCAAAACTTCATCTCAAGCCCCGGAGATTCAAACTATTTATAGAGGCCTTGGAACACCAATTGCTGAAAGACCGCAGAAAGAGCATAAGAAAACGGACTTGCCAGGGAGAAAATCTCTCTTCTGCTTCCCTCGGAAACATCTCAAGTCATAGTAGAGAAAGAGGATTGGATAACCGTCCATTTAAACTTATTCTCTCCGACGGCCAAAATGTTAAAAAGCTAGGGCCTGGAAGAGCATCTACCAAACATGGTGAAAGCTTAAGTGTCAACCTTGGTGACGAAAAAGAAGACACAGCCTTTGGGAGAGGTGGAAGGCAACGGCGAAAACAAGGTTATAGAAAATGGGAAAAAGCTGCAATAGATGGGGTCTCTCTGGTTGCTGATGCTGCAGAGCATTTGGAACGAACATCAATTGACAAAGATATGGATGATCAAACAGGTCCCACAAGATATTTAACCGGAAAGTCTCCACTTTCTCTATGCTCAGCTGGTGATGTTCCTCTCAGTGATGCCAATATGCAGTTTTCTGCCAAGCTTAAACTTCAGCTGTTCCCGATTGATGAATGTACTCGAAGATCCTTGGAAATGGATAAGCACAATCCGCATCTTGAACTTACTCTTAGTAATCGCAAGAAGATATCATCTGTACTTGAACATCTCAATCGCAAATGGGGAAGCTCAAGTTGTGCGACTGGAGAGCTATTGCTATTTCCTTACAACGCACGAAAAGAAACTGTAACGTGCCATCAGAGGTGGACCCATGACTCTTTTCTAAGCGCAGCAGAAGTGCATTCAATGGTCGGAAGTCCTTCGGTTTTCCGCTTAAGGTATGGTTGGTTTGTCCATGATGCGTCAGGTTCTATTATTTCTCAAGTTCCAACTTCAGATCCTTGCCCTTCACTCGAGGATGACATGAATGTGGATAGGTTGAACGAGGTCAACATGCTCCTTACTGAATCAGGACCCTTGTCTGTGCATTCAACTGCTGAACAAACGACATCTGTAGAGCCCAGTCAGGGTCTAGTATGTGCATCTGGTGTCCATGATCGTCCCGCAAGATCTAGAGATGATTATGAACCTGCTTCAACGAGTATTACTCCACTTGAGCATTTGAGCGGCGGTAATGCACAATCACCAGGAGAATGGGCTGATAGTCTTACTAACATAAGTATAGGTGATCTACTTTCTGAAGTGCCCGATGACATAGATAGTGATGGTGTTGATCCACCTGCCACCGAAGGTTCACATTACCTCCTTCGAGATGTCCCATTTACCTCTGACTCTTTTGATGCTGCAATTGCTGCTCATATACTAAGACACCAGAACAAGCCAAGTGCTCAACTACCGCTGACTTCTGGCTCTTCCTCTCTGTGGGATGATGAAGAAACACGTGATGCCTTCTCTTTCCAAAAAAATCGTTTCGCAAATTCCACCGAGCTGGCTAGTGTTGCTTCTCCTAAAGGTGTTGGCAGAGTAAATGGAGAGCCTTCACAGTTGGTGGAGGCTTCATCCGGCGATGAGGGATCTTATAACCCTCATGACGATGGAGATCCAATGGAAGAGGGTCCAGCAGACCCTCATACGATGGATTCTCCAGGGAAGACCCCTTGTGGACTTGCGGATGTATACTGGCCCGACTCGTTAGGACCACTGGATTTAGACATTAGATCGTCAAAGTATACAGATGATTTGATCCTTAGTGAGAGCCTCGGGGGATTGAGCCGTCTGATAGCAACCAGCCTTGATGCGTTTCAGAACTGCTCGCTCTTTGGGTTCGACAATAAGAAGGACAAGTCTAACATGGTATGAAATGGAACCAAAGCTAAAGCATGGGGTCCAAATGTTGATAGTTGAAAAAGAAAGTGACTTCTTGCCTTTTGAAAAAAGAAACTTTTATCACCAACTGATAGCTTCACTGTACAAAAATTTGATGTAACCTTTTACTCTTCCTTTCACACATTCTTTTGTGTTGATACATGTTTCTCTGTGTACACTTTTACTGTTAATTTACATGTTTATTTGGCTACCATGCCTTCTTTCT

SEQ ID NO: 1495 - DNA, 2344 bp, Arabidopsis thaliana
  misc_feature (1)..(2344): Ceres cDNA ID no. 12643559
  misc_feature (1)..(2344): Also known as  Ceres CDNA ID no. 23656099
atggcagattcaagctgttctctccctcctctttatgaaaacatttcatacaaaagttatattctaagagctgtggatctcacgattcttggccttctcttttctcttctcttgcaccgaatcctatatatgagccaaaacggcatcatttggctcgtggctttcctttgtgaatcttgtttctcattcgtgtggctccttagtacctgcacaaaatggagtcctgctgaaactaaaccctatccagatagacttgatgaaagggtttatgatcttccctcagtagatatgttcgtgcccaccgcagatccagttcgagaaccgccaattatggttgtgaataccgtactttcgctgttagcagtgaattatccagcgaataaacttgcttgttatgtatcggatgatggatgctcacctctcacttacttttctctcaaggaagcttctaagttcgccaagatttgggttcccttctgcaaaaaatataaccttaaagttagagctccttttcggtatttcttaaacccttttgccgcaacagagggttctgaattcagtagagattgggaaatgactaagagggagtacgagaagttatgccggaaagtggaagatgccaccggagattctcatttgttgggcacagacaatgaattggaagctttttcaaacacaaaaccaaatgatcattcaactataatcaaggtggtatgggagaacaaaggaggtgtaggagacgagaaagaggtccctcatatcgtatacatttcaagagaaaaaagaccaaactaccttcatcattacaaagctggagccatgaactttctggcaagagtgtcagggttgatgacaaatgcaccatacatgttgaacgtggactgcgacatgtatgcaaacgaagcagatgtggtgcgacaagcaatgtgtatatttctgcaaaaatcacaaaatcaaaaccattgtgcttttgttcaattccctcaagagttctatgattctaacaccatcaaactcaccgtcataaaatcatatatgggacgaggaattgcaggaatccaaggaccaataaatgttggttcaggttgcttccacagtagaagagttatgtacggtttatcgccggacgaattagaagacaatggaagtctttcttcggttgctacaagggagcttttggctgaggatagtttgtcaagtggatttgggaattcaaaagagatggtgacatcggttgttgaggcattacaaagaaaaccaaatccccaaaatatacttacaaactccatagaagcggctcaagaagtgggacattgtgactacgagtcccaaaccagctggggcaaaaccattggttggttatacgattcaatgtcagaagatatgaacactagtatcggaatccactcgagaggttggactagctcatacattgctccggatccacctgcgtttcttggatctatgccgccgggaggactggaggcaatgatccagcaacggcgatgggcaacaggatcgatcgaagttcttttcaacaaacaaagtccgttgctaggattgttttgcagaaaattaagatttcgacagcgagtagcttatctttgcgtttccatttgtgtaaggtcaatccctgagctcatttattgtctcttgcctgcatattgcctactccacaactctgccttatttcccaagggactttgtcttggcataacaatgttacttgcggggatgcactgtctctacactctatgggaatttatgtgtcttggtcattccatacaatcgtggtatgtctcacagtcattttggagaatagtagccactagtagttggttatttagcatctttgatattatactcaagcttcttggactctcgaaaaacgtgttcttagtatctaaaaagactatgcccgtcgaaaccatgtcaggatctgggattggaccatctcaaagagaagatgatggtccgaactcaggtaaaactgaatttgacggctcactttatttcttgcccggcacatttattgtcttggtgaatctagccgcccttgttggggttttcgtgggtctacaacggtcaagttatagtcatggaggaggtggttcgggtttgggagaagcttgtgcatgtattttggtggttatgttgttctttccattcctaaagggtttgtttgcgaaaggaaaatatggaatcccattgtctactctctcaaaagctggctttttagcagtttcatttgttgttttctctgtaggaaactagtatagtgatattgttttgttatatatgtaaagaagttaacttcattattaaacacatcaatttgaataca

SEQ ID NO: 1496 - protein, 2344 aa, Arabidopsis thaliana
  misc_feature: PFam Name: Mito_carr; PFam Description: Mitochondrial
  misc_feature: GI Number: 51970652; NR Description: mitochondrial carrier
  misc_feature: GI Number: 23197668; NR Description: putative mitochondrial carrier protein [Arabidopsis thaliana] >gi|22135876|gb|AAM91520.1| putative mitochondrial carrier protein [Arabidopsis thaliana] >gi|51968668|dbj|BAD43026.1|
  misc_feature: GI Number: 4895195; NR Description: putative mitochondrial carrier protein [Arabidopsis thaliana] >gi|25295875|pir||D84798 probable mitochondrial carrier protein [imported] - Arabidopsis
  misc_feature: GI Number: 17104715; NR Description: putative Ca-dependent solute carrier protein [Arabidopsis thaliana] >gi|13877985|gb|AAK44070.1| putative Ca-dependent solute carrier
  misc_feature: GI Number: 21554682; NR Description: Ca-dependent solute
ATGGCAGATTCAAGCTGTTCTCTCCCTCCTCTTTATGAAAACATTTCATACAAAAGTTATATTCTAAGAGCTGTGGATCTCACGATTCTTGGCCTTCTCTTTTCTCTTCTCTTGCACCGAATCCTATATATGAGCCAAAACGGCATCATTTGGCTCGTGGCTTTCCTTTGTGAATCTTGTTTCTCATTCGTGTGGCTCCTTAGTACCTGCACAAAATGGAGTCCTGCTGAAACTAAACCCTATCCAGATAGACTTGATGAAAGGGTTTATGATCTTCCCTCAGTAGATATGTTCGTGCCCACCGCAGATCCAGTTCGAGAACCGCCAATTATGGTTGTGAATACCGTACTTTCGCTGTTAGCAGTGAATTATCCAGCGAATAAACTTGCTTGTTATGTATCGGATGATGGATGCTCACCTCTCACTTACTTTTCTCTCAAGGAAGCTTCTAAGTTCGCCAAGATTTGGGTTCCCTTCTGCAAAAAATATAACCTTAAAGTTAGAGCTCCTTTTCGGTATTTCTTAAACCCTTTTGCCGCAACAGAGGGTTCTGAATTCAGTAGAGATTGGGAAATGACTAAGAGGGAGTACGAGAAGTTATGCCGGAAAGTGGAAGATGCCACCGGAGATTCTCATTTGTTGGGCACAGACAATGAATTGGAAGCTTTTTCAAACACAAAACCAAATGATCATTCAACTATAATCAAGGTGGTATGGGAGAACAAAGGAGGTGTAGGAGACGAGAAAGAGGTCCCTCATATCGTATACATTTCAAGAGAAAAAAGACCAAACTACCTTCATCATTACAAAGCTGGAGCCATGAACTTTCTGGCAAGAGTGTCAGGGTTGATGACAAATGCACCATACATGTTGAACGTGGACTGCGACATGTATGCAAACGAAGCAGATGTGGTGCGACAAGCAATGTGTATATTTCTGCAAAAATCACAAAATCAAAACCATTGTGCTTTTGTTCAATTCCCTCAAGAGTTCTATGATTCTAACACCATCAAACTCACCGTCATAAAATCATATATGGGACGAGGAATTGCAGGAATCCAAGGACCAATAAATGTTGGTTCAGGTTGCTTCCACAGTAGAAGAGTTATGTACGGTTTATCGCCGGACGAATTAGAAGACAATGGAAGTCTTTCTTCGGTTGCTACAAGGGAGCTTTTGGCTGAGGATAGTTTGTCAAGTGGATTTGGGAATTCAAAAGAGATGGTGACATCGGTTGTTGAGGCATTACAAAGAAAACCAAATCCCCAAAATATACTTACAAACTCCATAGAAGCGGCTCAAGAAGTGGGACATTGTGACTACGAGTCCCAAACCAGCTGGGGCAAAACCATTGGTTGGTTATACGATTCAATGTCAGAAGATATGAACACTAGTATCGGAATCCACTCGAGAGGTTGGACTAGCTCATACATTGCTCCGGATCCACCTGCGTTTCTTGGATCTATGCCGCCGGGAGGACTGGAGGCAATGATCCAGCAACGGCGATGGGCAACAGGATCGATCGAAGTTCTTTTCAACAAACAAAGTCCGTTGCTAGGATTGTTTTGCAGAAAATTAAGATTTCGACAGCGAGTAGCTTATCTTTGCGTTTCCATTTGTGTAAGGTCAATCCCTGAGCTCATTTATTGTCTCTTGCCTGCATATTGCCTACTCCACAACTCTGCCTTATTTCCCAAGGGACTTTGTCTTGGCATAACAATGTTACTTGCGGGGATGCACTGTCTCTACACTCTATGGGAATTTATGTGTCTTGGTCATTCCATACAATCGTGGTATGTCTCACAGTCATTTTGGAGAATAGTAGCCACTAGTAGTTGGTTATTTAGCATCTTTGATATTATACTCAAGCTTCTTGGACTCTCGAAAAACGTGTTCTTAGTATCTAAAAAGACTATGCCCGTCGAAACCATGTCAGGATCTGGGATTGGACCATCTCAAAGAGAAGATGATGGTCCGAACTCAGGTAAAACTGAATTTGACGGCTCACTTTATTTCTTGCCCGGCACATTTATTGTCTTGGTGAATCTAGCCGCCCTTGTTGGGGTTTTCGTGGGTCTACAACGGTCAAGTTATAGTCATGGAGGAGGTGGTTCGGGTTTGGGAGAAGCTTGTGCATGTATTTTGGTGGTTATGTTGTTCTTTCCATTCCTAAAGGGTTTGTTTGCGAAAGGAAAATATGGAATCCCATTGTCTACTCTCTCAAAAGCTGGCTTTTTAGCAGTTTCATTTGTTGTTTTCTCTGTAGGAAACTAGTATAGTGATATTGTTTTGTTATATATGTAAAGAAGTTAACTTCATTATTAAACACATCAATTTGAATACA

SEQ ID NO: 1497 - DNA, 1407 bp, Arabidopsis thaliana
  misc_feature (1)..(1407): Ceres cDNA ID no. 12644485
  misc_feature (1)..(1407): Also known as  Ceres CDNA ID no. 23656099
atgggtgtttttggatcgaatgaatcgtcaagcatgagtattgtgatgtatccgtggttagcctttggtcacatgactccttttcttcacctatccaacaagctcgcagagaaaggtcacaagattgttttcttgcttcccaagaaagcactaaaccagcttgaacctcttaatctctacccaaatctcatcactttccacaccatctctatccctcaggtcaaagggctccctccgggtgcggagacaaactccgacgtccctttcttcttgacacatttgcttgcagttgcaatggaccaaacccggccagaggtcgagaccattttccgtacaatcaaaccggacttggttttctatgattctgcccattggataccggaaattgctaaaccgatcggtgctaaaaccgtttgcttcaacatcgttagcgctgcgtcaatcgcactgtctcttgtcccttctgcggagagagaggtcattgatggcaaggaaatgtcaggggaggagttagctaagacgcctctaggttacccatcttcgaaagtagtcttacgtccgcacgaagcaaaatccctgagtttcgtgtggaggaagcacgaggcgattggctctttctttgatgggaaagttaccgcgatgagaaactgcgacgcaatcgctataaggacttgccgtgagacagaaggcaaattctgcgattacataagtaggcagtacagtaaaccggtttacctaacaggaccggttctccctggatcccaacctaatcagccctccttagatcctcaatgggcggagtggctagccaaattcaaccacggttcggttgtgttctgcgctttcggtagccaacccgttgtaaacaagatagatcagtttcaagaactctgtttaggtctagaatcaactggttttccgtttctggttgccattaagcctccttcgggtgtatcaaccgtcgaggaagccttaccggaaggattcaaagagagggttcaaggacgtggcgttgtgtttggaggttggattcagcaaccgttggtgttgaaccatccttcagtgggttgttttgttagccattgcgggtttgggtcgatgtgggagtcgttgatgagtgattgtcagatcgttttggttccgcagcacggagaacagattttgaacgcaaggctgatgacggaggagatggaggtggcggttgaagtggagagggaaaagaaagggtggttctcgcggcaaagcttggagaatgctgtgaagagtgtgatggaggaaggtagtgagatcggtgagaaagtgaggaagaatcatgacaagtggagatgtgttttgactgactctggtttttcagatggttatattgataagtttgaacaaaatttaattgaacttgtgaagtcatga

SEQ ID NO: 1498 - protein, 1407 aa, Arabidopsis thaliana
  misc_feature: PFam Name: Mito_carr; PFam Description: Mitochondrial
  misc_feature: GI Number: 51970652; NR Description: mitochondrial carrier
  misc_feature: GI Number: 23197668; NR Description: putative mitochondrial carrier protein [Arabidopsis thaliana] >gi|22135876|gb|AAM91520.1| putative mitochondrial carrier protein [Arabidopsis thaliana] >gi|51968668|dbj|BAD43026.1|
  misc_feature: GI Number: 4895195; NR Description: putative mitochondrial carrier protein [Arabidopsis thaliana] >gi|25295875|pir||D84798 probable mitochondrial carrier protein [imported] - Arabidopsis
  misc_feature: GI Number: 17104715; NR Description: putative Ca-dependent solute carrier protein [Arabidopsis thaliana] >gi|13877985|gb|AAK44070.1| putative Ca-dependent solute carrier
  misc_feature: GI Number: 21554682; NR Description: Ca-dependent solute
ATGGGTGTTTTTGGATCGAATGAATCGTCAAGCATGAGTATTGTGATGTATCCGTGGTTAGCCTTTGGTCACATGACTCCTTTTCTTCACCTATCCAACAAGCTCGCAGAGAAAGGTCACAAGATTGTTTTCTTGCTTCCCAAGAAAGCACTAAACCAGCTTGAACCTCTTAATCTCTACCCAAATCTCATCACTTTCCACACCATCTCTATCCCTCAGGTCAAAGGGCTCCCTCCGGGTGCGGAGACAAACTCCGACGTCCCTTTCTTCTTGACACATTTGCTTGCAGTTGCAATGGACCAAACCCGGCCAGAGGTCGAGACCATTTTCCGTACAATCAAACCGGACTTGGTTTTCTATGATTCTGCCCATTGGATACCGGAAATTGCTAAACCGATCGGTGCTAAAACCGTTTGCTTCAACATCGTTAGCGCTGCGTCAATCGCACTGTCTCTTGTCCCTTCTGCGGAGAGAGAGGTCATTGATGGCAAGGAAATGTCAGGGGAGGAGTTAGCTAAGACGCCTCTAGGTTACCCATCTTCGAAAGTAGTCTTACGTCCGCACGAAGCAAAATCCCTGAGTTTCGTGTGGAGGAAGCACGAGGCGATTGGCTCTTTCTTTGATGGGAAAGTTACCGCGATGAGAAACTGCGACGCAATCGCTATAAGGACTTGCCGTGAGACAGAAGGCAAATTCTGCGATTACATAAGTAGGCAGTACAGTAAACCGGTTTACCTAACAGGACCGGTTCTCCCTGGATCCCAACCTAATCAGCCCTCCTTAGATCCTCAATGGGCGGAGTGGCTAGCCAAATTCAACCACGGTTCGGTTGTGTTCTGCGCTTTCGGTAGCCAACCCGTTGTAAACAAGATAGATCAGTTTCAAGAACTCTGTTTAGGTCTAGAATCAACTGGTTTTCCGTTTCTGGTTGCCATTAAGCCTCCTTCGGGTGTATCAACCGTCGAGGAAGCCTTACCGGAAGGATTCAAAGAGAGGGTTCAAGGACGTGGCGTTGTGTTTGGAGGTTGGATTCAGCAACCGTTGGTGTTGAACCATCCTTCAGTGGGTTGTTTTGTTAGCCATTGCGGGTTTGGGTCGATGTGGGAGTCGTTGATGAGTGATTGTCAGATCGTTTTGGTTCCGCAGCACGGAGAACAGATTTTGAACGCAAGGCTGATGACGGAGGAGATGGAGGTGGCGGTTGAAGTGGAGAGGGAAAAGAAAGGGTGGTTCTCGCGGCAAAGCTTGGAGAATGCTGTGAAGAGTGTGATGGAGGAAGGTAGTGAGATCGGTGAGAAAGTGAGGAAGAATCATGACAAGTGGAGATGTGTTTTGACTGACTCTGGTTTTTCAGATGGTTATATTGATAAGTTTGAACAAAATTTAATTGAACTTGTGAAGTCATGA

SEQ ID NO: 1499 - DNA, 1224 bp, Arabidopsis thaliana
  misc_feature (1)..(1224): Ceres cDNA ID no. 12646268
  misc_feature (1)..(1224): Also known as  Ceres CDNA ID no. 23656099
atgctgaatttaggcagagctagaaccgggaggcaaaacagatctatgtcttttgaaggattggattttgcagacccaaagaagaacaacaattacatggggaagattgttttggtcatgacacttacagcaatgtgcattctcttgctcaaccaatccccaaccttcaataccccaagcgtgttttctcgaagtgaaccaggagttacacatgttctagtcactggtggtgcagggtatatcgggtcacatgcagctttacgccttctaaaagattcataccgtgtcaccattgtggacaatctatctcgagggaacctcggtgcagtcaagatcttgcaacaactgtttccggaacctggaaagcttcaattcatttatgctgatcttggagatgcaaatgctgttaacaaaatattttctgaaaacgcatttgacgctgtgatgcattttgctgctgttgcttattattatcacaatatcacatcgaacacattggtagttttagagacaatggctgctcatggtgtgaagactttgatatattcaagcacatgtgctacttatggagagcctgagaaaatgccaataacagaggaaactccacaggttccaatcaatccatatggaaaggctaaaaagatggcagaagatatcatcttggatttctccaagaattctattatggcagttatgatcctaagatatttcaatgtgattgggtctgatcctgagggtagactaggtgaagctccaagacctgaactcagtgagcatggacggatctctggtgcttgctttgatgctgcacgaggcatcattcccgggctgcagattaaaggaacagactacaagactgttgatgggacttgtgtacgtgattacattgatgtcaccgacttggttgatgctcatgttaaagctcttgaaaaggcgaaaccccgcaaagttggtatcttcaatgttggtaccgggaaaggtagctcggtgaaggagtttgtggaagcgtgcaaaaaggcgaccggcgttgatataaaagtcgattacttggaaagacgggcaggagattacgcagaggtttacagcgatccaagaaaaatcaaagaagagctgaattggacagctaagcacaccaatcttcaagaaagtttaaagatggcatggagatggcaaaagcttcatcgcagtggctatggatcttcttccttggtttctgcatactga

SEQ ID NO: 1500 - protein, 1224 aa, Arabidopsis thaliana
  misc_feature: PFam Name: Mito_carr; PFam Description: Mitochondrial
  misc_feature: GI Number: 51970652; NR Description: mitochondrial carrier
  misc_feature: GI Number: 23197668; NR Description: putative mitochondrial carrier protein [Arabidopsis thaliana] >gi|22135876|gb|AAM91520.1| putative mitochondrial carrier protein [Arabidopsis thaliana] >gi|51968668|dbj|BAD43026.1|
  misc_feature: GI Number: 4895195; NR Description: putative mitochondrial carrier protein [Arabidopsis thaliana] >gi|25295875|pir||D84798 probable mitochondrial carrier protein [imported] - Arabidopsis
  misc_feature: GI Number: 17104715; NR Description: putative Ca-dependent solute carrier protein [Arabidopsis thaliana] >gi|13877985|gb|AAK44070.1| putative Ca-dependent solute carrier
  misc_feature: GI Number: 21554682; NR Description: Ca-dependent solute
ATGCTGAATTTAGGCAGAGCTAGAACCGGGAGGCAAAACAGATCTATGTCTTTTGAAGGATTGGATTTTGCAGACCCAAAGAAGAACAACAATTACATGGGGAAGATTGTTTTGGTCATGACACTTACAGCAATGTGCATTCTCTTGCTCAACCAATCCCCAACCTTCAATACCCCAAGCGTGTTTTCTCGAAGTGAACCAGGAGTTACACATGTTCTAGTCACTGGTGGTGCAGGGTATATCGGGTCACATGCAGCTTTACGCCTTCTAAAAGATTCATACCGTGTCACCATTGTGGACAATCTATCTCGAGGGAACCTCGGTGCAGTCAAGATCTTGCAACAACTGTTTCCGGAACCTGGAAAGCTTCAATTCATTTATGCTGATCTTGGAGATGCAAATGCTGTTAACAAAATATTTTCTGAAAACGCATTTGACGCTGTGATGCATTTTGCTGCTGTTGCTTATTATTATCACAATATCACATCGAACACATTGGTAGTTTTAGAGACAATGGCTGCTCATGGTGTGAAGACTTTGATATATTCAAGCACATGTGCTACTTATGGAGAGCCTGAGAAAATGCCAATAACAGAGGAAACTCCACAGGTTCCAATCAATCCATATGGAAAGGCTAAAAAGATGGCAGAAGATATCATCTTGGATTTCTCCAAGAATTCTATTATGGCAGTTATGATCCTAAGATATTTCAATGTGATTGGGTCTGATCCTGAGGGTAGACTAGGTGAAGCTCCAAGACCTGAACTCAGTGAGCATGGACGGATCTCTGGTGCTTGCTTTGATGCTGCACGAGGCATCATTCCCGGGCTGCAGATTAAAGGAACAGACTACAAGACTGTTGATGGGACTTGTGTACGTGATTACATTGATGTCACCGACTTGGTTGATGCTCATGTTAAAGCTCTTGAAAAGGCGAAACCCCGCAAAGTTGGTATCTTCAATGTTGGTACCGGGAAAGGTAGCTCGGTGAAGGAGTTTGTGGAAGCGTGCAAAAAGGCGACCGGCGTTGATATAAAAGTCGATTACTTGGAAAGACGGGCAGGAGATTACGCAGAGGTTTACAGCGATCCAAGAAAAATCAAAGAAGAGCTGAATTGGACAGCTAAGCACACCAATCTTCAAGAAAGTTTAAAGATGGCATGGAGATGGCAAAAGCTTCATCGCAGTGGCTATGGATCTTCTTCCTTGGTTTCTGCATACTGA

SEQ ID NO: 1501 - DNA, 1353 bp, Arabidopsis thaliana
  misc_feature (1)..(1353): Ceres cDNA ID no. 12646556
  misc_feature (1)..(1353): Also known as  Ceres CDNA ID no. 23656099
atgcttgcaccttttactgctggatggcagagtgctgatttagatcccttggtcattgcaaagtctgagggaagttatgtgtatgatgatactgggaaaaaatatcttgactctctcgctggtttatggtgtactgccttaggaggaaatgagccaaggcttgtttctgccgctgttgaacagttgaacaccttgccgttttatcactccttttggaaccgtactactaaaccttctctggatcttgctaaggttcttttagagatgttcacggccaacaaaatggccaaagcattttttacaagcggtggatcagatgccaacgatacccaggtcaagctggtttggtattacaataacgcacttggaaggcccgagaagaaaaagtttatcgcgagaaagaaatcgtaccatggctccactctaatatcagcaagtttgtccggccttcccccgctacaccaaaattttgatttacctgcaccatttgtgttgcacacagattgccctcattattggcgttttcatcttccaggcgaaacggaagaggagttctcaaccagattagccaagaatttagaggatctaatcatcaaagaaggaccagaaactattggtgcttttatagctgaaccagtcatgggtgctgggggtgtgatacctccacctgctacctactttgaaaaggttcaagctgttgttaagaaatatgatatcttgttcattgctgatgaggtgatatgtgcatttggaaggctcgggacaatgtttggctgtgacaaatacaacattaagccagatcttgtgaccttagctaaggcactgtcttcagcatatatgccgattggagccattcttatgagccaagaagtggcagatgtcataaattctcatagcagcaagctaggcgttttctcccatggatttacttattctggtcatccagtttcgtgtgctgtagcaattgaagcgttaaagatatacaaggagaggaacataccagagtatgtcgccaaagttgccccaaggtttcaagatggagttaaagcgtttgcctctggtagtcctattattggagagacaagaggaacaggtttgattcttgggactgagtttgtagacaataaatctccgaacgaaccatttccaccagaatggggtgttggcgcattctttggagccgagtgccagaagcacgggatgttagtccgtgttgcaggtgatggcattttgatgtctccaccgctcattatctcacctgaagagattgatgagttgatttctatctatgggaaagcattgaaggcaacggaagagaaggtaaaagaactcaaggctcagcacaagaagtga

SEQ ID NO: 1502 - protein, 1353 aa, Arabidopsis thaliana
  misc_feature: PFam Name: Mito_carr; PFam Description: Mitochondrial
  misc_feature: GI Number: 51970652; NR Description: mitochondrial carrier
  misc_feature: GI Number: 23197668; NR Description: putative mitochondrial carrier protein [Arabidopsis thaliana] >gi|22135876|gb|AAM91520.1| putative mitochondrial carrier protein [Arabidopsis thaliana] >gi|51968668|dbj|BAD43026.1|
  misc_feature: GI Number: 4895195; NR Description: putative mitochondrial carrier protein [Arabidopsis thaliana] >gi|25295875|pir||D84798 probable mitochondrial carrier protein [imported] - Arabidopsis
  misc_feature: GI Number: 17104715; NR Description: putative Ca-dependent solute carrier protein [Arabidopsis thaliana] >gi|13877985|gb|AAK44070.1| putative Ca-dependent solute carrier
  misc_feature: GI Number: 21554682; NR Description: Ca-dependent solute
ATGCTTGCACCTTTTACTGCTGGATGGCAGAGTGCTGATTTAGATCCCTTGGTCATTGCAAAGTCTGAGGGAAGTTATGTGTATGATGATACTGGGAAAAAATATCTTGACTCTCTCGCTGGTTTATGGTGTACTGCCTTAGGAGGAAATGAGCCAAGGCTTGTTTCTGCCGCTGTTGAACAGTTGAACACCTTGCCGTTTTATCACTCCTTTTGGAACCGTACTACTAAACCTTCTCTGGATCTTGCTAAGGTTCTTTTAGAGATGTTCACGGCCAACAAAATGGCCAAAGCATTTTTTACAAGCGGTGGATCAGATGCCAACGATACCCAGGTCAAGCTGGTTTGGTATTACAATAACGCACTTGGAAGGCCCGAGAAGAAAAAGTTTATCGCGAGAAAGAAATCGTACCATGGCTCCACTCTAATATCAGCAAGTTTGTCCGGCCTTCCCCCGCTACACCAAAATTTTGATTTACCTGCACCATTTGTGTTGCACACAGATTGCCCTCATTATTGGCGTTTTCATCTTCCAGGCGAAACGGAAGAGGAGTTCTCAACCAGATTAGCCAAGAATTTAGAGGATCTAATCATCAAAGAAGGACCAGAAACTATTGGTGCTTTTATAGCTGAACCAGTCATGGGTGCTGGGGGTGTGATACCTCCACCTGCTACCTACTTTGAAAAGGTTCAAGCTGTTGTTAAGAAATATGATATCTTGTTCATTGCTGATGAGGTGATATGTGCATTTGGAAGGCTCGGGACAATGTTTGGCTGTGACAAATACAACATTAAGCCAGATCTTGTGACCTTAGCTAAGGCACTGTCTTCAGCATATATGCCGATTGGAGCCATTCTTATGAGCCAAGAAGTGGCAGATGTCATAAATTCTCATAGCAGCAAGCTAGGCGTTTTCTCCCATGGATTTACTTATTCTGGTCATCCAGTTTCGTGTGCTGTAGCAATTGAAGCGTTAAAGATATACAAGGAGAGGAACATACCAGAGTATGTCGCCAAAGTTGCCCCAAGGTTTCAAGATGGAGTTAAAGCGTTTGCCTCTGGTAGTCCTATTATTGGAGAGACAAGAGGAACAGGTTTGATTCTTGGGACTGAGTTTGTAGACAATAAATCTCCGAACGAACCATTTCCACCAGAATGGGGTGTTGGCGCATTCTTTGGAGCCGAGTGCCAGAAGCACGGGATGTTAGTCCGTGTTGCAGGTGATGGCATTTTGATGTCTCCACCGCTCATTATCTCACCTGAAGAGATTGATGAGTTGATTTCTATCTATGGGAAAGCATTGAAGGCAACGGAAGAGAAGGTAAAAGAACTCAAGGCTCAGCACAAGAAGTGA

SEQ ID NO: 1503 - DNA, 2205 bp, Arabidopsis thaliana
  misc_feature (1)..(2205): Ceres cDNA ID no. 12647844
  misc_feature (1)..(2205): Also known as  Ceres CDNA ID no. 23656099
atggatgctccggttccactctctttatctactctgttagaactctgcaccaatctcttgcaaaaatctgtaaacaagtccaatggtcgtttcacagcgcaattggttcattgccgtgttatcaaatcgggtcttatgttcagcgtctacctgatgaataatctcatgaacgtctactcaaaaactggttatgctcttcacgcacgcaagctgttcgacgaaatgcctctaagaacagctttttcatggaacacggttctttcggcttattctaaacgaggagatatggattcgacttgtgagttctttgatcagttgcctcaaagggattcggtttcgtggactacgatgattgttgggtataagaacattggtcaatatcataaggctataagagttatgggggatatggtcaaggaagggattgagccgacgcagtttacgcttacgaatgtgcttgcatcggtggctgcaacgcggtgtatggaaacaggtaaaaaggttcattctttcatcgttaagcttggtcttcgcggtaacgtttctgtgtcgaattcactgcttaatatgtatgcaaaatgtggtgatccaatgatggcaaaatttgttttcgatagaatggttgttagagatatctcaagctggaatgctatgattgcgttacatatgcaggtcggtcaaatggatcttgctatggcgcagttcgagcaaatggctgagcgagatatagtcacttggaattctatgatttctggtttcaatcagagagggtatgatctcagagctctagatatcttttcgaagatgctgagggattctctgttgtcgccggatagattcactctggcgagtgtgttatctgcttgtgccaatcttgagaaactttgtattgggaagcagattcattcgcacattgttactacagggtttgatatttccggaatcgtgttaaatgcattgatctcgatgtattcgaggttcgcatggaccgccatgattgtaggatatgagcaacacggttcgtatggtgaagctataaaccttttcagatcaatggttggaggagggcagagaccaaacagttacactcttgcagcaatgttaagtgtagcttcaagtttggcatcattgagccatggcaagcaaatccatgggagtgctgtaaagtcaggggaaatttattcagtttctgtcagcaatgcattgataacaatgtatgcaaaggcgggtaacattacatcggcaagccgggcatttgatttgatacgctgtgagagggatacagtatcgtggacatccatgattatcgcgttggcacagcacggtcacgcagaagaagcacttgagctttttgagacaatgctgatggaaggactaagacctgatcacataacatatgttggtgttttctctgcctgtactcatgccggtttggtcaaccaaggtcgtcaatacttcgatatgatgaaggacgttgataagattatacctacccttagccactatgcttgtatggtggacctgtttggacgtgctggtttattgcaggaagcacaagagttcatcgaaaagatgcctattgagcctgatgtagtgacatggggttcactgctttctgcttgcagagttcacaagaacatcgatcttgggaaagttgcagcagagagattgcttcttctcgagccagagaacagcggggcatactcagccttggctaacttatactcagcttgtggaaaatgggaagaagctgctaagataagaaaatcaatgaaagatggaagagtaaagaaggaacaagggtttagctggattgaagtgaagcataaagtccatgtctttggagtggaagacgggactcatccagagaagaacgagatctacatgaccatgaagaagatttgggacgagatcaagaaaatgggttatgttcccgacacagcttctgtactacacgacctcgaagaagaggttaaagaacagattctaaggcaccacagcgagaaactagcaatcgcatttggactaattagcactccggataaaaccacattgaggatcatgaagaatctcagagtgtgcaatgattgccacacggctataaagttcatttccaagcttgtgggaagggaaatcatagtgagagatacaacaagatttcaccatttcaaagatgggttttgttcttgccgagattattggtga

SEQ ID NO: 1504 - protein, 2205 aa, Arabidopsis thaliana
  misc_feature: PFam Name: Mito_carr; PFam Description: Mitochondrial
  misc_feature: GI Number: 51970652; NR Description: mitochondrial carrier
  misc_feature: GI Number: 23197668; NR Description: putative mitochondrial carrier protein [Arabidopsis thaliana] >gi|22135876|gb|AAM91520.1| putative mitochondrial carrier protein [Arabidopsis thaliana] >gi|51968668|dbj|BAD43026.1|
  misc_feature: GI Number: 4895195; NR Description: putative mitochondrial carrier protein [Arabidopsis thaliana] >gi|25295875|pir||D84798 probable mitochondrial carrier protein [imported] - Arabidopsis
  misc_feature: GI Number: 17104715; NR Description: putative Ca-dependent solute carrier protein [Arabidopsis thaliana] >gi|13877985|gb|AAK44070.1| putative Ca-dependent solute carrier
  misc_feature: GI Number: 21554682; NR Description: Ca-dependent solute
ATGGATGCTCCGGTTCCACTCTCTTTATCTACTCTGTTAGAACTCTGCACCAATCTCTTGCAAAAATCTGTAAACAAGTCCAATGGTCGTTTCACAGCGCAATTGGTTCATTGCCGTGTTATCAAATCGGGTCTTATGTTCAGCGTCTACCTGATGAATAATCTCATGAACGTCTACTCAAAAACTGGTTATGCTCTTCACGCACGCAAGCTGTTCGACGAAATGCCTCTAAGAACAGCTTTTTCATGGAACACGGTTCTTTCGGCTTATTCTAAACGAGGAGATATGGATTCGACTTGTGAGTTCTTTGATCAGTTGCCTCAAAGGGATTCGGTTTCGTGGACTACGATGATTGTTGGGTATAAGAACATTGGTCAATATCATAAGGCTATAAGAGTTATGGGGGATATGGTCAAGGAAGGGATTGAGCCGACGCAGTTTACGCTTACGAATGTGCTTGCATCGGTGGCTGCAACGCGGTGTATGGAAACAGGTAAAAAGGTTCATTCTTTCATCGTTAAGCTTGGTCTTCGCGGTAACGTTTCTGTGTCGAATTCACTGCTTAATATGTATGCAAAATGTGGTGATCCAATGATGGCAAAATTTGTTTTCGATAGAATGGTTGTTAGAGATATCTCAAGCTGGAATGCTATGATTGCGTTACATATGCAGGTCGGTCAAATGGATCTTGCTATGGCGCAGTTCGAGCAAATGGCTGAGCGAGATATAGTCACTTGGAATTCTATGATTTCTGGTTTCAATCAGAGAGGGTATGATCTCAGAGCTCTAGATATCTTTTCGAAGATGCTGAGGGATTCTCTGTTGTCGCCGGATAGATTCACTCTGGCGAGTGTGTTATCTGCTTGTGCCAATCTTGAGAAACTTTGTATTGGGAAGCAGATTCATTCGCACATTGTTACTACAGGGTTTGATATTTCCGGAATCGTGTTAAATGCATTGATCTCGATGTATTCGAGGTTCGCATGGACCGCCATGATTGTAGGATATGAGCAACACGGTTCGTATGGTGAAGCTATAAACCTTTTCAGATCAATGGTTGGAGGAGGGCAGAGACCAAACAGTTACACTCTTGCAGCAATGTTAAGTGTAGCTTCAAGTTTGGCATCATTGAGCCATGGCAAGCAAATCCATGGGAGTGCTGTAAAGTCAGGGGAAATTTATTCAGTTTCTGTCAGCAATGCATTGATAACAATGTATGCAAAGGCGGGTAACATTACATCGGCAAGCCGGGCATTTGATTTGATACGCTGTGAGAGGGATACAGTATCGTGGACATCCATGATTATCGCGTTGGCACAGCACGGTCACGCAGAAGAAGCACTTGAGCTTTTTGAGACAATGCTGATGGAAGGACTAAGACCTGATCACATAACATATGTTGGTGTTTTCTCTGCCTGTACTCATGCCGGTTTGGTCAACCAAGGTCGTCAATACTTCGATATGATGAAGGACGTTGATAAGATTATACCTACCCTTAGCCACTATGCTTGTATGGTGGACCTGTTTGGACGTGCTGGTTTATTGCAGGAAGCACAAGAGTTCATCGAAAAGATGCCTATTGAGCCTGATGTAGTGACATGGGGTTCACTGCTTTCTGCTTGCAGAGTTCACAAGAACATCGATCTTGGGAAAGTTGCAGCAGAGAGATTGCTTCTTCTCGAGCCAGAGAACAGCGGGGCATACTCAGCCTTGGCTAACTTATACTCAGCTTGTGGAAAATGGGAAGAAGCTGCTAAGATAAGAAAATCAATGAAAGATGGAAGAGTAAAGAAGGAACAAGGGTTTAGCTGGATTGAAGTGAAGCATAAAGTCCATGTCTTTGGAGTGGAAGACGGGACTCATCCAGAGAAGAACGAGATCTACATGACCATGAAGAAGATTTGGGACGAGATCAAGAAAATGGGTTATGTTCCCGACACAGCTTCTGTACTACACGACCTCGAAGAAGAGGTTAAAGAACAGATTCTAAGGCACCACAGCGAGAAACTAGCAATCGCATTTGGACTAATTAGCACTCCGGATAAAACCACATTGAGGATCATGAAGAATCTCAGAGTGTGCAATGATTGCCACACGGCTATAAAGTTCATTTCCAAGCTTGTGGGAAGGGAAATCATAGTGAGAGATACAACAAGATTTCACCATTTCAAAGATGGGTTTTGTTCTTGCCGAGATTATTGGTGA

SEQ ID NO: 1505 - DNA, 909 bp, Arabidopsis thaliana
  misc_feature (1)..(909): Ceres cDNA ID no. 12647875
  misc_feature (1)..(909): Also known as  Ceres CDNA ID no. 23656099
acctgcaaaaacaacatctctcacattctctctaaactctcttcactgttactcgacaatggctactacttctaactcggtacttttcctaagttctgactcactgattcatcatcatcatcatcaacctctccatctatcttcctccagatctcactctgtttctctcccacccaacaagcgatccaattctctcacgcttcgttgttcaacaaatggcgatagcacctcaaccgaaaaggaaacaccaatcgaactcaaattcccagcatttccaacggtaatggacattaaccaaatcagagagatattgcctcacaggtttccgtttctgctggtagatagagtgatagagtatacgcctggtgtttcagctgtagctattaagaatgtcaccatcaatgacaatttcttccctggccatttccctgaacgaccaatcatgcctggtgttctcatgattgaggcaatggcgcaagtcggaggtatagtaatgctgcagccggaagtaggaggctctcaagataacttcttctttgctggtattgataaagtgagatttcgcaaaccagtgattgcaggagacacgctagtcatgaggatgactcttctcaagttccagaagcggttcgggctcgctaaaatggaaggtaaagcttatgtgggtggtgctctggtgtgtgaaggcgagttcatgatggtttctgctggtagttcttgatctcacccattaatggtctcacttcccacatgtggactcttcttatgcttcttctgttattcgaaaatctagacaagacagctttatgttttcgacatttatatgagctacttttgcccttcgtgtctttattgctgtctccaatttatgaacattcataagatacaaatacagagattttgattttg

SEQ ID NO: 1506 - protein, 909 aa, Arabidopsis thaliana
  misc_feature: PFam Name: Mito_carr; PFam Description: Mitochondrial
  misc_feature: GI Number: 51970652; NR Description: mitochondrial carrier
  misc_feature: GI Number: 23197668; NR Description: putative mitochondrial carrier protein [Arabidopsis thaliana] >gi|22135876|gb|AAM91520.1| putative mitochondrial carrier protein [Arabidopsis thaliana] >gi|51968668|dbj|BAD43026.1|
  misc_feature: GI Number: 4895195; NR Description: putative mitochondrial carrier protein [Arabidopsis thaliana] >gi|25295875|pir||D84798 probable mitochondrial carrier protein [imported] - Arabidopsis
  misc_feature: GI Number: 17104715; NR Description: putative Ca-dependent solute carrier protein [Arabidopsis thaliana] >gi|13877985|gb|AAK44070.1| putative Ca-dependent solute carrier
  misc_feature: GI Number: 21554682; NR Description: Ca-dependent solute
ACCTGCAAAAACAACATCTCTCACATTCTCTCTAAACTCTCTTCACTGTTACTCGACAATGGCTACTACTTCTAACTCGGTACTTTTCCTAAGTTCTGACTCACTGATTCATCATCATCATCATCAACCTCTCCATCTATCTTCCTCCAGATCTCACTCTGTTTCTCTCCCACCCAACAAGCGATCCAATTCTCTCACGCTTCGTTGTTCAACAAATGGCGATAGCACCTCAACCGAAAAGGAAACACCAATCGAACTCAAATTCCCAGCATTTCCAACGGTAATGGACATTAACCAAATCAGAGAGATATTGCCTCACAGGTTTCCGTTTCTGCTGGTAGATAGAGTGATAGAGTATACGCCTGGTGTTTCAGCTGTAGCTATTAAGAATGTCACCATCAATGACAATTTCTTCCCTGGCCATTTCCCTGAACGACCAATCATGCCTGGTGTTCTCATGATTGAGGCAATGGCGCAAGTCGGAGGTATAGTAATGCTGCAGCCGGAAGTAGGAGGCTCTCAAGATAACTTCTTCTTTGCTGGTATTGATAAAGTGAGATTTCGCAAACCAGTGATTGCAGGAGACACGCTAGTCATGAGGATGACTCTTCTCAAGTTCCAGAAGCGGTTCGGGCTCGCTAAAATGGAAGGTAAAGCTTATGTGGGTGGTGCTCTGGTGTGTGAAGGCGAGTTCATGATGGTTTCTGCTGGTAGTTCTTGATCTCACCCATTAATGGTCTCACTTCCCACATGTGGACTCTTCTTATGCTTCTTCTGTTATTCGAAAATCTAGACAAGACAGCTTTATGTTTTCGACATTTATATGAGCTACTTTTGCCCTTCGTGTCTTTATTGCTGTCTCCAATTTATGAACATTCATAAGATACAAATACAGAGATTTTGATTTTG

SEQ ID NO: 1507 - DNA, 1154 bp, Arabidopsis thaliana
  misc_feature (1)..(1154): Ceres cDNA ID no. 12648759
  misc_feature (1)..(1154): Also known as  Ceres CDNA ID no. 23656099
ataacatatatttcttcttcgtttcattcataatcgtcttataaccacagattctaaaacatgggagaagaagtaaaaccagaggcaaaggaggcagcctctgctccacaggccgtccccgctgaggaggaggagaagaagaaagatgtagcggaggagaagaaagtggcggctgaggaggagaaaccaaaggaggaagaggagccgcaaccaccaccaccgcctccacccttcatactctacgtcgacttgcattgtgttggatgcgctaagaagattgaaagatctattctaaaaattagaggtgtggaagaagtggtgatggatatgaatgagaaccaagtgacgataaagggagtgttggatccgcaagcagtgtgcaacaaaatcaagaagaagactaaaagaatggccaaagtcctctcgccgcttccggcagctgagggagagcctctgccaccaatcataacctctcaggtctccggcggcctcaccaccgtcgagctcagcgttaacatgcactgccaagcttgtgctgaccagctcaagaagaagattctcaaaatgagaggggtccaaacaactgtgacagagcacaccacgggaaaagtaatagtgactgggacaatggacgctgagaagcttgtggattacgtctaccgtcggaccaaaaagcaagcccgaatcgtaccccaacctgacccggaacctgaagcccccgcggccgcgcaggaagaaaagaaggaggagagcggtgaaggcaatgaaaaaccaccagagaccggagaggaaaaggaagaagagaagaagaaggagggagaggaaaatggagaggaaggtggtggagaagaggcggcggctacggaggaagagagacgagacaatgaaatgacggctatggcccaagaagaagggatgaagaggatgatgtattactatcaaccttcatacgtcatagagaggattcctccgccgcagctttttagcgacgagaaccctaatgcttgttgcatttcttaattaaatttggtttcgtatatgtctatggaaaatataattagaggaattaataattaggtaagaaaagaaagaaaataggtaaagaatttgtaaactatttattttttaatataatgtacgtgtgtttggtatct

SEQ ID NO: 1508 - protein, 1154 aa, Arabidopsis thaliana
  misc_feature: PFam Name: Mito_carr; PFam Description: Mitochondrial
  misc_feature: GI Number: 51970652; NR Description: mitochondrial carrier
  misc_feature: GI Number: 23197668; NR Description: putative mitochondrial carrier protein [Arabidopsis thaliana] >gi|22135876|gb|AAM91520.1| putative mitochondrial carrier protein [Arabidopsis thaliana] >gi|51968668|dbj|BAD43026.1|
  misc_feature: GI Number: 4895195; NR Description: putative mitochondrial carrier protein [Arabidopsis thaliana] >gi|25295875|pir||D84798 probable mitochondrial carrier protein [imported] - Arabidopsis
  misc_feature: GI Number: 17104715; NR Description: putative Ca-dependent solute carrier protein [Arabidopsis thaliana] >gi|13877985|gb|AAK44070.1| putative Ca-dependent solute carrier
  misc_feature: GI Number: 21554682; NR Description: Ca-dependent solute
ATAACATATATTTCTTCTTCGTTTCATTCATAATCGTCTTATAACCACAGATTCTAAAACATGGGAGAAGAAGTAAAACCAGAGGCAAAGGAGGCAGCCTCTGCTCCACAGGCCGTCCCCGCTGAGGAGGAGGAGAAGAAGAAAGATGTAGCGGAGGAGAAGAAAGTGGCGGCTGAGGAGGAGAAACCAAAGGAGGAAGAGGAGCCGCAACCACCACCACCGCCTCCACCCTTCATACTCTACGTCGACTTGCATTGTGTTGGATGCGCTAAGAAGATTGAAAGATCTATTCTAAAAATTAGAGGTGTGGAAGAAGTGGTGATGGATATGAATGAGAACCAAGTGACGATAAAGGGAGTGTTGGATCCGCAAGCAGTGTGCAACAAAATCAAGAAGAAGACTAAAAGAATGGCCAAAGTCCTCTCGCCGCTTCCGGCAGCTGAGGGAGAGCCTCTGCCACCAATCATAACCTCTCAGGTCTCCGGCGGCCTCACCACCGTCGAGCTCAGCGTTAACATGCACTGCCAAGCTTGTGCTGACCAGCTCAAGAAGAAGATTCTCAAAATGAGAGGGGTCCAAACAACTGTGACAGAGCACACCACGGGAAAAGTAATAGTGACTGGGACAATGGACGCTGAGAAGCTTGTGGATTACGTCTACCGTCGGACCAAAAAGCAAGCCCGAATCGTACCCCAACCTGACCCGGAACCTGAAGCCCCCGCGGCCGCGCAGGAAGAAAAGAAGGAGGAGAGCGGTGAAGGCAATGAAAAACCACCAGAGACCGGAGAGGAAAAGGAAGAAGAGAAGAAGAAGGAGGGAGAGGAAAATGGAGAGGAAGGTGGTGGAGAAGAGGCGGCGGCTACGGAGGAAGAGAGACGAGACAATGAAATGACGGCTATGGCCCAAGAAGAAGGGATGAAGAGGATGATGTATTACTATCAACCTTCATACGTCATAGAGAGGATTCCTCCGCCGCAGCTTTTTAGCGACGAGAACCCTAATGCTTGTTGCATTTCTTAATTAAATTTGGTTTCGTATATGTCTATGGAAAATATAATTAGAGGAATTAATAATTAGGTAAGAAAAGAAAGAAAATAGGTAAAGAATTTGTAAACTATTTATTTTTTAATATAATGTACGTGTGTTTGGTATCT

SEQ ID NO: 1509 - DNA, 1263 bp, Arabidopsis thaliana
  misc_feature (1)..(1263): Ceres cDNA ID no. 12648778
  misc_feature (1)..(1263): Also known as  Ceres CDNA ID no. 23656099
atgggaagatcaccaatggttcctatggctgttcttgtttatgtttctctactgttctctgtttcttattcctccacgttcgtcatcacaaataactgtccctttactatatggcctggaactcttgcaggctctggcacccagccactacccaccacagggttcaggcttgatgtgggacagtctgttagaattcccacggctctaggctggtcaggtcgtatttgggctaggactggctgcaactttgatgctaacggcgcgggaaaatgtatgactggagactgcggcggaaagctggagtgtgctggtaatggcgctgctccgccgacatctcttttcgagatcacactcggtcacggttctgatgacaaagatttctatgatgtcagtctcgttgatgggtataaccttcccatagttgctctcccgacgggtggtggactggttggcgcttgtaatgctacaggatgtgttgctgatatcaatattagctgtccaaaggagcttcaagtgatgggagaggaagaggctgaaagaggaggggttgttgcatgcaagagcgcttgtgaggcctttgggttggaccagtactgttgcagcggtcagtttgctaacccgaccacatgccgaccgtctttatactcttccatcttcaagagagcttgtcccagagcttatagctatgccttcgatgatggaaccagtactttcacctgcaaggcttctgaatatgcaattatcttctgccctggcagggtaaaaagaccagacagtctgaactcggatcctcccagcccacctcagaatcagttagggcaacctatggctcccccaactcaaaatcagtatggtcaacctatggctcctgcacctcagtatcagtacggtcaacctatggctccaccgactcaaaatcagtatggtcaacctctggctcctccgactcaaaatcaatacgatcaacctctggctcctccgactcaaaatcaatatggtcaacctatggctccaccaactccgcccccacccggaccaaacgaggattcaatgactcccccacctcagaatcagaatggggatgggcagttcatgcctcctcccactttggaccaagatccaaacgaccagtatatgaatcccccaattcaggatcagagtcaaagagagactcaatcttcatccgatcttcttcgaccttaccctgtcttgttgcttcttggctttagtctaactgctttgaggcaatctggcacgacatga

SEQ ID NO: 1510 - protein, 1263 aa, Arabidopsis thaliana
  misc_feature: PFam Name: Mito_carr; PFam Description: Mitochondrial
  misc_feature: GI Number: 51970652; NR Description: mitochondrial carrier
  misc_feature: GI Number: 23197668; NR Description: putative mitochondrial carrier protein [Arabidopsis thaliana] >gi|22135876|gb|AAM91520.1| putative mitochondrial carrier protein [Arabidopsis thaliana] >gi|51968668|dbj|BAD43026.1|
  misc_feature: GI Number: 4895195; NR Description: putative mitochondrial carrier protein [Arabidopsis thaliana] >gi|25295875|pir||D84798 probable mitochondrial carrier protein [imported] - Arabidopsis
  misc_feature: GI Number: 17104715; NR Description: putative Ca-dependent solute carrier protein [Arabidopsis thaliana] >gi|13877985|gb|AAK44070.1| putative Ca-dependent solute carrier
  misc_feature: GI Number: 21554682; NR Description: Ca-dependent solute
ATGGGAAGATCACCAATGGTTCCTATGGCTGTTCTTGTTTATGTTTCTCTACTGTTCTCTGTTTCTTATTCCTCCACGTTCGTCATCACAAATAACTGTCCCTTTACTATATGGCCTGGAACTCTTGCAGGCTCTGGCACCCAGCCACTACCCACCACAGGGTTCAGGCTTGATGTGGGACAGTCTGTTAGAATTCCCACGGCTCTAGGCTGGTCAGGTCGTATTTGGGCTAGGACTGGCTGCAACTTTGATGCTAACGGCGCGGGAAAATGTATGACTGGAGACTGCGGCGGAAAGCTGGAGTGTGCTGGTAATGGCGCTGCTCCGCCGACATCTCTTTTCGAGATCACACTCGGTCACGGTTCTGATGACAAAGATTTCTATGATGTCAGTCTCGTTGATGGGTATAACCTTCCCATAGTTGCTCTCCCGACGGGTGGTGGACTGGTTGGCGCTTGTAATGCTACAGGATGTGTTGCTGATATCAATATTAGCTGTCCAAAGGAGCTTCAAGTGATGGGAGAGGAAGAGGCTGAAAGAGGAGGGGTTGTTGCATGCAAGAGCGCTTGTGAGGCCTTTGGGTTGGACCAGTACTGTTGCAGCGGTCAGTTTGCTAACCCGACCACATGCCGACCGTCTTTATACTCTTCCATCTTCAAGAGAGCTTGTCCCAGAGCTTATAGCTATGCCTTCGATGATGGAACCAGTACTTTCACCTGCAAGGCTTCTGAATATGCAATTATCTTCTGCCCTGGCAGGGTAAAAAGACCAGACAGTCTGAACTCGGATCCTCCCAGCCCACCTCAGAATCAGTTAGGGCAACCTATGGCTCCCCCAACTCAAAATCAGTATGGTCAACCTATGGCTCCTGCACCTCAGTATCAGTACGGTCAACCTATGGCTCCACCGACTCAAAATCAGTATGGTCAACCTCTGGCTCCTCCGACTCAAAATCAATACGATCAACCTCTGGCTCCTCCGACTCAAAATCAATATGGTCAACCTATGGCTCCACCAACTCCGCCCCCACCCGGACCAAACGAGGATTCAATGACTCCCCCACCTCAGAATCAGAATGGGGATGGGCAGTTCATGCCTCCTCCCACTTTGGACCAAGATCCAAACGACCAGTATATGAATCCCCCAATTCAGGATCAGAGTCAAAGAGAGACTCAATCTTCATCCGATCTTCTTCGACCTTACCCTGTCTTGTTGCTTCTTGGCTTTAGTCTAACTGCTTTGAGGCAATCTGGCACGACATGA

SEQ ID NO: 1511 - DNA, 1623 bp, Arabidopsis thaliana
  misc_feature (1)..(1623): Ceres cDNA ID no. 12649001
  misc_feature (1)..(1623): Also known as  Ceres CDNA ID no. 23656099
atgggatttgaagacaagaaaatgctgagacagagacataagcgttctaagagctgtactgttcctgagaagaaaaagcttgaagatgagaatagcattgattcttctctggatgcttctcaacgcctcaagctcgacttacctcgttgcggcgataaatcttttgaaatgaagaaggatctatcccctgatgtaaaattcaagagctctctgaagcaagagattcaagagcttgagaaaagattacagaaccagtttgatgtccgtggtgcgttagagaaggcattaggctataaaacaccatctcgagacatcaaaggcgactctactccaaagcctccaacagaattgatcaaggaaatcgcggtgttggagttagaagtttctcatttggaacagtaccttctatctttgtatcgtaaagcgtttgatcaacaaacatcttctgaggacatcgattcatgtgttcgtcgttgccagtcctctcttaatcaacgttccaccttcaataaccgaatatctccaccagaagactcggtattcgcgtgccactcccaaccattgtccatacatgaatacatacaaaatggatcaaatgatgcaagccttgcagaacacatgggaactcggatatctgatcacatattcatgactccaaacaagttatcagaggaaatgatcaagtgtgcatcagctatatattccaagctcgctgatccaccatcgataaaccacggtttctcatccccgagttcgtctccatcatcaacaagcgagttttcaccacaagaccagtatgatatgtggagtccaagcttcagaaaaaactcgtctttcgatgaccagtttgaattcagcggaccttatagctcaatgatcgaagtgtcacacattcatcgaaaccgtaaaagacgcgaccttgacctgatgaatcgaaacttcagcttacttcttaagcaactggaaagtgttgatccgagaaaactgactcatcaagagaaactggcgttctggattaacgtacataacgctcttgtgatgcatacatttctggcaaatgggattccacagaacaatgggaagcgatttttactactctccaagccagcttacaagataggaggtcgcatggtaagcttagaagcaatacaaagttatattcttcgtatcaagatgcctcgtcctggccagtggctgaagttattactcatacctaaaaaattcagaaccggagatgaacatcaagaatattccctcgagcattccgagcctctcttatactttgcactttgttcaggcaaccattctgaccctgcgattcgtgtttttacgcccaagggaatataccaagagctagaaaccgcaaaggaagagtacatccgcgcaacgtttggagtaaagaaagaccagaaactagtcttaccaaagatcattgagtcttttagcaaagactcaggtttaggtcaagcagcattgatggagatgattcaagaatgtctcccggaaacaatgaaaaaaaccataaagaaacttaactcagggagatcccgaaagagcattgtcgaatggacgcctcataatttcgtgtttcggtatttgatagccagagaacttgttagatga

SEQ ID NO: 1512 - protein, 1623 aa, Arabidopsis thaliana
  misc_feature: PFam Name: Mito_carr; PFam Description: Mitochondrial
  misc_feature: GI Number: 51970652; NR Description: mitochondrial carrier
  misc_feature: GI Number: 23197668; NR Description: putative mitochondrial carrier protein [Arabidopsis thaliana] >gi|22135876|gb|AAM91520.1| putative mitochondrial carrier protein [Arabidopsis thaliana] >gi|51968668|dbj|BAD43026.1|
  misc_feature: GI Number: 4895195; NR Description: putative mitochondrial carrier protein [Arabidopsis thaliana] >gi|25295875|pir||D84798 probable mitochondrial carrier protein [imported] - Arabidopsis
  misc_feature: GI Number: 17104715; NR Description: putative Ca-dependent solute carrier protein [Arabidopsis thaliana] >gi|13877985|gb|AAK44070.1| putative Ca-dependent solute carrier
  misc_feature: GI Number: 21554682; NR Description: Ca-dependent solute
ATGGGATTTGAAGACAAGAAAATGCTGAGACAGAGACATAAGCGTTCTAAGAGCTGTACTGTTCCTGAGAAGAAAAAGCTTGAAGATGAGAATAGCATTGATTCTTCTCTGGATGCTTCTCAACGCCTCAAGCTCGACTTACCTCGTTGCGGCGATAAATCTTTTGAAATGAAGAAGGATCTATCCCCTGATGTAAAATTCAAGAGCTCTCTGAAGCAAGAGATTCAAGAGCTTGAGAAAAGATTACAGAACCAGTTTGATGTCCGTGGTGCGTTAGAGAAGGCATTAGGCTATAAAACACCATCTCGAGACATCAAAGGCGACTCTACTCCAAAGCCTCCAACAGAATTGATCAAGGAAATCGCGGTGTTGGAGTTAGAAGTTTCTCATTTGGAACAGTACCTTCTATCTTTGTATCGTAAAGCGTTTGATCAACAAACATCTTCTGAGGACATCGATTCATGTGTTCGTCGTTGCCAGTCCTCTCTTAATCAACGTTCCACCTTCAATAACCGAATATCTCCACCAGAAGACTCGGTATTCGCGTGCCACTCCCAACCATTGTCCATACATGAATACATACAAAATGGATCAAATGATGCAAGCCTTGCAGAACACATGGGAACTCGGATATCTGATCACATATTCATGACTCCAAACAAGTTATCAGAGGAAATGATCAAGTGTGCATCAGCTATATATTCCAAGCTCGCTGATCCACCATCGATAAACCACGGTTTCTCATCCCCGAGTTCGTCTCCATCATCAACAAGCGAGTTTTCACCACAAGACCAGTATGATATGTGGAGTCCAAGCTTCAGAAAAAACTCGTCTTTCGATGACCAGTTTGAATTCAGCGGACCTTATAGCTCAATGATCGAAGTGTCACACATTCATCGAAACCGTAAAAGACGCGACCTTGACCTGATGAATCGAAACTTCAGCTTACTTCTTAAGCAACTGGAAAGTGTTGATCCGAGAAAACTGACTCATCAAGAGAAACTGGCGTTCTGGATTAACGTACATAACGCTCTTGTGATGCATACATTTCTGGCAAATGGGATTCCACAGAACAATGGGAAGCGATTTTTACTACTCTCCAAGCCAGCTTACAAGATAGGAGGTCGCATGGTAAGCTTAGAAGCAATACAAAGTTATATTCTTCGTATCAAGATGCCTCGTCCTGGCCAGTGGCTGAAGTTATTACTCATACCTAAAAAATTCAGAACCGGAGATGAACATCAAGAATATTCCCTCGAGCATTCCGAGCCTCTCTTATACTTTGCACTTTGTTCAGGCAACCATTCTGACCCTGCGATTCGTGTTTTTACGCCCAAGGGAATATACCAAGAGCTAGAAACCGCAAAGGAAGAGTACATCCGCGCAACGTTTGGAGTAAAGAAAGACCAGAAACTAGTCTTACCAAAGATCATTGAGTCTTTTAGCAAAGACTCAGGTTTAGGTCAAGCAGCATTGATGGAGATGATTCAAGAATGTCTCCCGGAAACAATGAAAAAAACCATAAAGAAACTTAACTCAGGGAGATCCCGAAAGAGCATTGTCGAATGGACGCCTCATAATTTCGTGTTTCGGTATTTGATAGCCAGAGAACTTGTTAGATGA

SEQ ID NO: 1513 - DNA, 1326 bp, Arabidopsis thaliana
  misc_feature (1)..(1326): Ceres cDNA ID no. 12649730
  misc_feature (1)..(1326): Also known as  Ceres CDNA ID no. 23656099
atgaaattcaaattctcgttcccagaagaaactgagcttcgaagaaacgtttacactagtagttccggtgaagaaaacagagtcgtcgttgattctcgtcatgtttctcaacagatcctcactgtccgatctactaactccactttacagagtaaaccggaaaaactaaaccggagaaatttggtggaacaaggattagcgaaagcaagagcatcgattttagaagcttcttcgaatgttaacactacattgttcaaatctgatcttccaaactcagaaatttatcgtaatccatcagctttatatcggagttacttagaaatggagaagaggtttaaggtgtatgtatacgaagaaggcgagccaccgctagttcacgatggaccgtgtaagagtgtttacgcggttgaagggagattcataactgagatggagaaaagaaggactaagtttcgtacttatgatcctaaccaagcttatgtttacttcttgccatttagtgttacttggctggttcgatacttatacgaaggcaattctgatgctaagcctttgaaaacatttgtttccgattatatcagattagtatctactaatcatcctttttggaatcgaactaatggtgctgatcacttcatgcttacttgtcacgattggggacctctgacttcacaagctaatagagatttgttcaacacttcgattcgagttatgtgtaatgctaattcatcagaagggtttaatcctactaaagatgtgactcttcctgagatcaaactctatggtggtgaagttgatcacaaactcaggttatctaaaaccttatccgcttctccgcggccttacctcgggttcttcgcaggcggtgtccacggtccggttagaccgattcttttaaaacactggaaacagcgtgacctggatatgcctgtttatgaataccttcctaaacacttaaactactatgatttcatgagaagttcaaagttctgtttttgtcccagtgggtatgaggtagctagtcctcgagtcatcgaagccatctactctgagtgtatccccgtcattctctcggttaacttcgtgttaccattcactgatgttcttcgttgggagactttctctgtactggtcgacgtttcagagattccgaggttgaaggagattctcatgtcgatctccaatgagaaatatgaatggcttaaaagtaacttgaggtatgtgaggagacatttcgagcttaacgatcctcctcagagatttgatgcatttcacttgactcttcattccatttggttacgtagacttaacttgaagcttacgtaa

SEQ ID NO: 1514 - protein, 1326 aa, Arabidopsis thaliana
  misc_feature: PFam Name: Mito_carr; PFam Description: Mitochondrial
  misc_feature: GI Number: 51970652; NR Description: mitochondrial carrier
  misc_feature: GI Number: 23197668; NR Description: putative mitochondrial carrier protein [Arabidopsis thaliana] >gi|22135876|gb|AAM91520.1| putative mitochondrial carrier protein [Arabidopsis thaliana] >gi|51968668|dbj|BAD43026.1|
  misc_feature: GI Number: 4895195; NR Description: putative mitochondrial carrier protein [Arabidopsis thaliana] >gi|25295875|pir||D84798 probable mitochondrial carrier protein [imported] - Arabidopsis
  misc_feature: GI Number: 17104715; NR Description: putative Ca-dependent solute carrier protein [Arabidopsis thaliana] >gi|13877985|gb|AAK44070.1| putative Ca-dependent solute carrier
  misc_feature: GI Number: 21554682; NR Description: Ca-dependent solute
ATGAAATTCAAATTCTCGTTCCCAGAAGAAACTGAGCTTCGAAGAAACGTTTACACTAGTAGTTCCGGTGAAGAAAACAGAGTCGTCGTTGATTCTCGTCATGTTTCTCAACAGATCCTCACTGTCCGATCTACTAACTCCACTTTACAGAGTAAACCGGAAAAACTAAACCGGAGAAATTTGGTGGAACAAGGATTAGCGAAAGCAAGAGCATCGATTTTAGAAGCTTCTTCGAATGTTAACACTACATTGTTCAAATCTGATCTTCCAAACTCAGAAATTTATCGTAATCCATCAGCTTTATATCGGAGTTACTTAGAAATGGAGAAGAGGTTTAAGGTGTATGTATACGAAGAAGGCGAGCCACCGCTAGTTCACGATGGACCGTGTAAGAGTGTTTACGCGGTTGAAGGGAGATTCATAACTGAGATGGAGAAAAGAAGGACTAAGTTTCGTACTTATGATCCTAACCAAGCTTATGTTTACTTCTTGCCATTTAGTGTTACTTGGCTGGTTCGATACTTATACGAAGGCAATTCTGATGCTAAGCCTTTGAAAACATTTGTTTCCGATTATATCAGATTAGTATCTACTAATCATCCTTTTTGGAATCGAACTAATGGTGCTGATCACTTCATGCTTACTTGTCACGATTGGGGACCTCTGACTTCACAAGCTAATAGAGATTTGTTCAACACTTCGATTCGAGTTATGTGTAATGCTAATTCATCAGAAGGGTTTAATCCTACTAAAGATGTGACTCTTCCTGAGATCAAACTCTATGGTGGTGAAGTTGATCACAAACTCAGGTTATCTAAAACCTTATCCGCTTCTCCGCGGCCTTACCTCGGGTTCTTCGCAGGCGGTGTCCACGGTCCGGTTAGACCGATTCTTTTAAAACACTGGAAACAGCGTGACCTGGATATGCCTGTTTATGAATACCTTCCTAAACACTTAAACTACTATGATTTCATGAGAAGTTCAAAGTTCTGTTTTTGTCCCAGTGGGTATGAGGTAGCTAGTCCTCGAGTCATCGAAGCCATCTACTCTGAGTGTATCCCCGTCATTCTCTCGGTTAACTTCGTGTTACCATTCACTGATGTTCTTCGTTGGGAGACTTTCTCTGTACTGGTCGACGTTTCAGAGATTCCGAGGTTGAAGGAGATTCTCATGTCGATCTCCAATGAGAAATATGAATGGCTTAAAAGTAACTTGAGGTATGTGAGGAGACATTTCGAGCTTAACGATCCTCCTCAGAGATTTGATGCATTTCACTTGACTCTTCATTCCATTTGGTTACGTAGACTTAACTTGAAGCTTACGTAA

SEQ ID NO: 1515 - DNA, 1109 bp, Arabidopsis thaliana
  misc_feature (1)..(1109): Ceres cDNA ID no. 12650562
  misc_feature (1)..(1109): Ceres CLONE  ID no. 38934
  misc_feature (1)..(1109): Also known as  Ceres CDNA ID no. 23542785
gcattaactgatttcacattcttcgataaggattttactctccagagaaagaaaaaaaaaacctcctctgcttttgtgatcctttaaggaaaaagacgaaatggcaacggaatcgtacgaagccgccattaaaggactcaatgatcttctcagtacgaaagcggatctcggaaacgtcgccgccgcgaagatcaaagcgttgacggcggagctaaaggagcttgactcaagcaattcagacgcaattgaacgaatcaagaccggttttactcaattcaaaaccgagaaatatttgaagaatagtactttgttcaatcatcttgccaagactcagaccccaaagtttctggtgtttgcttgctctgattctcgagtttgtccatctcacatcttgaatttccaacctggtgaggcttttgttgtcagaaacatagccaatatggttccaccttttgaccagaagagacactctggagttggcgccgccgttgaatacgcagttgtacatctcaaggtggagaacattttggtgataggccatagctgctgtggtggtattaagggactcatgtccattgaagatgatgctgccccaactcaaagtgacttcattgaaaattgggtgaagataggcgcatcagcgaggaacaagatcaaggaggaacataaagacttgagctacgatgatcaatgcaacaagtgtgagaaggaagctgtgaacgtatcgcttggaaacttgctttcgtacccattcgtgagagctgaggtggtgaagaacacacttgcaataagaggaggtcactacaatttcgtcaaaggaacgtttgatctctgggagctcgatttcaagaccactcctgcttttgccttctcttaagaaagaaagctaccggaacatataaaactcttttgagataaaaaaagacactttgactcatctttcttcattctctcatgttgatgattcctctccaacttctttgatttctttttgttaattcaaaacttcaactttgctgcttctatttcaaaagctcaaacaataaagctgtaaccaacgtttgaaacttctatatttgtctaattgatgtttgaacgaagatttgaac

SEQ ID NO: 1516 - protein, 1109 aa, Arabidopsis thaliana
  misc_feature: PFam Name: Pro_CA; PFam Description: Carbonic anhydrase
  misc_feature: GI Number: 21593413; NR Description: carbonic anhydrase, putative [Arabidopsis thaliana] >gi|3176676|gb|AAC18799.1| Similar to carbonic anhydrase gb|L19255 from Nicotiana tabacum. ESTs gb|AA597643, gb|T45390, gb|T43963 and gb|AA597734 come from this
  misc_feature: GI Number: 21281000; NR Description: putative carbonic anhydrase [Arabidopsis thaliana] >gi|14334470|gb|AAK59433.1| putative carbonic anhydrase [Arabidopsis thaliana] >gi|15223141|ref|NP_177198.1| carbonic anhydrase, putative /
  misc_feature: GI Number: 21386933; NR Description: putative carbonic anhydrase [Arabidopsis thaliana] >gi|19698837|gb|AAL91154.1| putative carbonic anhydrase [Arabidopsis thaliana] >gi|4056455|gb|AAC98028.1| Similar to gb|L19255 carbonic
  misc_feature: GI Number: 56562175; NR Description: carbonic anhydrase
  misc_feature: GI Number: 3061271; NR Description: NPCA1 [Nicotiana paniculata]
GCATTAACTGATTTCACATTCTTCGATAAGGATTTTACTCTCCAGAGAAAGAAAAAAAAAACCTCCTCTGCTTTTGTGATCCTTTAAGGAAAAAGACGAAATGGCAACGGAATCGTACGAAGCCGCCATTAAAGGACTCAATGATCTTCTCAGTACGAAAGCGGATCTCGGAAACGTCGCCGCCGCGAAGATCAAAGCGTTGACGGCGGAGCTAAAGGAGCTTGACTCAAGCAATTCAGACGCAATTGAACGAATCAAGACCGGTTTTACTCAATTCAAAACCGAGAAATATTTGAAGAATAGTACTTTGTTCAATCATCTTGCCAAGACTCAGACCCCAAAGTTTCTGGTGTTTGCTTGCTCTGATTCTCGAGTTTGTCCATCTCACATCTTGAATTTCCAACCTGGTGAGGCTTTTGTTGTCAGAAACATAGCCAATATGGTTCCACCTTTTGACCAGAAGAGACACTCTGGAGTTGGCGCCGCCGTTGAATACGCAGTTGTACATCTCAAGGTGGAGAACATTTTGGTGATAGGCCATAGCTGCTGTGGTGGTATTAAGGGACTCATGTCCATTGAAGATGATGCTGCCCCAACTCAAAGTGACTTCATTGAAAATTGGGTGAAGATAGGCGCATCAGCGAGGAACAAGATCAAGGAGGAACATAAAGACTTGAGCTACGATGATCAATGCAACAAGTGTGAGAAGGAAGCTGTGAACGTATCGCTTGGAAACTTGCTTTCGTACCCATTCGTGAGAGCTGAGGTGGTGAAGAACACACTTGCAATAAGAGGAGGTCACTACAATTTCGTCAAAGGAACGTTTGATCTCTGGGAGCTCGATTTCAAGACCACTCCTGCTTTTGCCTTCTCTTAAGAAAGAAAGCTACCGGAACATATAAAACTCTTTTGAGATAAAAAAAGACACTTTGACTCATCTTTCTTCATTCTCTCATGTTGATGATTCCTCTCCAACTTCTTTGATTTCTTTTTGTTAATTCAAAACTTCAACTTTGCTGCTTCTATTTCAAAAGCTCAAACAATAAAGCTGTAACCAACGTTTGAAACTTCTATATTTGTCTAATTGATGTTTGAACGAAGATTTGAAC

SEQ ID NO: 1517 - DNA, 1026 bp, Arabidopsis thaliana
  misc_feature (1)..(1026): Ceres cDNA ID no. 12650646
  misc_feature (1)..(1026): Also known as  Ceres CDNA ID no. 23542785
atgggtaataagctgggaaggaagagacagattgtggacgaaagatacacaaagccacaacaaggtttatacatgagcaaagatgttgacattaaaaagcttaagaaactcatcttagagtctaagcttgctccttgttatcctggtcttgaagaaaccccctcctcccatcatgatcttgaagaatgtcctatttgctttctgtttgcattaagcttttggtcttctttacatatgaaaatgtctacttttgagtcctccttatcatatgtaagatgccctttttgcaaaacatccaattatgctgtcgagtatcgtggagggaaaactaaagaggagaagagctttgaacaaattgaagagcagcgagttatagaagccaaaataaggatgaggcagaaggaagttgaagatgatgaagaaagaatgcagaaacgtctggagtcatattcttctagttctagcactagtgcagcgactcttgatacagagtatggttctgctgcagatcattcctttctggctaaagttatatgcacaacggtaatacgtgttggaactttgaatctgagtggttcatatcaggtgactgatatgtggttatctggaaaactcttcagggacggtcagtttgactttgatcttgaagatataatggtcatggaagcaatatggctttcgatgcaggaaccaggaattcagagaaacacatcacctgatgatatttcagaaaaagatcgtaatgaggaaccatcaactccgtcatcatcatctccatcaggtgggctagcttgtgcaattgctgttcttgccgaacgtcagcaaatggttggcgtatcttcttcgaatcaaaacgttaaccttgcatcacaaaaccttgttccagacaatggtaacaacagtcattacaatgccatagaacaggatagtaaccattaccttcaaggagcaggaatcagctatacaagatcagatatgactgatgatagcggcggtgagacttccagggaagttacatggcaatag

SEQ ID NO: 1518 - protein, 1026 aa, Arabidopsis thaliana
  misc_feature: PFam Name: Pro_CA; PFam Description: Carbonic anhydrase
  misc_feature: GI Number: 21593413; NR Description: carbonic anhydrase, putative [Arabidopsis thaliana] >gi|3176676|gb|AAC18799.1| Similar to carbonic anhydrase gb|L19255 from Nicotiana tabacum. ESTs gb|AA597643, gb|T45390, gb|T43963 and gb|AA597734 come from this
  misc_feature: GI Number: 21281000; NR Description: putative carbonic anhydrase [Arabidopsis thaliana] >gi|14334470|gb|AAK59433.1| putative carbonic anhydrase [Arabidopsis thaliana] >gi|15223141|ref|NP_177198.1| carbonic anhydrase, putative /
  misc_feature: GI Number: 21386933; NR Description: putative carbonic anhydrase [Arabidopsis thaliana] >gi|19698837|gb|AAL91154.1| putative carbonic anhydrase [Arabidopsis thaliana] >gi|4056455|gb|AAC98028.1| Similar to gb|L19255 carbonic
  misc_feature: GI Number: 56562175; NR Description: carbonic anhydrase
  misc_feature: GI Number: 3061271; NR Description: NPCA1 [Nicotiana paniculata]
ATGGGTAATAAGCTGGGAAGGAAGAGACAGATTGTGGACGAAAGATACACAAAGCCACAACAAGGTTTATACATGAGCAAAGATGTTGACATTAAAAAGCTTAAGAAACTCATCTTAGAGTCTAAGCTTGCTCCTTGTTATCCTGGTCTTGAAGAAACCCCCTCCTCCCATCATGATCTTGAAGAATGTCCTATTTGCTTTCTGTTTGCATTAAGCTTTTGGTCTTCTTTACATATGAAAATGTCTACTTTTGAGTCCTCCTTATCATATGTAAGATGCCCTTTTTGCAAAACATCCAATTATGCTGTCGAGTATCGTGGAGGGAAAACTAAAGAGGAGAAGAGCTTTGAACAAATTGAAGAGCAGCGAGTTATAGAAGCCAAAATAAGGATGAGGCAGAAGGAAGTTGAAGATGATGAAGAAAGAATGCAGAAACGTCTGGAGTCATATTCTTCTAGTTCTAGCACTAGTGCAGCGACTCTTGATACAGAGTATGGTTCTGCTGCAGATCATTCCTTTCTGGCTAAAGTTATATGCACAACGGTAATACGTGTTGGAACTTTGAATCTGAGTGGTTCATATCAGGTGACTGATATGTGGTTATCTGGAAAACTCTTCAGGGACGGTCAGTTTGACTTTGATCTTGAAGATATAATGGTCATGGAAGCAATATGGCTTTCGATGCAGGAACCAGGAATTCAGAGAAACACATCACCTGATGATATTTCAGAAAAAGATCGTAATGAGGAACCATCAACTCCGTCATCATCATCTCCATCAGGTGGGCTAGCTTGTGCAATTGCTGTTCTTGCCGAACGTCAGCAAATGGTTGGCGTATCTTCTTCGAATCAAAACGTTAACCTTGCATCACAAAACCTTGTTCCAGACAATGGTAACAACAGTCATTACAATGCCATAGAACAGGATAGTAACCATTACCTTCAAGGAGCAGGAATCAGCTATACAAGATCAGATATGACTGATGATAGCGGCGGTGAGACTTCCAGGGAAGTTACATGGCAATAG

SEQ ID NO: 1519 - DNA, 5109 bp, Arabidopsis thaliana
  misc_feature (1)..(5109): Ceres cDNA ID no. 12650865
  misc_feature (1)..(5109): Also known as  Ceres CDNA ID no. 23542785
atgtcaagcagagaaaaccctagcggaatctgcaaaagcattcccaagctcatctcttccttcgtcgacactttcgttgattactccgtctccggcatcttcctgccccaagatcctagctcacaaaatgagattctgcaaacgaggttcgagaagccggagcgactcgttgcaatcggtgatctccatggcgatctcgagaagtctagagaagcattcaagatcgctggtctgattgattcgtcggacagatggactggtggatcaacgatggttgttcaggtgggcgacgtactagatcgaggtggagaggagttgaagatactttatttcttagagaaattgaaacgagaggctgagagagctggaggtaagattctgactatgaatgggaaccatgagatcatgaatatagaaggtgactttagatatgtgactaagaaaggtttagaggaatttcagatttgggctgattggtattgtttagggaacaagatgaagactttatgcagtggtcttgataaacctaaggatccttacgaagggattccgatgagcttccctcgtatgagagccgactgttttgaaggaattagagctaggattgctgcattgagacctgatggtccgattgcaaagagattcttgactaagaatcaaacagttgctgttgttggtgattcggtttttgttcacggtggtcttttagctgagcatatagagtatggactggagaggattaacgaggaggttcggggttggattaacgggtttaaaggaggaagatatgcgcctgcttattgtagaggagggaactctgtagtttggttgaggaagttctcggaagaaatggctcacaaatgtgattgtgcagctcttgagcatgctctttccactattcccggggttaagaggatgatcatgggacatacaatccaggatgctggtatcaacggtgtttgtaatgataaagccattaggattgatgttggcatgtccaagggatgtgctgatggattgcctgaggttttggagatccgcagggactccggtgaagcttatcttatggcttctgttttgcttccattgccacaagtatttgttttgtttgattatcgcaggagccgtaaagagtcaagctttccccgcgccgtctacaattccaattccatttcttctaattcaaccaatgccaatcatttccttcgccggatttctaacttctgtgaaaccggagacctcgacaagtcctttcgaactgtccaagaattcgttggcgatgacgagagctcgtccgatgcgtttcttcttgtccgagaagctcttgggcttctcttacaagcttctgggaagagaaaagacattgaaatgggaagaaagatccaccagctggtttctgggtcgacccggttaaggaatgatgacgttctctgtactcgtattatcaccatgtacgctatgtgtggctctcctgatgattctcggtttgtgtttgatgccttgcggagtaagaatctcttccagtggaatgctgttatcagctcttactcaagaaacgagctttacgatgaagtattagagacgtttatcgagatgatctcaacgactgatcttttaccggatcatttcacttatccatgtgtgattaaggcttgtgctgggatgtctgatgttgggatcgggcttgcggttcatgggttggtggtgaagaccggattggtggaagatgtttttgtgggtaatgcattggtgtctttctatggaactcatggttttgttactgatgccttgcaactgttcgatataatgcctgagagaaatttggtttcctggaactccatgattcgagtgttctcggataatggtttctcagaagaaagcttcttgcttcttggagaaatgatggaggaaaatggtgatggtgcgtttatgccggatgttgctacacttgttactgtgttgccggtttgtgcaagagaaagagaaatagggttgggaaaaggtgttcatgggtgggcggtgaaattgaggttggacaaggaactagtccttaacaatgccttaatggacatgtactccaaatgcggttgcattactaatgcacaaatgatctttaagatgaacaataacaagaatgtggtttcttggaacacaatggtaggaggtttttcagcagagggtgatacacatgggacgtttgatgttctgagacagatgctggcaggaggcgaagatgtcaaagcggacgaggtaaccattctaaatgcagtgcctgtttgtttccatgaatcattcttaccgagtttaaaggaacttcattgttactccttaaaacaagagtttgtatacaatgagttagtagccaatgcctttgtggcttcttatgcaaagtgtggctcactgagttatgcccagcgtgtgtttcatggtataaggagtaaaacagtgaactcttggaatgctttgattggcggccatgctcagagcaatgatccgagattgtccttggatgctcatttgcagatgaaaatttctggattgctacctgatagttttactgtctgtagtcttctttcagcttgttctaaactaaaatccctgcggttgggaaaggaagtgcatgggtttataatccgaaattggttagaaagagatttgtttgtttatttatcagtactctcattatacattcattgtggggagctatgcactgtacaagcattatttgatgcaatggaagataaaagcttagtatcttggaatactgtaatcaccggttaccttcagaatggatttcctgatagagctttgggcgtctttagacaaatggttttgtatggaatccagctttgtgggatttctatgatgcctgtgtttggtgcgtgttcgctgctaccttctcttcgactggggagagaagcgcatgcttatgctttgaagcacctcctggaggacgatgcgtttattgcatgttctttaattgatatgtatgccaagaatggttctataacacaatcatctaaggttttcaatggcttgaaggagaaaagcacggcatcttggaatgccatgataatgggatatggaatacatggcctagcaaaagaggctataaaactctttgaagagatgcaaagaacaggtcataaccctgatgacctaactttcttaggtgttctaacggcttgcaaccatagtggtctgatccatgaagggctgagatatctggatcaaatgaagtcttcttttgggctaaagccaaatttaaagcattatgcttgtgtcattgacatgttaggccgagctgggcaactagacaaggctctaagggttgttgcagaagagatgtctgaggaagctgacgttggaatttggaagtctctgctcagctcatgcagaatccatcaaaatctggaaatgggagagaaagttgctgctaagttattcgaattagaaccagaaaagcctgagaattatgttctgctttccaacttatatgcaggattggggaaatgggaagacgtgagaaaagtgagacagagaatgaacgagatgagtttacgaaaggatgctggatgctcttggatcgaactaaacaggaaggtatttagctttgttgtcggtgaaagattcttagatggttttgaggaaatcaaaagtctttggagtatattggagatgaagatatcgaagatgggatacagaccagacacaatgtcagtacaacatgatctaagtgaagaggagaagattgaacagttaaggggacacagcgagaagcttgcccttacctacgggttgattaaaacttcagaaggaacaactattagagtttacaagaacctaaggatctgtgtggactgtcacaatgcagcaaagttgatctccaaggtcatggaaagggaaatagttgtgagggacaacaaaaggtttcatcatttcaagaatggggaagagaagcaagacgcaatgaagagttcaatgagcatcattgtcttcttgtttgtgaccatcttcaccatctctgcttcttccttgaaccctgaggaaacttgcatacaaagaaacatcaaccggtcacaacctccaagctcttcactcgaacccaagacatcaaagttcgactttcttgtggacaagttgtgcagagacatggctcgtgccgtcatgttctctgtgaggataaccggaaaattcccatctcactatgtgaaggcgatgtgtaatgtgtttggaaatgacgagaagaaagtgaaagagtatgttgtgaagaaatggttgggaggtgaaaaggttttgtcgaatctcgttagcaagaaagacatttacatggcgtcgaggaatcaggagaaatctcccaaagtgcaagagctttacgacctctgcaaagagactttcactggcaaagctccttctcctgcttccatggctatccaaaagctatgctctgtgttggactcagttagtcctgcagatgttgggcttgaagaggtatctcaagacgatgatcgaggctatggagtttctggggttagccgtttcaatagagtaggacgatgggcacaaccgataacattcttagacattcatgaatgtgatacttttacaatgtgtattttctgcttcccaacgtcttcagtgatcccattgcatgatcatccagagatggctgtgtttagtaaaatcctctatggatcacttcatgttaaagcttacgattgggtcgaacctccatgtattatcacacaagataaaggcgtccccggttctcttccagcaaggttggcgaaattggtgagtgacaaagttataacgcctcagtctgagataccggcgttgtacccaaagactggaggcaatctccattgcttcactgcgttgactccatgtgctgtgctcgacattctctcacctccttacaaagaaagtgttggcaggagttgcagttactacatggactatccgttttccactttcgcattggagaacggaatgaagaaggtggatgaaggaaaggaagacgaatacgcatggcttgtacagattgacacgcccgatgatcttcacatgcgtcccggatcatatactggtccaactatcagagtctag

SEQ ID NO: 1520 - protein, 5109 aa, Arabidopsis thaliana
  misc_feature: PFam Name: Pro_CA; PFam Description: Carbonic anhydrase
  misc_feature: GI Number: 21593413; NR Description: carbonic anhydrase, putative [Arabidopsis thaliana] >gi|3176676|gb|AAC18799.1| Similar to carbonic anhydrase gb|L19255 from Nicotiana tabacum. ESTs gb|AA597643, gb|T45390, gb|T43963 and gb|AA597734 come from this
  misc_feature: GI Number: 21281000; NR Description: putative carbonic anhydrase [Arabidopsis thaliana] >gi|14334470|gb|AAK59433.1| putative carbonic anhydrase [Arabidopsis thaliana] >gi|15223141|ref|NP_177198.1| carbonic anhydrase, putative /
  misc_feature: GI Number: 21386933; NR Description: putative carbonic anhydrase [Arabidopsis thaliana] >gi|19698837|gb|AAL91154.1| putative carbonic anhydrase [Arabidopsis thaliana] >gi|4056455|gb|AAC98028.1| Similar to gb|L19255 carbonic
  misc_feature: GI Number: 56562175; NR Description: carbonic anhydrase
  misc_feature: GI Number: 3061271; NR Description: NPCA1 [Nicotiana paniculata]
ATGTCAAGCAGAGAAAACCCTAGCGGAATCTGCAAAAGCATTCCCAAGCTCATCTCTTCCTTCGTCGACACTTTCGTTGATTACTCCGTCTCCGGCATCTTCCTGCCCCAAGATCCTAGCTCACAAAATGAGATTCTGCAAACGAGGTTCGAGAAGCCGGAGCGACTCGTTGCAATCGGTGATCTCCATGGCGATCTCGAGAAGTCTAGAGAAGCATTCAAGATCGCTGGTCTGATTGATTCGTCGGACAGATGGACTGGTGGATCAACGATGGTTGTTCAGGTGGGCGACGTACTAGATCGAGGTGGAGAGGAGTTGAAGATACTTTATTTCTTAGAGAAATTGAAACGAGAGGCTGAGAGAGCTGGAGGTAAGATTCTGACTATGAATGGGAACCATGAGATCATGAATATAGAAGGTGACTTTAGATATGTGACTAAGAAAGGTTTAGAGGAATTTCAGATTTGGGCTGATTGGTATTGTTTAGGGAACAAGATGAAGACTTTATGCAGTGGTCTTGATAAACCTAAGGATCCTTACGAAGGGATTCCGATGAGCTTCCCTCGTATGAGAGCCGACTGTTTTGAAGGAATTAGAGCTAGGATTGCTGCATTGAGACCTGATGGTCCGATTGCAAAGAGATTCTTGACTAAGAATCAAACAGTTGCTGTTGTTGGTGATTCGGTTTTTGTTCACGGTGGTCTTTTAGCTGAGCATATAGAGTATGGACTGGAGAGGATTAACGAGGAGGTTCGGGGTTGGATTAACGGGTTTAAAGGAGGAAGATATGCGCCTGCTTATTGTAGAGGAGGGAACTCTGTAGTTTGGTTGAGGAAGTTCTCGGAAGAAATGGCTCACAAATGTGATTGTGCAGCTCTTGAGCATGCTCTTTCCACTATTCCCGGGGTTAAGAGGATGATCATGGGACATACAATCCAGGATGCTGGTATCAACGGTGTTTGTAATGATAAAGCCATTAGGATTGATGTTGGCATGTCCAAGGGATGTGCTGATGGATTGCCTGAGGTTTTGGAGATCCGCAGGGACTCCGGTGAAGCTTATCTTATGGCTTCTGTTTTGCTTCCATTGCCACAAGTATTTGTTTTGTTTGATTATCGCAGGAGCCGTAAAGAGTCAAGCTTTCCCCGCGCCGTCTACAATTCCAATTCCATTTCTTCTAATTCAACCAATGCCAATCATTTCCTTCGCCGGATTTCTAACTTCTGTGAAACCGGAGACCTCGACAAGTCCTTTCGAACTGTCCAAGAATTCGTTGGCGATGACGAGAGCTCGTCCGATGCGTTTCTTCTTGTCCGAGAAGCTCTTGGGCTTCTCTTACAAGCTTCTGGGAAGAGAAAAGACATTGAAATGGGAAGAAAGATCCACCAGCTGGTTTCTGGGTCGACCCGGTTAAGGAATGATGACGTTCTCTGTACTCGTATTATCACCATGTACGCTATGTGTGGCTCTCCTGATGATTCTCGGTTTGTGTTTGATGCCTTGCGGAGTAAGAATCTCTTCCAGTGGAATGCTGTTATCAGCTCTTACTCAAGAAACGAGCTTTACGATGAAGTATTAGAGACGTTTATCGAGATGATCTCAACGACTGATCTTTTACCGGATCATTTCACTTATCCATGTGTGATTAAGGCTTGTGCTGGGATGTCTGATGTTGGGATCGGGCTTGCGGTTCATGGGTTGGTGGTGAAGACCGGATTGGTGGAAGATGTTTTTGTGGGTAATGCATTGGTGTCTTTCTATGGAACTCATGGTTTTGTTACTGATGCCTTGCAACTGTTCGATATAATGCCTGAGAGAAATTTGGTTTCCTGGAACTCCATGATTCGAGTGTTCTCGGATAATGGTTTCTCAGAAGAAAGCTTCTTGCTTCTTGGAGAAATGATGGAGGAAAATGGTGATGGTGCGTTTATGCCGGATGTTGCTACACTTGTTACTGTGTTGCCGGTTTGTGCAAGAGAAAGAGAAATAGGGTTGGGAAAAGGTGTTCATGGGTGGGCGGTGAAATTGAGGTTGGACAAGGAACTAGTCCTTAACAATGCCTTAATGGACATGTACTCCAAATGCGGTTGCATTACTAATGCACAAATGATCTTTAAGATGAACAATAACAAGAATGTGGTTTCTTGGAACACAATGGTAGGAGGTTTTTCAGCAGAGGGTGATACACATGGGACGTTTGATGTTCTGAGACAGATGCTGGCAGGAGGCGAAGATGTCAAAGCGGACGAGGTAACCATTCTAAATGCAGTGCCTGTTTGTTTCCATGAATCATTCTTACCGAGTTTAAAGGAACTTCATTGTTACTCCTTAAAACAAGAGTTTGTATACAATGAGTTAGTAGCCAATGCCTTTGTGGCTTCTTATGCAAAGTGTGGCTCACTGAGTTATGCCCAGCGTGTGTTTCATGGTATAAGGAGTAAAACAGTGAACTCTTGGAATGCTTTGATTGGCGGCCATGCTCAGAGCAATGATCCGAGATTGTCCTTGGATGCTCATTTGCAGATGAAAATTTCTGGATTGCTACCTGATAGTTTTACTGTCTGTAGTCTTCTTTCAGCTTGTTCTAAACTAAAATCCCTGCGGTTGGGAAAGGAAGTGCATGGGTTTATAATCCGAAATTGGTTAGAAAGAGATTTGTTTGTTTATTTATCAGTACTCTCATTATACATTCATTGTGGGGAGCTATGCACTGTACAAGCATTATTTGATGCAATGGAAGATAAAAGCTTAGTATCTTGGAATACTGTAATCACCGGTTACCTTCAGAATGGATTTCCTGATAGAGCTTTGGGCGTCTTTAGACAAATGGTTTTGTATGGAATCCAGCTTTGTGGGATTTCTATGATGCCTGTGTTTGGTGCGTGTTCGCTGCTACCTTCTCTTCGACTGGGGAGAGAAGCGCATGCTTATGCTTTGAAGCACCTCCTGGAGGACGATGCGTTTATTGCATGTTCTTTAATTGATATGTATGCCAAGAATGGTTCTATAACACAATCATCTAAGGTTTTCAATGGCTTGAAGGAGAAAAGCACGGCATCTTGGAATGCCATGATAATGGGATATGGAATACATGGCCTAGCAAAAGAGGCTATAAAACTCTTTGAAGAGATGCAAAGAACAGGTCATAACCCTGATGACCTAACTTTCTTAGGTGTTCTAACGGCTTGCAACCATAGTGGTCTGATCCATGAAGGGCTGAGATATCTGGATCAAATGAAGTCTTCTTTTGGGCTAAAGCCAAATTTAAAGCATTATGCTTGTGTCATTGACATGTTAGGCCGAGCTGGGCAACTAGACAAGGCTCTAAGGGTTGTTGCAGAAGAGATGTCTGAGGAAGCTGACGTTGGAATTTGGAAGTCTCTGCTCAGCTCATGCAGAATCCATCAAAATCTGGAAATGGGAGAGAAAGTTGCTGCTAAGTTATTCGAATTAGAACCAGAAAAGCCTGAGAATTATGTTCTGCTTTCCAACTTATATGCAGGATTGGGGAAATGGGAAGACGTGAGAAAAGTGAGACAGAGAATGAACGAGATGAGTTTACGAAAGGATGCTGGATGCTCTTGGATCGAACTAAACAGGAAGGTATTTAGCTTTGTTGTCGGTGAAAGATTCTTAGATGGTTTTGAGGAAATCAAAAGTCTTTGGAGTATATTGGAGATGAAGATATCGAAGATGGGATACAGACCAGACACAATGTCAGTACAACATGATCTAAGTGAAGAGGAGAAGATTGAACAGTTAAGGGGACACAGCGAGAAGCTTGCCCTTACCTACGGGTTGATTAAAACTTCAGAAGGAACAACTATTAGAGTTTACAAGAACCTAAGGATCTGTGTGGACTGTCACAATGCAGCAAAGTTGATCTCCAAGGTCATGGAAAGGGAAATAGTTGTGAGGGACAACAAAAGGTTTCATCATTTCAAGAATGGGGAAGAGAAGCAAGACGCAATGAAGAGTTCAATGAGCATCATTGTCTTCTTGTTTGTGACCATCTTCACCATCTCTGCTTCTTCCTTGAACCCTGAGGAAACTTGCATACAAAGAAACATCAACCGGTCACAACCTCCAAGCTCTTCACTCGAACCCAAGACATCAAAGTTCGACTTTCTTGTGGACAAGTTGTGCAGAGACATGGCTCGTGCCGTCATGTTCTCTGTGAGGATAACCGGAAAATTCCCATCTCACTATGTGAAGGCGATGTGTAATGTGTTTGGAAATGACGAGAAGAAAGTGAAAGAGTATGTTGTGAAGAAATGGTTGGGAGGTGAAAAGGTTTTGTCGAATCTCGTTAGCAAGAAAGACATTTACATGGCGTCGAGGAATCAGGAGAAATCTCCCAAAGTGCAAGAGCTTTACGACCTCTGCAAAGAGACTTTCACTGGCAAAGCTCCTTCTCCTGCTTCCATGGCTATCCAAAAGCTATGCTCTGTGTTGGACTCAGTTAGTCCTGCAGATGTTGGGCTTGAAGAGGTATCTCAAGACGATGATCGAGGCTATGGAGTTTCTGGGGTTAGCCGTTTCAATAGAGTAGGACGATGGGCACAACCGATAACATTCTTAGACATTCATGAATGTGATACTTTTACAATGTGTATTTTCTGCTTCCCAACGTCTTCAGTGATCCCATTGCATGATCATCCAGAGATGGCTGTGTTTAGTAAAATCCTCTATGGATCACTTCATGTTAAAGCTTACGATTGGGTCGAACCTCCATGTATTATCACACAAGATAAAGGCGTCCCCGGTTCTCTTCCAGCAAGGTTGGCGAAATTGGTGAGTGACAAAGTTATAACGCCTCAGTCTGAGATACCGGCGTTGTACCCAAAGACTGGAGGCAATCTCCATTGCTTCACTGCGTTGACTCCATGTGCTGTGCTCGACATTCTCTCACCTCCTTACAAAGAAAGTGTTGGCAGGAGTTGCAGTTACTACATGGACTATCCGTTTTCCACTTTCGCATTGGAGAACGGAATGAAGAAGGTGGATGAAGGAAAGGAAGACGAATACGCATGGCTTGTACAGATTGACACGCCCGATGATCTTCACATGCGTCCCGGATCATATACTGGTCCAACTATCAGAGTCTAG

SEQ ID NO: 1521 - DNA, 1500 bp, Arabidopsis thaliana
  misc_feature (1)..(1500): Ceres cDNA ID no. 12650918
  misc_feature (1)..(1500): Also known as  Ceres CDNA ID no. 23542785
tcgtttatatatttgttttacttgttttgcacatacacacaaaaataaaaaagactttatatttatttactttttaatcacacggattagctccggcgaagtatggtcgtcgtcttcatcttcttcctccatcatcagatttttccttaaatggaagaaaccaaacgaaactccgatcttctccgttctcgtgttttcctctctggcttttattgctgggattgggaatttctcaccgctctcttgctttttagttgctgattctttttccttcgactttctatttccaatctttcttcttctctttgtgtattagattatttttagttttatttttctgtggtaaaataaaaaaagttcgccggagatgacggctgtgacggcggcgcaaagatcagttccggcgccgtttttaagcaaaacgtatcagctagttgatgatcatagcacagacgacgtcgtttcatggaacgaagaaggaacagcttttgtcgtgtggaaaacagcagagtttgctaaagatcttcttcctcaatacttcaagcataataatttctcaagcttcattcgtcagctcaacacttacggatttcgtaaaactgtaccggataaatgggaatttgcaaacgattatttccggagaggcggggaggatctgttgacggacatacgacggcgtaaatcggtgattgcttcaacggcggggaaatgtgttgttgttggttcgccttctgagtctaattctggtggtggtgatgatcacggttcaagctccacgtcatcacccggttcgtcgaagaatcctggttcggtggagaacatggttgctgatttatcaggagagaacgagaagcttaaacgtgaaaacaataacttgagctcggagctcgcggcggcgaagaagcagcgcgatgagctagtgacgttcttgacgggtcatctgaaagtaagaccggaacaaatcgataaaatgatcaaaggagggaaatttaaaccggtggagtctgacgaagagagtgagtgcgaaggttgcgacggcggcggaggagcagaggagggggtaggtgaaggattgaaattgtttggggtgtggttgaaaggagagagaaaaaagagggaccgggatgaaaagaattatgtggtgagtgggtcccgtatgacggaaataaagaacgtggactttcacgcgccgttgtggaaaagcagcaaagtctgcaactaaaaaaagagtagaagactgttcaaaccagcgtgtgacacgtcatcgacgacgacgaaaaaaatgatttaaaaaactatttttttccgtaaggaagaaaagttatttttatgttttaaaaaggtgaagaaggtccagaaggatcaacgcaaatatataaatggattttcatgtattatataatttaattagtgtattaagaaaataaaacagatgttgaagttttattgttgcttaatttatgtcttcataatgtaaaaaagcatgtgaaatacttggtc

SEQ ID NO: 1522 - protein, 1500 aa, Arabidopsis thaliana
  misc_feature: PFam Name: Pro_CA; PFam Description: Carbonic anhydrase
  misc_feature: GI Number: 21593413; NR Description: carbonic anhydrase, putative [Arabidopsis thaliana] >gi|3176676|gb|AAC18799.1| Similar to carbonic anhydrase gb|L19255 from Nicotiana tabacum. ESTs gb|AA597643, gb|T45390, gb|T43963 and gb|AA597734 come from this
  misc_feature: GI Number: 21281000; NR Description: putative carbonic anhydrase [Arabidopsis thaliana] >gi|14334470|gb|AAK59433.1| putative carbonic anhydrase [Arabidopsis thaliana] >gi|15223141|ref|NP_177198.1| carbonic anhydrase, putative /
  misc_feature: GI Number: 21386933; NR Description: putative carbonic anhydrase [Arabidopsis thaliana] >gi|19698837|gb|AAL91154.1| putative carbonic anhydrase [Arabidopsis thaliana] >gi|4056455|gb|AAC98028.1| Similar to gb|L19255 carbonic
  misc_feature: GI Number: 56562175; NR Description: carbonic anhydrase
  misc_feature: GI Number: 3061271; NR Description: NPCA1 [Nicotiana paniculata]
TCGTTTATATATTTGTTTTACTTGTTTTGCACATACACACAAAAATAAAAAAGACTTTATATTTATTTACTTTTTAATCACACGGATTAGCTCCGGCGAAGTATGGTCGTCGTCTTCATCTTCTTCCTCCATCATCAGATTTTTCCTTAAATGGAAGAAACCAAACGAAACTCCGATCTTCTCCGTTCTCGTGTTTTCCTCTCTGGCTTTTATTGCTGGGATTGGGAATTTCTCACCGCTCTCTTGCTTTTTAGTTGCTGATTCTTTTTCCTTCGACTTTCTATTTCCAATCTTTCTTCTTCTCTTTGTGTATTAGATTATTTTTAGTTTTATTTTTCTGTGGTAAAATAAAAAAAGTTCGCCGGAGATGACGGCTGTGACGGCGGCGCAAAGATCAGTTCCGGCGCCGTTTTTAAGCAAAACGTATCAGCTAGTTGATGATCATAGCACAGACGACGTCGTTTCATGGAACGAAGAAGGAACAGCTTTTGTCGTGTGGAAAACAGCAGAGTTTGCTAAAGATCTTCTTCCTCAATACTTCAAGCATAATAATTTCTCAAGCTTCATTCGTCAGCTCAACACTTACGGATTTCGTAAAACTGTACCGGATAAATGGGAATTTGCAAACGATTATTTCCGGAGAGGCGGGGAGGATCTGTTGACGGACATACGACGGCGTAAATCGGTGATTGCTTCAACGGCGGGGAAATGTGTTGTTGTTGGTTCGCCTTCTGAGTCTAATTCTGGTGGTGGTGATGATCACGGTTCAAGCTCCACGTCATCACCCGGTTCGTCGAAGAATCCTGGTTCGGTGGAGAACATGGTTGCTGATTTATCAGGAGAGAACGAGAAGCTTAAACGTGAAAACAATAACTTGAGCTCGGAGCTCGCGGCGGCGAAGAAGCAGCGCGATGAGCTAGTGACGTTCTTGACGGGTCATCTGAAAGTAAGACCGGAACAAATCGATAAAATGATCAAAGGAGGGAAATTTAAACCGGTGGAGTCTGACGAAGAGAGTGAGTGCGAAGGTTGCGACGGCGGCGGAGGAGCAGAGGAGGGGGTAGGTGAAGGATTGAAATTGTTTGGGGTGTGGTTGAAAGGAGAGAGAAAAAAGAGGGACCGGGATGAAAAGAATTATGTGGTGAGTGGGTCCCGTATGACGGAAATAAAGAACGTGGACTTTCACGCGCCGTTGTGGAAAAGCAGCAAAGTCTGCAACTAAAAAAAGAGTAGAAGACTGTTCAAACCAGCGTGTGACACGTCATCGACGACGACGAAAAAAATGATTTAAAAAACTATTTTTTTCCGTAAGGAAGAAAAGTTATTTTTATGTTTTAAAAAGGTGAAGAAGGTCCAGAAGGATCAACGCAAATATATAAATGGATTTTCATGTATTATATAATTTAATTAGTGTATTAAGAAAATAAAACAGATGTTGAAGTTTTATTGTTGCTTAATTTATGTCTTCATAATGTAAAAAAGCATGTGAAATACTTGGTC

SEQ ID NO: 1523 - DNA, 1299 bp, Arabidopsis thaliana
  misc_feature (1)..(1299): Ceres cDNA ID no. 12650990
  misc_feature (1)..(1299): Also known as  Ceres CDNA ID no. 23542785
atgggaaaacccggcggcgcaaagaccagaaccgccgtatgtttatcagacggtgttttctttctcgccggagctttcatgtctctcactctcgtctggtcttacttctcaatcttttcaccttctttcaccagtttacgtcacgacggcaaaccggttcaatgctccggtttagacatgcaattcgacccatccgagcccggtttttacgacgacccggatctaagctactcgatcgagaaaccaatcacaaaatgggacgagaaacgaaaccaatggtttgaatcacacccatctttcaaacccggttcagaaaaccggatcgtaatggtaaccggttcacaatcctcgccgtgtaaaaacccaatcggagaccatttattactccgatgcttcaaaaacaaagtcgattacgctcgaatccatggtcacgacatcttctacagcaattctcttcttcatccgaagatgaattcttattgggcgaaacttccggtggttaaagcggcgatgcttgctcacccagaggcggagtggatttggtgggttgattccgacgctatcttcaccgacatggaatttaaaccgccgcttcaccgttaccgtcaacacaacctcgtcgttcacggttggccaaatataatctacgagaaacagagctggacggcgttaaacgccggcgttttcttaataagaaattgtcaatggtcaatggacttaattgacacgtggaagagtatgggaccagtgagtccagattacaaaaaatggggtcccatccaacggtcgatattcaaagataagttgtttccagagtcagatgatcaaacggctctgatttatttgctttataaacataaagagttgtattatcctaagatatacctcgaagcagagtattatctccaagggtattggattggtgtatttggggatttcgccaacgtgacggaacggtatcttgagatggaacgagaagacgacacgttgcgtaggcgtcacgcggagaaagtgagcgaacgatacggtgcgtttagagaagagcggtttttgaaaggcgagtttggtgggagaggaagtcgcagacgcgcgtttataacgcattttacgggatgtcaaccatgtagcggtgatcataatccgagttacgatggtgacacgtgttggaatgagatgatcagagcccttaattttgctgataatcaggtgatgcgcgtgtatggttacgttcattctgatttgagtaagacttctccgcttcaacctctgccgttcgattatcctaatgaagcttggtga

SEQ ID NO: 1524 - protein, 1299 aa, Arabidopsis thaliana
  misc_feature: PFam Name: Pro_CA; PFam Description: Carbonic anhydrase
  misc_feature: GI Number: 21593413; NR Description: carbonic anhydrase, putative [Arabidopsis thaliana] >gi|3176676|gb|AAC18799.1| Similar to carbonic anhydrase gb|L19255 from Nicotiana tabacum. ESTs gb|AA597643, gb|T45390, gb|T43963 and gb|AA597734 come from this
  misc_feature: GI Number: 21281000; NR Description: putative carbonic anhydrase [Arabidopsis thaliana] >gi|14334470|gb|AAK59433.1| putative carbonic anhydrase [Arabidopsis thaliana] >gi|15223141|ref|NP_177198.1| carbonic anhydrase, putative /
  misc_feature: GI Number: 21386933; NR Description: putative carbonic anhydrase [Arabidopsis thaliana] >gi|19698837|gb|AAL91154.1| putative carbonic anhydrase [Arabidopsis thaliana] >gi|4056455|gb|AAC98028.1| Similar to gb|L19255 carbonic
  misc_feature: GI Number: 56562175; NR Description: carbonic anhydrase
  misc_feature: GI Number: 3061271; NR Description: NPCA1 [Nicotiana paniculata]
ATGGGAAAACCCGGCGGCGCAAAGACCAGAACCGCCGTATGTTTATCAGACGGTGTTTTCTTTCTCGCCGGAGCTTTCATGTCTCTCACTCTCGTCTGGTCTTACTTCTCAATCTTTTCACCTTCTTTCACCAGTTTACGTCACGACGGCAAACCGGTTCAATGCTCCGGTTTAGACATGCAATTCGACCCATCCGAGCCCGGTTTTTACGACGACCCGGATCTAAGCTACTCGATCGAGAAACCAATCACAAAATGGGACGAGAAACGAAACCAATGGTTTGAATCACACCCATCTTTCAAACCCGGTTCAGAAAACCGGATCGTAATGGTAACCGGTTCACAATCCTCGCCGTGTAAAAACCCAATCGGAGACCATTTATTACTCCGATGCTTCAAAAACAAAGTCGATTACGCTCGAATCCATGGTCACGACATCTTCTACAGCAATTCTCTTCTTCATCCGAAGATGAATTCTTATTGGGCGAAACTTCCGGTGGTTAAAGCGGCGATGCTTGCTCACCCAGAGGCGGAGTGGATTTGGTGGGTTGATTCCGACGCTATCTTCACCGACATGGAATTTAAACCGCCGCTTCACCGTTACCGTCAACACAACCTCGTCGTTCACGGTTGGCCAAATATAATCTACGAGAAACAGAGCTGGACGGCGTTAAACGCCGGCGTTTTCTTAATAAGAAATTGTCAATGGTCAATGGACTTAATTGACACGTGGAAGAGTATGGGACCAGTGAGTCCAGATTACAAAAAATGGGGTCCCATCCAACGGTCGATATTCAAAGATAAGTTGTTTCCAGAGTCAGATGATCAAACGGCTCTGATTTATTTGCTTTATAAACATAAAGAGTTGTATTATCCTAAGATATACCTCGAAGCAGAGTATTATCTCCAAGGGTATTGGATTGGTGTATTTGGGGATTTCGCCAACGTGACGGAACGGTATCTTGAGATGGAACGAGAAGACGACACGTTGCGTAGGCGTCACGCGGAGAAAGTGAGCGAACGATACGGTGCGTTTAGAGAAGAGCGGTTTTTGAAAGGCGAGTTTGGTGGGAGAGGAAGTCGCAGACGCGCGTTTATAACGCATTTTACGGGATGTCAACCATGTAGCGGTGATCATAATCCGAGTTACGATGGTGACACGTGTTGGAATGAGATGATCAGAGCCCTTAATTTTGCTGATAATCAGGTGATGCGCGTGTATGGTTACGTTCATTCTGATTTGAGTAAGACTTCTCCGCTTCAACCTCTGCCGTTCGATTATCCTAATGAAGCTTGGTGA

SEQ ID NO: 1525 - DNA, 1761 bp, Arabidopsis thaliana
  misc_feature (1)..(1761): Ceres cDNA ID no. 12651001
  misc_feature (1)..(1761): Also known as  Ceres CDNA ID no. 23542785
aacacttttcttgttgtgagagtaagagggaggttaaaatgagcataatgaggaatttcttgagtatgataattatgctttgcgtatgtctcaattggtgttttgctgaaggagctgagaaaagcgatagtggaaaggtacttgattcttacaccattcaagtcagctctctgttcccttcatcatcatcttgtgtcccttcttcaaaagcatctaataccaagtcgtcgctgcgcgtggtgcacatgcatggtgcgtgctcgcatcttagcagcgatgcgagagtcgaccatgacgaaatcatcagacgcgatcaagcacgtgtggagtccatctactcaaaattgtcaaagaatagcgcaaatgaagtcagcgaagccaagtcaacggagctaccggctaaaagtggaatcacactcggatcaggaaactacatcgtaacaatcggaatcgggacaccgaagcacgatctatcgctggtcttcgacaccggaagtgacctgacatggactcaatgtgagccatgtctaggaagttgctattcacaaaaggaaccaaaatttaacccttcttcgtcttctacttaccaaaacgtctcgtgctcatctccaatgtgtgaagacgctgagagttgttcggcttccaactgcgtatacagtatcgtttacggcgataagtcgtttacccaaggatttcttgcaaaggagaaatttaccctaacgaactctgatgttttggaggatgtttactttggttgcggtgaaaacaaccaaggacttttcgacggtgttgctgggcttctcggccttggccctggcaaactctcactaccggcgcaaacaacaacgacctacaacaatatcttctcctactgtctaccttctttcacaagtaacagtactggccatcttacctttggatccgctggaatctctgaatccgttaaattcacaccgatttcttccttcccaagcgcattcaattatggcatcgatatcataggtatcagtgtaggcgacaaggaattagcgattactccaaactcattctcgaccgaaggtgctataatcgactcaggcacagtgtttactcgcctccctaccaaagtctacgcggaactccgcagtgtttttaaggaaaagatgtcgagttacaagagtacgtcgggatacgggctttttgacacatgttacgatttcactggcttggatacggtgacatacccgacgattgcattctccttcgccggtagcactgtcgtagaacttgatggatcagggatttcgttgccgatcaagatatcacaggtttgtttggcgtttgcagggaatgatgaccttcccgccatctttggaaacgttcagcagacgacgctagatgttgtgtacgacgtggctggtggacgagtcggttttgctcccaatggttgttaattagctacttgaacaaaaagaagaggagagggttttgtaatttgagtaagggtttggctcgtaaatttagctcctatttatatatagtacgtgtgctaagtaaattgccccaaaaataattttgtgtgtgcgcggcaattgctttcttatatatatacgacatgtagatttgctttcttatatacttcaatcctgacttggaagtaagttttttagtaacgtcaaacatgcttcaacatttgcttaatgtacaagtccgatttaagctaccagaatcatctttttccttgagtgtaaccttttttactcgaaaaagcataaattcatt

SEQ ID NO: 1526 - protein, 1761 aa, Arabidopsis thaliana
  misc_feature: PFam Name: Pro_CA; PFam Description: Carbonic anhydrase
  misc_feature: GI Number: 21593413; NR Description: carbonic anhydrase, putative [Arabidopsis thaliana] >gi|3176676|gb|AAC18799.1| Similar to carbonic anhydrase gb|L19255 from Nicotiana tabacum. ESTs gb|AA597643, gb|T45390, gb|T43963 and gb|AA597734 come from this
  misc_feature: GI Number: 21281000; NR Description: putative carbonic anhydrase [Arabidopsis thaliana] >gi|14334470|gb|AAK59433.1| putative carbonic anhydrase [Arabidopsis thaliana] >gi|15223141|ref|NP_177198.1| carbonic anhydrase, putative /
  misc_feature: GI Number: 21386933; NR Description: putative carbonic anhydrase [Arabidopsis thaliana] >gi|19698837|gb|AAL91154.1| putative carbonic anhydrase [Arabidopsis thaliana] >gi|4056455|gb|AAC98028.1| Similar to gb|L19255 carbonic
  misc_feature: GI Number: 56562175; NR Description: carbonic anhydrase
  misc_feature: GI Number: 3061271; NR Description: NPCA1 [Nicotiana paniculata]
AACACTTTTCTTGTTGTGAGAGTAAGAGGGAGGTTAAAATGAGCATAATGAGGAATTTCTTGAGTATGATAATTATGCTTTGCGTATGTCTCAATTGGTGTTTTGCTGAAGGAGCTGAGAAAAGCGATAGTGGAAAGGTACTTGATTCTTACACCATTCAAGTCAGCTCTCTGTTCCCTTCATCATCATCTTGTGTCCCTTCTTCAAAAGCATCTAATACCAAGTCGTCGCTGCGCGTGGTGCACATGCATGGTGCGTGCTCGCATCTTAGCAGCGATGCGAGAGTCGACCATGACGAAATCATCAGACGCGATCAAGCACGTGTGGAGTCCATCTACTCAAAATTGTCAAAGAATAGCGCAAATGAAGTCAGCGAAGCCAAGTCAACGGAGCTACCGGCTAAAAGTGGAATCACACTCGGATCAGGAAACTACATCGTAACAATCGGAATCGGGACACCGAAGCACGATCTATCGCTGGTCTTCGACACCGGAAGTGACCTGACATGGACTCAATGTGAGCCATGTCTAGGAAGTTGCTATTCACAAAAGGAACCAAAATTTAACCCTTCTTCGTCTTCTACTTACCAAAACGTCTCGTGCTCATCTCCAATGTGTGAAGACGCTGAGAGTTGTTCGGCTTCCAACTGCGTATACAGTATCGTTTACGGCGATAAGTCGTTTACCCAAGGATTTCTTGCAAAGGAGAAATTTACCCTAACGAACTCTGATGTTTTGGAGGATGTTTACTTTGGTTGCGGTGAAAACAACCAAGGACTTTTCGACGGTGTTGCTGGGCTTCTCGGCCTTGGCCCTGGCAAACTCTCACTACCGGCGCAAACAACAACGACCTACAACAATATCTTCTCCTACTGTCTACCTTCTTTCACAAGTAACAGTACTGGCCATCTTACCTTTGGATCCGCTGGAATCTCTGAATCCGTTAAATTCACACCGATTTCTTCCTTCCCAAGCGCATTCAATTATGGCATCGATATCATAGGTATCAGTGTAGGCGACAAGGAATTAGCGATTACTCCAAACTCATTCTCGACCGAAGGTGCTATAATCGACTCAGGCACAGTGTTTACTCGCCTCCCTACCAAAGTCTACGCGGAACTCCGCAGTGTTTTTAAGGAAAAGATGTCGAGTTACAAGAGTACGTCGGGATACGGGCTTTTTGACACATGTTACGATTTCACTGGCTTGGATACGGTGACATACCCGACGATTGCATTCTCCTTCGCCGGTAGCACTGTCGTAGAACTTGATGGATCAGGGATTTCGTTGCCGATCAAGATATCACAGGTTTGTTTGGCGTTTGCAGGGAATGATGACCTTCCCGCCATCTTTGGAAACGTTCAGCAGACGACGCTAGATGTTGTGTACGACGTGGCTGGTGGACGAGTCGGTTTTGCTCCCAATGGTTGTTAATTAGCTACTTGAACAAAAAGAAGAGGAGAGGGTTTTGTAATTTGAGTAAGGGTTTGGCTCGTAAATTTAGCTCCTATTTATATATAGTACGTGTGCTAAGTAAATTGCCCCAAAAATAATTTTGTGTGTGCGCGGCAATTGCTTTCTTATATATATACGACATGTAGATTTGCTTTCTTATATACTTCAATCCTGACTTGGAAGTAAGTTTTTTAGTAACGTCAAACATGCTTCAACATTTGCTTAATGTACAAGTCCGATTTAAGCTACCAGAATCATCTTTTTCCTTGAGTGTAACCTTTTTTACTCGAAAAAGCATAAATTCATT

SEQ ID NO: 1527 - DNA, 1011 bp, Arabidopsis thaliana
  misc_feature (1)..(1011): Ceres cDNA ID no. 12651056
  misc_feature (1)..(1011): Also known as  Ceres CDNA ID no. 23542785
atggagaagagattcaagatatggacatatagagaaggagaagctcctctgtttcacaagggtccactcaacaacatttacgccattgaaggccaattcatggacgagatcgagaacggaaacagccgttttaaggcggcttcaccggaggaagccactgtgttctacatccccgtagggattgtcaatatcatacgctttgtctatagaccttacactagctatgcacgtgaccgtctccaaaacattgttaaagactacatctctctcatctctaaccgttacccttactggaatcgcagtcgcggtgctgatcacttcttcctctcctgtcacgattgggcacctgatgtctcagctgtggatccagaattatacaagcattttataagagctctctgcaatgccaattcctccgaaggattcaccccaatgagagacgtttcattaccggaaatcaacattccacacagccaattagggtttgtacacaccggagaaccgcctcaaaaccgcaaactcttagcattcttcgcgggcggttctcacggagatgtccgaaaaatacttttccaacactggaaagaaaaagacaaagacgtccttgtctacgagaatctccccaaaaccatgaactacacgaaaatgatggacaaggcaaagttttgtttatgtcctagcggttgggaagtggcgagtccgagaattgtcgagtcactttactccggctgtgttccggtcatcatagctgattattacgtcctcccgttcagcgacgtgttgaattggaagacattctcggttcatattccaatatcaaagatgcctgacataaagaagattctagaagcaataacagaagaagagtacttgaatatgcaaagaagagtgcttgaggttcggaaacactttgtcataaacagaccatcaaagccatatgatatgttgcatatgatcatgcattctatttggttacggaggcttaatgttcgaatccctctttcacagtga

SEQ ID NO: 1528 - protein, 1011 aa, Arabidopsis thaliana
  misc_feature: PFam Name: Pro_CA; PFam Description: Carbonic anhydrase
  misc_feature: GI Number: 21593413; NR Description: carbonic anhydrase, putative [Arabidopsis thaliana] >gi|3176676|gb|AAC18799.1| Similar to carbonic anhydrase gb|L19255 from Nicotiana tabacum. ESTs gb|AA597643, gb|T45390, gb|T43963 and gb|AA597734 come from this
  misc_feature: GI Number: 21281000; NR Description: putative carbonic anhydrase [Arabidopsis thaliana] >gi|14334470|gb|AAK59433.1| putative carbonic anhydrase [Arabidopsis thaliana] >gi|15223141|ref|NP_177198.1| carbonic anhydrase, putative /
  misc_feature: GI Number: 21386933; NR Description: putative carbonic anhydrase [Arabidopsis thaliana] >gi|19698837|gb|AAL91154.1| putative carbonic anhydrase [Arabidopsis thaliana] >gi|4056455|gb|AAC98028.1| Similar to gb|L19255 carbonic
  misc_feature: GI Number: 56562175; NR Description: carbonic anhydrase
  misc_feature: GI Number: 3061271; NR Description: NPCA1 [Nicotiana paniculata]
ATGGAGAAGAGATTCAAGATATGGACATATAGAGAAGGAGAAGCTCCTCTGTTTCACAAGGGTCCACTCAACAACATTTACGCCATTGAAGGCCAATTCATGGACGAGATCGAGAACGGAAACAGCCGTTTTAAGGCGGCTTCACCGGAGGAAGCCACTGTGTTCTACATCCCCGTAGGGATTGTCAATATCATACGCTTTGTCTATAGACCTTACACTAGCTATGCACGTGACCGTCTCCAAAACATTGTTAAAGACTACATCTCTCTCATCTCTAACCGTTACCCTTACTGGAATCGCAGTCGCGGTGCTGATCACTTCTTCCTCTCCTGTCACGATTGGGCACCTGATGTCTCAGCTGTGGATCCAGAATTATACAAGCATTTTATAAGAGCTCTCTGCAATGCCAATTCCTCCGAAGGATTCACCCCAATGAGAGACGTTTCATTACCGGAAATCAACATTCCACACAGCCAATTAGGGTTTGTACACACCGGAGAACCGCCTCAAAACCGCAAACTCTTAGCATTCTTCGCGGGCGGTTCTCACGGAGATGTCCGAAAAATACTTTTCCAACACTGGAAAGAAAAAGACAAAGACGTCCTTGTCTACGAGAATCTCCCCAAAACCATGAACTACACGAAAATGATGGACAAGGCAAAGTTTTGTTTATGTCCTAGCGGTTGGGAAGTGGCGAGTCCGAGAATTGTCGAGTCACTTTACTCCGGCTGTGTTCCGGTCATCATAGCTGATTATTACGTCCTCCCGTTCAGCGACGTGTTGAATTGGAAGACATTCTCGGTTCATATTCCAATATCAAAGATGCCTGACATAAAGAAGATTCTAGAAGCAATAACAGAAGAAGAGTACTTGAATATGCAAAGAAGAGTGCTTGAGGTTCGGAAACACTTTGTCATAAACAGACCATCAAAGCCATATGATATGTTGCATATGATCATGCATTCTATTTGGTTACGGAGGCTTAATGTTCGAATCCCTCTTTCACAGTGA

SEQ ID NO: 1529 - DNA, 1916 bp, Arabidopsis thaliana
  misc_feature (1)..(1916): Ceres cDNA ID no. 12651168
  misc_feature (1)..(1916): Also known as  Ceres CDNA ID no. 23542785
atttgatcttggcaagatctcgagagcatttataaagaaattaaagcaacacatacacacatcaatttcgtaatcgttgcagagtaagaccgatcatcgatggctgatgtaatggaacagaatcttcttcaaaccgctgtgcttaaccggacgtccttccatttccaacctcagagaaattggctcaacgatccaaacgcgccaatgtattacaaaggattctaccatttgttctaccagaataaccctttggctcccgaattcagtaggacaagaatcatatggggacactctgtttcacaagacatggtcaattggatccagctcgaaccagcccttgtcccttctgagtcctttgacatcaacagctgctggtcaggatccgccacgatcctccctgatggcagacctgtaattttgtacactggactcgacgtcaacaacaaacagcaagtcacagttgttgccgaaccaaaggacgtttctgaccctttgcttcgtgagtgggttaagccaaagtacaatcctgtgatggttccgccaagtaatgtcccttttaattgtttccgtgatcccacggaggcgtggaaagggcaagatgggaaatggagagtgctcataggagctaaggagaaagatactgagaaaggaatggcgattttgtaccgaagcgatgattttgtccagtggacaaagtatccggtgcctttacttgagtcagaaggaaccggaatgtgggaatgccctgattttttcccggtttctatcactggtaaagaaggtgttgacacttcggtaaacaatgctagtgtgaggcatgtcttgaaggcgagttttggaggcaatgattgctatgtcattggtaaatactcttctgagactgaagacttttcagcggattatgagttcactaacactagtgcagatttgagatatgatcatggaacgttttatgcctcaaaggcgttcttcgatagtgttaaaaataggaggatcaactggggatgggtcatagagactgatagcaaagaagatgattttaagaaaggatgggctggccttatgactcttcccagggaaatttggatggacacaagtggaaagaagctgatgcaatggccaattgaagaaatcaacaatctccggaccaaaagtgttagccttgatgattgctatgaattcaaaaccggctctacctttgaaatctcaggcatcactgctgcccaagcagatgtagaagtgacttttaatctgcctttcctggaaaataatcccgagatacttgatgctgaccaagttgatgatgcgactctgtttgatcgtgatagctcggttggatgtgtttacgggccttttggattgctagcattggcttccagtgatttatcagaacaaaccgcaatcttctttaaagttattcgtcgcggtaacggatatgcagttgtaatgtgcagcagcgagaagaggtcttcgttgagagacaacataaaaaaatcttcgcatggagcattcctagatattgatccaaggcatgagaagatctcattaagatgtttgatcgatcactcgattatagagagctacggagtaggaggaaaaactgtgataacatctagagtttatccaaaattggcaattggtgaagccgctaagctttatgtcttcaatgatggagaaaatggtgtgatcatgacgtccctggaagcttggagcatgagaaatgcccaaatcaattcaaacccaacttattagttaatcatataatatgataatctttggactgccctaaaacaaattcttatcttgtcatgtattgtggaatgtttaagatttatgcgtcgtttgtattcaagttattggtgtggtttatgctgtcgttccttgggtgaaataatgtaagtcttctcatgtttctt

SEQ ID NO: 1530 - protein, 1916 aa, Arabidopsis thaliana
  misc_feature: PFam Name: Pro_CA; PFam Description: Carbonic anhydrase
  misc_feature: GI Number: 21593413; NR Description: carbonic anhydrase, putative [Arabidopsis thaliana] >gi|3176676|gb|AAC18799.1| Similar to carbonic anhydrase gb|L19255 from Nicotiana tabacum. ESTs gb|AA597643, gb|T45390, gb|T43963 and gb|AA597734 come from this
  misc_feature: GI Number: 21281000; NR Description: putative carbonic anhydrase [Arabidopsis thaliana] >gi|14334470|gb|AAK59433.1| putative carbonic anhydrase [Arabidopsis thaliana] >gi|15223141|ref|NP_177198.1| carbonic anhydrase, putative /
  misc_feature: GI Number: 21386933; NR Description: putative carbonic anhydrase [Arabidopsis thaliana] >gi|19698837|gb|AAL91154.1| putative carbonic anhydrase [Arabidopsis thaliana] >gi|4056455|gb|AAC98028.1| Similar to gb|L19255 carbonic
  misc_feature: GI Number: 56562175; NR Description: carbonic anhydrase
  misc_feature: GI Number: 3061271; NR Description: NPCA1 [Nicotiana paniculata]
ATTTGATCTTGGCAAGATCTCGAGAGCATTTATAAAGAAATTAAAGCAACACATACACACATCAATTTCGTAATCGTTGCAGAGTAAGACCGATCATCGATGGCTGATGTAATGGAACAGAATCTTCTTCAAACCGCTGTGCTTAACCGGACGTCCTTCCATTTCCAACCTCAGAGAAATTGGCTCAACGATCCAAACGCGCCAATGTATTACAAAGGATTCTACCATTTGTTCTACCAGAATAACCCTTTGGCTCCCGAATTCAGTAGGACAAGAATCATATGGGGACACTCTGTTTCACAAGACATGGTCAATTGGATCCAGCTCGAACCAGCCCTTGTCCCTTCTGAGTCCTTTGACATCAACAGCTGCTGGTCAGGATCCGCCACGATCCTCCCTGATGGCAGACCTGTAATTTTGTACACTGGACTCGACGTCAACAACAAACAGCAAGTCACAGTTGTTGCCGAACCAAAGGACGTTTCTGACCCTTTGCTTCGTGAGTGGGTTAAGCCAAAGTACAATCCTGTGATGGTTCCGCCAAGTAATGTCCCTTTTAATTGTTTCCGTGATCCCACGGAGGCGTGGAAAGGGCAAGATGGGAAATGGAGAGTGCTCATAGGAGCTAAGGAGAAAGATACTGAGAAAGGAATGGCGATTTTGTACCGAAGCGATGATTTTGTCCAGTGGACAAAGTATCCGGTGCCTTTACTTGAGTCAGAAGGAACCGGAATGTGGGAATGCCCTGATTTTTTCCCGGTTTCTATCACTGGTAAAGAAGGTGTTGACACTTCGGTAAACAATGCTAGTGTGAGGCATGTCTTGAAGGCGAGTTTTGGAGGCAATGATTGCTATGTCATTGGTAAATACTCTTCTGAGACTGAAGACTTTTCAGCGGATTATGAGTTCACTAACACTAGTGCAGATTTGAGATATGATCATGGAACGTTTTATGCCTCAAAGGCGTTCTTCGATAGTGTTAAAAATAGGAGGATCAACTGGGGATGGGTCATAGAGACTGATAGCAAAGAAGATGATTTTAAGAAAGGATGGGCTGGCCTTATGACTCTTCCCAGGGAAATTTGGATGGACACAAGTGGAAAGAAGCTGATGCAATGGCCAATTGAAGAAATCAACAATCTCCGGACCAAAAGTGTTAGCCTTGATGATTGCTATGAATTCAAAACCGGCTCTACCTTTGAAATCTCAGGCATCACTGCTGCCCAAGCAGATGTAGAAGTGACTTTTAATCTGCCTTTCCTGGAAAATAATCCCGAGATACTTGATGCTGACCAAGTTGATGATGCGACTCTGTTTGATCGTGATAGCTCGGTTGGATGTGTTTACGGGCCTTTTGGATTGCTAGCATTGGCTTCCAGTGATTTATCAGAACAAACCGCAATCTTCTTTAAAGTTATTCGTCGCGGTAACGGATATGCAGTTGTAATGTGCAGCAGCGAGAAGAGGTCTTCGTTGAGAGACAACATAAAAAAATCTTCGCATGGAGCATTCCTAGATATTGATCCAAGGCATGAGAAGATCTCATTAAGATGTTTGATCGATCACTCGATTATAGAGAGCTACGGAGTAGGAGGAAAAACTGTGATAACATCTAGAGTTTATCCAAAATTGGCAATTGGTGAAGCCGCTAAGCTTTATGTCTTCAATGATGGAGAAAATGGTGTGATCATGACGTCCCTGGAAGCTTGGAGCATGAGAAATGCCCAAATCAATTCAAACCCAACTTATTAGTTAATCATATAATATGATAATCTTTGGACTGCCCTAAAACAAATTCTTATCTTGTCATGTATTGTGGAATGTTTAAGATTTATGCGTCGTTTGTATTCAAGTTATTGGTGTGGTTTATGCTGTCGTTCCTTGGGTGAAATAATGTAAGTCTTCTCATGTTTCTT

SEQ ID NO: 1531 - DNA, 3060 bp, Arabidopsis thaliana
  misc_feature (1)..(3060): Ceres cDNA ID no. 12651758
  misc_feature (1)..(3060): Also known as  Ceres CDNA ID no. 23542785
atggaactttatgttttctttatatatgtagtcgggaagacacttcataaaaagatccaaaacactaatttactattattattcggaaaactttgttttttcacaaatataaaagttttcatatttagtgagaaaatgagcttccttattcgttccatctgtttccttatcctcattcctagttttctaatcacgtttgtttcagctacgcaacacttgtgtcattccgaccaaaaggatgctcttcttgatttcaagaatgagtttgggatggttgattcaaaatcatgggtgaacaaaagtgattgttgttcgtgggatggtatcacgtgtgatgctaagtcgggaaacgtgatcgggctagaccttagttctatcttcctctatggccagctcaaatccaacagtagtctttttaaactgcgtcatctccgtgatctaaacctcgctaacaacaatttcaacaattcgccaataccagctgagtttgataaactcacagggctagaaagacttgacctctctcagtcttcactttcaggccaaattccaatcaatcttcttcagctaacaaagttggtgtctctcgatctttcttctagtgattttttcggtgatgaatcttttcattatttatccattgataaatcttttcttcctctacttgctcgaaacttgaggaaccttagagaactagatatgagctacgtaaaaatttcttcagaaatccccgaggagttttcaaacatacggtctctaagatctctaaatcttaatggctgcaacctatttggagaatttccaagcagtattcttctgattcccaacttacaatctattgacttagggaacaatcctaatctgagaggcaatcttcccgtttttcatgaaaacaactctttgctaaagttgaccattttgtacacatccttttcaggtgccatacctgactccattagtagcctaaaaaatttgacctctttgaccctttccgtttcttatttctctgggaagattccattttcacttgggaatctttcccatctctcccatcttagtctctcttctaataatcttattggtgaaatcccatcttcaattggcaatctaaaccaattgaccaatttttatgttggtggtaacaagcttagtggaaacttgccagctacgctaagcaatttgaccaaactaaatacaatctctctctcttccaaccagttcacaggttcccttccacctagcattagccaactctctaaactgaagttcttttttgctgatgataatccttttataggagccattctttcacccctactcaagattccctcattgactaggatccatttgagttataaccaactcaacgaccttgttgggattgagaatatctttatgttacctaatttagaaaccttttatatttaccattacaattacaccaaagtccgtccacttgacttaaatgtcttctcgtctctcaagcagctaggcacattatatatctcacgcatccccatttcaaccacaaacatcacttctgattttccatcaaatttggaatatttgagcttaagaagctgcaacatcactgacttccctgagttcataagaaaggggagaaatctacagattctagatctttccaacaacaaaatcaaaggtcaagtaccagactggttgtggagaatgccaacgttgaatagtgtggatctttctaacaactcgctcagcggtttccatgtatccgtaaaagcatctcccgagagtcaactcacgagtgtagacctaagctcaaatgcttttcaaggaccactcttcctcccgtccaagtctctcagatatttttctggttccaacaataacttcaccggaaagatacctcgatcaatatgtggactaagctctctagagatcctagatctatcaaacaacaacctcaacggctcactcccttggtgtttagaaactcttatgagttctctttcagatctagatctccgtaacaacagcctcagcggaagtcttcctgaaatatttatgaatgccacgaagttaaggtcacttgacgtcagccacaaccgaatggagggaaagcttcctggttctcttactggttgctcttctctggaagttctaaatgtgggaagcaatagaatcaacgacatgtttcccttcgagttgaattctttacagaagcttcaagttcttgtcctccactctaacaagtttcatggcacattacataacgttgatggggtttggtttggatttcctcagttgcaaatcattgatgtatcacataatgacttcttcggtatcttgccatctgattacttcatgaactggactgcgatgtcctccaagaaagataataatatagagccagagtacattcagaatcctagtgtatacggttcctcacttggctactacacttcacttgtcttgatgagtaaaggagtatcaatggagatggaacgtgtccttacaatctacacggccatcgatttatcagggaatcaactacatggaaagattcctgattctattggtctgctgaaggagcttcgaattctgaacatgtcaagcaatggttttacaggccacatcccatcttctttagcaaacctgaagaatcttgagtcactcgacatatcccaaaacaatatctctggtgagattcctcctgagctcgggactctctcttctctcgcgtggataaacgtttcacataaccagcttgtaggttccataccacaaggcacacaatttcaacggcaaaaatgctcttcctacgaaggaaaccccggacttaatggtccttctcttgagaatgtttgtggacatatcaaagagtcaacaccaacacaaaccgaaccgttggagacaaaagaagaagaagaagaagaatcatttagttggatagcagcaggtttaggctttgcacctggagttgtatttggactagcgatgggatacatagtggtttcatacaagcatcaatggttcatgaagactttcggacgaagcaagcaacagaacaccagaactcgttaa

SEQ ID NO: 1532 - protein, 3060 aa, Arabidopsis thaliana
  misc_feature: PFam Name: Pro_CA; PFam Description: Carbonic anhydrase
  misc_feature: GI Number: 21593413; NR Description: carbonic anhydrase, putative [Arabidopsis thaliana] >gi|3176676|gb|AAC18799.1| Similar to carbonic anhydrase gb|L19255 from Nicotiana tabacum. ESTs gb|AA597643, gb|T45390, gb|T43963 and gb|AA597734 come from this
  misc_feature: GI Number: 21281000; NR Description: putative carbonic anhydrase [Arabidopsis thaliana] >gi|14334470|gb|AAK59433.1| putative carbonic anhydrase [Arabidopsis thaliana] >gi|15223141|ref|NP_177198.1| carbonic anhydrase, putative /
  misc_feature: GI Number: 21386933; NR Description: putative carbonic anhydrase [Arabidopsis thaliana] >gi|19698837|gb|AAL91154.1| putative carbonic anhydrase [Arabidopsis thaliana] >gi|4056455|gb|AAC98028.1| Similar to gb|L19255 carbonic
  misc_feature: GI Number: 56562175; NR Description: carbonic anhydrase
  misc_feature: GI Number: 3061271; NR Description: NPCA1 [Nicotiana paniculata]
ATGGAACTTTATGTTTTCTTTATATATGTAGTCGGGAAGACACTTCATAAAAAGATCCAAAACACTAATTTACTATTATTATTCGGAAAACTTTGTTTTTTCACAAATATAAAAGTTTTCATATTTAGTGAGAAAATGAGCTTCCTTATTCGTTCCATCTGTTTCCTTATCCTCATTCCTAGTTTTCTAATCACGTTTGTTTCAGCTACGCAACACTTGTGTCATTCCGACCAAAAGGATGCTCTTCTTGATTTCAAGAATGAGTTTGGGATGGTTGATTCAAAATCATGGGTGAACAAAAGTGATTGTTGTTCGTGGGATGGTATCACGTGTGATGCTAAGTCGGGAAACGTGATCGGGCTAGACCTTAGTTCTATCTTCCTCTATGGCCAGCTCAAATCCAACAGTAGTCTTTTTAAACTGCGTCATCTCCGTGATCTAAACCTCGCTAACAACAATTTCAACAATTCGCCAATACCAGCTGAGTTTGATAAACTCACAGGGCTAGAAAGACTTGACCTCTCTCAGTCTTCACTTTCAGGCCAAATTCCAATCAATCTTCTTCAGCTAACAAAGTTGGTGTCTCTCGATCTTTCTTCTAGTGATTTTTTCGGTGATGAATCTTTTCATTATTTATCCATTGATAAATCTTTTCTTCCTCTACTTGCTCGAAACTTGAGGAACCTTAGAGAACTAGATATGAGCTACGTAAAAATTTCTTCAGAAATCCCCGAGGAGTTTTCAAACATACGGTCTCTAAGATCTCTAAATCTTAATGGCTGCAACCTATTTGGAGAATTTCCAAGCAGTATTCTTCTGATTCCCAACTTACAATCTATTGACTTAGGGAACAATCCTAATCTGAGAGGCAATCTTCCCGTTTTTCATGAAAACAACTCTTTGCTAAAGTTGACCATTTTGTACACATCCTTTTCAGGTGCCATACCTGACTCCATTAGTAGCCTAAAAAATTTGACCTCTTTGACCCTTTCCGTTTCTTATTTCTCTGGGAAGATTCCATTTTCACTTGGGAATCTTTCCCATCTCTCCCATCTTAGTCTCTCTTCTAATAATCTTATTGGTGAAATCCCATCTTCAATTGGCAATCTAAACCAATTGACCAATTTTTATGTTGGTGGTAACAAGCTTAGTGGAAACTTGCCAGCTACGCTAAGCAATTTGACCAAACTAAATACAATCTCTCTCTCTTCCAACCAGTTCACAGGTTCCCTTCCACCTAGCATTAGCCAACTCTCTAAACTGAAGTTCTTTTTTGCTGATGATAATCCTTTTATAGGAGCCATTCTTTCACCCCTACTCAAGATTCCCTCATTGACTAGGATCCATTTGAGTTATAACCAACTCAACGACCTTGTTGGGATTGAGAATATCTTTATGTTACCTAATTTAGAAACCTTTTATATTTACCATTACAATTACACCAAAGTCCGTCCACTTGACTTAAATGTCTTCTCGTCTCTCAAGCAGCTAGGCACATTATATATCTCACGCATCCCCATTTCAACCACAAACATCACTTCTGATTTTCCATCAAATTTGGAATATTTGAGCTTAAGAAGCTGCAACATCACTGACTTCCCTGAGTTCATAAGAAAGGGGAGAAATCTACAGATTCTAGATCTTTCCAACAACAAAATCAAAGGTCAAGTACCAGACTGGTTGTGGAGAATGCCAACGTTGAATAGTGTGGATCTTTCTAACAACTCGCTCAGCGGTTTCCATGTATCCGTAAAAGCATCTCCCGAGAGTCAACTCACGAGTGTAGACCTAAGCTCAAATGCTTTTCAAGGACCACTCTTCCTCCCGTCCAAGTCTCTCAGATATTTTTCTGGTTCCAACAATAACTTCACCGGAAAGATACCTCGATCAATATGTGGACTAAGCTCTCTAGAGATCCTAGATCTATCAAACAACAACCTCAACGGCTCACTCCCTTGGTGTTTAGAAACTCTTATGAGTTCTCTTTCAGATCTAGATCTCCGTAACAACAGCCTCAGCGGAAGTCTTCCTGAAATATTTATGAATGCCACGAAGTTAAGGTCACTTGACGTCAGCCACAACCGAATGGAGGGAAAGCTTCCTGGTTCTCTTACTGGTTGCTCTTCTCTGGAAGTTCTAAATGTGGGAAGCAATAGAATCAACGACATGTTTCCCTTCGAGTTGAATTCTTTACAGAAGCTTCAAGTTCTTGTCCTCCACTCTAACAAGTTTCATGGCACATTACATAACGTTGATGGGGTTTGGTTTGGATTTCCTCAGTTGCAAATCATTGATGTATCACATAATGACTTCTTCGGTATCTTGCCATCTGATTACTTCATGAACTGGACTGCGATGTCCTCCAAGAAAGATAATAATATAGAGCCAGAGTACATTCAGAATCCTAGTGTATACGGTTCCTCACTTGGCTACTACACTTCACTTGTCTTGATGAGTAAAGGAGTATCAATGGAGATGGAACGTGTCCTTACAATCTACACGGCCATCGATTTATCAGGGAATCAACTACATGGAAAGATTCCTGATTCTATTGGTCTGCTGAAGGAGCTTCGAATTCTGAACATGTCAAGCAATGGTTTTACAGGCCACATCCCATCTTCTTTAGCAAACCTGAAGAATCTTGAGTCACTCGACATATCCCAAAACAATATCTCTGGTGAGATTCCTCCTGAGCTCGGGACTCTCTCTTCTCTCGCGTGGATAAACGTTTCACATAACCAGCTTGTAGGTTCCATACCACAAGGCACACAATTTCAACGGCAAAAATGCTCTTCCTACGAAGGAAACCCCGGACTTAATGGTCCTTCTCTTGAGAATGTTTGTGGACATATCAAAGAGTCAACACCAACACAAACCGAACCGTTGGAGACAAAAGAAGAAGAAGAAGAAGAATCATTTAGTTGGATAGCAGCAGGTTTAGGCTTTGCACCTGGAGTTGTATTTGGACTAGCGATGGGATACATAGTGGTTTCATACAAGCATCAATGGTTCATGAAGACTTTCGGACGAAGCAAGCAACAGAACACCAGAACTCGTTAA

SEQ ID NO: 1533 - DNA, 1047 bp, Arabidopsis thaliana
  misc_feature (1)..(1047): Ceres cDNA ID no. 12651990
  misc_feature (1)..(1047): Also known as  Ceres CDNA ID no. 23542785
atggagaagccaaagttcaagactgtccaagaggtggttgcagccggtcaaggactaccggagagatatctccatgcaccaaccggcgaaggcgaaagtcaaccacttaacggtgcggtgccggagatggatattccggccatcgatctcagtcttctcttctcttcctctgtagacggtcaagaagagatgaagaaacttcactcagcactctctacatggggcgttgttcaggtgatgaatcatggaattactgaagcttttcttgacaagatttacaagctaaccaagcagttctttgcgcttccgaccgaagagaaacacaagtgtgctagagagacaggtaatatccaaggatatggtaacgatatgattctgtctgataatcaagttcttgattggatcgaccgtttgtttctcactacttaccctgaagataagcgtcaacttaaattctggcctcaagtccctgtcggattcagcgagacgttagatgaatacacaatgaagcaacgggtattgattgagaaattctttaaggctatggctagatcattggaattggaagagaattgttttctagaaatgtatggagaaaatgctgtaatgaattcaagattcaacttctttcctccatgtccaaggccagacaaggttattgggattaaaccgcatgctgatggttcagctatcactcttctcttacccgacaaagatgtcgaagggcttcagtttcttaaagatgggaagtggtataaagctccaatagttcctgatacaattcttatcactttaggtgatcaaatggagataatgagtaatgggatatataagagcccggttcatcgagtggtgaccaacagagagaaggaaaggatatctgtggcaacgttttgtgtaccgggtctagacaaagagattcaccctgcagatgggcttgtgactgaggcaagaccaagattgtataaaacagttaccaagtatgtggatctccactacaagtactatcaacagggtcgaagaactattgaagctgcattaatctga

SEQ ID NO: 1534 - protein, 1047 aa, Arabidopsis thaliana
  misc_feature: PFam Name: Pro_CA; PFam Description: Carbonic anhydrase
  misc_feature: GI Number: 21593413; NR Description: carbonic anhydrase, putative [Arabidopsis thaliana] >gi|3176676|gb|AAC18799.1| Similar to carbonic anhydrase gb|L19255 from Nicotiana tabacum. ESTs gb|AA597643, gb|T45390, gb|T43963 and gb|AA597734 come from this
  misc_feature: GI Number: 21281000; NR Description: putative carbonic anhydrase [Arabidopsis thaliana] >gi|14334470|gb|AAK59433.1| putative carbonic anhydrase [Arabidopsis thaliana] >gi|15223141|ref|NP_177198.1| carbonic anhydrase, putative /
  misc_feature: GI Number: 21386933; NR Description: putative carbonic anhydrase [Arabidopsis thaliana] >gi|19698837|gb|AAL91154.1| putative carbonic anhydrase [Arabidopsis thaliana] >gi|4056455|gb|AAC98028.1| Similar to gb|L19255 carbonic
  misc_feature: GI Number: 56562175; NR Description: carbonic anhydrase
  misc_feature: GI Number: 3061271; NR Description: NPCA1 [Nicotiana paniculata]
ATGGAGAAGCCAAAGTTCAAGACTGTCCAAGAGGTGGTTGCAGCCGGTCAAGGACTACCGGAGAGATATCTCCATGCACCAACCGGCGAAGGCGAAAGTCAACCACTTAACGGTGCGGTGCCGGAGATGGATATTCCGGCCATCGATCTCAGTCTTCTCTTCTCTTCCTCTGTAGACGGTCAAGAAGAGATGAAGAAACTTCACTCAGCACTCTCTACATGGGGCGTTGTTCAGGTGATGAATCATGGAATTACTGAAGCTTTTCTTGACAAGATTTACAAGCTAACCAAGCAGTTCTTTGCGCTTCCGACCGAAGAGAAACACAAGTGTGCTAGAGAGACAGGTAATATCCAAGGATATGGTAACGATATGATTCTGTCTGATAATCAAGTTCTTGATTGGATCGACCGTTTGTTTCTCACTACTTACCCTGAAGATAAGCGTCAACTTAAATTCTGGCCTCAAGTCCCTGTCGGATTCAGCGAGACGTTAGATGAATACACAATGAAGCAACGGGTATTGATTGAGAAATTCTTTAAGGCTATGGCTAGATCATTGGAATTGGAAGAGAATTGTTTTCTAGAAATGTATGGAGAAAATGCTGTAATGAATTCAAGATTCAACTTCTTTCCTCCATGTCCAAGGCCAGACAAGGTTATTGGGATTAAACCGCATGCTGATGGTTCAGCTATCACTCTTCTCTTACCCGACAAAGATGTCGAAGGGCTTCAGTTTCTTAAAGATGGGAAGTGGTATAAAGCTCCAATAGTTCCTGATACAATTCTTATCACTTTAGGTGATCAAATGGAGATAATGAGTAATGGGATATATAAGAGCCCGGTTCATCGAGTGGTGACCAACAGAGAGAAGGAAAGGATATCTGTGGCAACGTTTTGTGTACCGGGTCTAGACAAAGAGATTCACCCTGCAGATGGGCTTGTGACTGAGGCAAGACCAAGATTGTATAAAACAGTTACCAAGTATGTGGATCTCCACTACAAGTACTATCAACAGGGTCGAAGAACTATTGAAGCTGCATTAATCTGA

SEQ ID NO: 1535 - DNA, 948 bp, Arabidopsis thaliana
  misc_feature (1)..(948): Ceres cDNA ID no. 12652035
  misc_feature (1)..(948): Also known as  Ceres CDNA ID no. 23542785
atggaatctgatctaaccacagagcatcatctaccattcatccgaattcataagaacggccgagtcgagcggcttagcggcaacgacatcaaaccaacgtctttaaacccacaaaacgatgtcgtttcgaaagacgtcatgtactcatcggaccacaacctctccgtccgtatgtttctccccaacaaatctagaaaactcgacaccgccggtaacaaaatacctctactcatctactttcacggcggagcttacatcatacaatctcctttctctccggtttaccataactacctcacggaggttgttataaccgctaactgcctagccgtgtcggttcagtaccgtcttgcgccagagcatccggttccggcggcttacgacgattcatggtctgcgattcagtggatcttttctcattctgatgattggattaatgaatacgctgatttcgacagagtttttatcgccggagatagtgccggagccaatatatcgcatcacatgggaataagagctggtaaggagaagcttagccctacaatcaaagggattgttatggtgcatccaggtttttgggggaaagaaccgatcgacgaacacgatgtacaagacggagaagtcagaaacaagatcgcatatatttgggaaaatatcgttagcccgaatagtgttgatggagtgaatgatccgtggtttaatgttgttggatccggatcggatgtttccgagatgggatgtgaaaaggttttggttgcggttgccggaaaagatgtgttttggcggcaaggattggcttatgcggcgaagctggagaagagtcagtggaaaggaagtgttgaggtgattgaggaagaagaggaaggacactgcttccatctccataaccataattctcaaaatgcttcgaaattgatgcagaagtttttggagtttatcataagttga

SEQ ID NO: 1536 - protein, 948 aa, Arabidopsis thaliana
  misc_feature: PFam Name: Pro_CA; PFam Description: Carbonic anhydrase
  misc_feature: GI Number: 21593413; NR Description: carbonic anhydrase, putative [Arabidopsis thaliana] >gi|3176676|gb|AAC18799.1| Similar to carbonic anhydrase gb|L19255 from Nicotiana tabacum. ESTs gb|AA597643, gb|T45390, gb|T43963 and gb|AA597734 come from this
  misc_feature: GI Number: 21281000; NR Description: putative carbonic anhydrase [Arabidopsis thaliana] >gi|14334470|gb|AAK59433.1| putative carbonic anhydrase [Arabidopsis thaliana] >gi|15223141|ref|NP_177198.1| carbonic anhydrase, putative /
  misc_feature: GI Number: 21386933; NR Description: putative carbonic anhydrase [Arabidopsis thaliana] >gi|19698837|gb|AAL91154.1| putative carbonic anhydrase [Arabidopsis thaliana] >gi|4056455|gb|AAC98028.1| Similar to gb|L19255 carbonic
  misc_feature: GI Number: 56562175; NR Description: carbonic anhydrase
  misc_feature: GI Number: 3061271; NR Description: NPCA1 [Nicotiana paniculata]
ATGGAATCTGATCTAACCACAGAGCATCATCTACCATTCATCCGAATTCATAAGAACGGCCGAGTCGAGCGGCTTAGCGGCAACGACATCAAACCAACGTCTTTAAACCCACAAAACGATGTCGTTTCGAAAGACGTCATGTACTCATCGGACCACAACCTCTCCGTCCGTATGTTTCTCCCCAACAAATCTAGAAAACTCGACACCGCCGGTAACAAAATACCTCTACTCATCTACTTTCACGGCGGAGCTTACATCATACAATCTCCTTTCTCTCCGGTTTACCATAACTACCTCACGGAGGTTGTTATAACCGCTAACTGCCTAGCCGTGTCGGTTCAGTACCGTCTTGCGCCAGAGCATCCGGTTCCGGCGGCTTACGACGATTCATGGTCTGCGATTCAGTGGATCTTTTCTCATTCTGATGATTGGATTAATGAATACGCTGATTTCGACAGAGTTTTTATCGCCGGAGATAGTGCCGGAGCCAATATATCGCATCACATGGGAATAAGAGCTGGTAAGGAGAAGCTTAGCCCTACAATCAAAGGGATTGTTATGGTGCATCCAGGTTTTTGGGGGAAAGAACCGATCGACGAACACGATGTACAAGACGGAGAAGTCAGAAACAAGATCGCATATATTTGGGAAAATATCGTTAGCCCGAATAGTGTTGATGGAGTGAATGATCCGTGGTTTAATGTTGTTGGATCCGGATCGGATGTTTCCGAGATGGGATGTGAAAAGGTTTTGGTTGCGGTTGCCGGAAAAGATGTGTTTTGGCGGCAAGGATTGGCTTATGCGGCGAAGCTGGAGAAGAGTCAGTGGAAAGGAAGTGTTGAGGTGATTGAGGAAGAAGAGGAAGGACACTGCTTCCATCTCCATAACCATAATTCTCAAAATGCTTCGAAATTGATGCAGAAGTTTTTGGAGTTTATCATAAGTTGA

SEQ ID NO: 1537 - DNA, 1775 bp, Arabidopsis thaliana
  misc_feature (1)..(1775): Ceres cDNA ID no. 12652129
  misc_feature (1)..(1775): Also known as  Ceres CDNA ID no. 23542785
cgacaaaagaagctgcttcttcatctctctctctctccttctctttctctctcaactccaattcgtttttaccagtttcgaatctgaacaaagttgggttttttattggtacccagaatctcaattctccttctttccttctgggtataggaaaagtctcgcctttttttatatttatccaatcgctcctgttcattgattccccagtaggattgtagtttttggttattgggaaaattgagtaaaggaggagatgggttgtttctcgtgttttgattcgagtgatgacgagaagctgaatccagttgatgaatctaatcatggtcagaagaaacaatcacaaccgacagtatccaataacatatctggactcccttcaggtggggagaagcttagctcaaagaccaatggaggatcaaaaagggagctactgcttccaagggatggacttggacaaattgctgctcatacatttgctttccgcgagcttgctgctgcaactatgaactttcatcctgacactttcttaggcgaaggtggatttggacgtgtctacaaaggaaggcttgacagcaccggtcaggttgttgctgttaaacaactagacaggaatggtctacaaggtaacagagaatttctggtagaggttcttatgctcagtcttcttcatcatcccaacttagtcaaccttattggttattgtgctgatggagatcaacgcctcttggtctacgagtttatgccgttaggatcattggaagatcacctccacgatcttccaccggataaggaggccttagattggaacatgagaatgaaaatagctgctggtgcggcgaaaggattggaatttctacatgataaggcaaaccctccggttatttatagagattttaagtcatcaaatattttactggatgagggtttccaccctaagctttctgattttggacttgctaaactcggaccaacgggagacaaatctcatgtctccactagagttatgggaacttatggttattgtgctcccgagtacgcaatgacgggacaattgacagtaaaatcagatgtctacagttttggtgtggtttttctcgagctcattactggtcgcaaagctatagacagcgagatgcctcatggagagcagaacctggtggcttgggctcgcccattgttcaacgacaggcgaaagttcataaaactggctgatccaaggttaaaggggcggtttccaacgcgtgcactctaccaagctttagctgtggcatcaatgtgcatccaagaacaggcggctacacgtcctctcatagcagatgttgtcactgcactctcctatcttgcaaaccaagcttatgatccaagtaaagatgatagtagaagaaaccgggatgaaagaggtgcaaggttaataacaaggaacgacgatggaggtggctcgggaagtaaattcgatttagaaggttcagagaaagaagattcaccgagagagacagctcggatattgaaccgagatatcaatagggagcgtgcggttgcagaggctaagatgtggggagagagtttgagggagaaacgaagacagagcgagcagggtacttcagagagcaacagtaccgggtagaaccggtttgggtcggtcttgacccttttttgttcttatttctctcaagactctcatttattgtcaaacatagaaaacaaacaaaaaaacattgggacgacgagttgctgtacattatatatgtgatgttgcaatatgggcacaaaggtta

SEQ ID NO: 1538 - protein, 1775 aa, Arabidopsis thaliana
  misc_feature: PFam Name: Pro_CA; PFam Description: Carbonic anhydrase
  misc_feature: GI Number: 21593413; NR Description: carbonic anhydrase, putative [Arabidopsis thaliana] >gi|3176676|gb|AAC18799.1| Similar to carbonic anhydrase gb|L19255 from Nicotiana tabacum. ESTs gb|AA597643, gb|T45390, gb|T43963 and gb|AA597734 come from this
  misc_feature: GI Number: 21281000; NR Description: putative carbonic anhydrase [Arabidopsis thaliana] >gi|14334470|gb|AAK59433.1| putative carbonic anhydrase [Arabidopsis thaliana] >gi|15223141|ref|NP_177198.1| carbonic anhydrase, putative /
  misc_feature: GI Number: 21386933; NR Description: putative carbonic anhydrase [Arabidopsis thaliana] >gi|19698837|gb|AAL91154.1| putative carbonic anhydrase [Arabidopsis thaliana] >gi|4056455|gb|AAC98028.1| Similar to gb|L19255 carbonic
  misc_feature: GI Number: 56562175; NR Description: carbonic anhydrase
  misc_feature: GI Number: 3061271; NR Description: NPCA1 [Nicotiana paniculata]
CGACAAAAGAAGCTGCTTCTTCATCTCTCTCTCTCTCCTTCTCTTTCTCTCTCAACTCCAATTCGTTTTTACCAGTTTCGAATCTGAACAAAGTTGGGTTTTTTATTGGTACCCAGAATCTCAATTCTCCTTCTTTCCTTCTGGGTATAGGAAAAGTCTCGCCTTTTTTTATATTTATCCAATCGCTCCTGTTCATTGATTCCCCAGTAGGATTGTAGTTTTTGGTTATTGGGAAAATTGAGTAAAGGAGGAGATGGGTTGTTTCTCGTGTTTTGATTCGAGTGATGACGAGAAGCTGAATCCAGTTGATGAATCTAATCATGGTCAGAAGAAACAATCACAACCGACAGTATCCAATAACATATCTGGACTCCCTTCAGGTGGGGAGAAGCTTAGCTCAAAGACCAATGGAGGATCAAAAAGGGAGCTACTGCTTCCAAGGGATGGACTTGGACAAATTGCTGCTCATACATTTGCTTTCCGCGAGCTTGCTGCTGCAACTATGAACTTTCATCCTGACACTTTCTTAGGCGAAGGTGGATTTGGACGTGTCTACAAAGGAAGGCTTGACAGCACCGGTCAGGTTGTTGCTGTTAAACAACTAGACAGGAATGGTCTACAAGGTAACAGAGAATTTCTGGTAGAGGTTCTTATGCTCAGTCTTCTTCATCATCCCAACTTAGTCAACCTTATTGGTTATTGTGCTGATGGAGATCAACGCCTCTTGGTCTACGAGTTTATGCCGTTAGGATCATTGGAAGATCACCTCCACGATCTTCCACCGGATAAGGAGGCCTTAGATTGGAACATGAGAATGAAAATAGCTGCTGGTGCGGCGAAAGGATTGGAATTTCTACATGATAAGGCAAACCCTCCGGTTATTTATAGAGATTTTAAGTCATCAAATATTTTACTGGATGAGGGTTTCCACCCTAAGCTTTCTGATTTTGGACTTGCTAAACTCGGACCAACGGGAGACAAATCTCATGTCTCCACTAGAGTTATGGGAACTTATGGTTATTGTGCTCCCGAGTACGCAATGACGGGACAATTGACAGTAAAATCAGATGTCTACAGTTTTGGTGTGGTTTTTCTCGAGCTCATTACTGGTCGCAAAGCTATAGACAGCGAGATGCCTCATGGAGAGCAGAACCTGGTGGCTTGGGCTCGCCCATTGTTCAACGACAGGCGAAAGTTCATAAAACTGGCTGATCCAAGGTTAAAGGGGCGGTTTCCAACGCGTGCACTCTACCAAGCTTTAGCTGTGGCATCAATGTGCATCCAAGAACAGGCGGCTACACGTCCTCTCATAGCAGATGTTGTCACTGCACTCTCCTATCTTGCAAACCAAGCTTATGATCCAAGTAAAGATGATAGTAGAAGAAACCGGGATGAAAGAGGTGCAAGGTTAATAACAAGGAACGACGATGGAGGTGGCTCGGGAAGTAAATTCGATTTAGAAGGTTCAGAGAAAGAAGATTCACCGAGAGAGACAGCTCGGATATTGAACCGAGATATCAATAGGGAGCGTGCGGTTGCAGAGGCTAAGATGTGGGGAGAGAGTTTGAGGGAGAAACGAAGACAGAGCGAGCAGGGTACTTCAGAGAGCAACAGTACCGGGTAGAACCGGTTTGGGTCGGTCTTGACCCTTTTTTGTTCTTATTTCTCTCAAGACTCTCATTTATTGTCAAACATAGAAAACAAACAAAAAAACATTGGGACGACGAGTTGCTGTACATTATATATGTGATGTTGCAATATGGGCACAAAGGTTA

SEQ ID NO: 1539 - DNA, 820 bp, Arabidopsis thaliana
  misc_feature (1)..(820): Ceres cDNA ID no. 12652266
  misc_feature (1)..(820): Ceres CLONE  ID no. 1359555
  misc_feature (1)..(820): Also known as  Ceres CDNA ID no. 23659454
agtttctattgttgttcatctctcaatcgtctctttcgatattttctcaggaaaatctttacaacatccgtggagaagcaacaccagaatccgaattcagcgatggatccagcgcgggaatgcgaaggcaaaggagcttgcgaattgaaatcgaacaagcgatttgctgataaaatcatgcctcatcttctcaacttgtacgggtctagtgcaaaagccaacgattttgacatgtatgcaccaaatgcttcatttgaagaccctttgacgcatgctcagggagtgaagcagatcaaatcagcattttattcactccctaaggtgtttggtgagtcgaaaatagttgaatatcatattcaagaaagtgaaacctcgccggggaagaaagagatactaattgacaacaaacaacactacaagatcatgggaaggaacatagatatgatctctctcattaagctctatgtcgaggacgggaagatcgttcgacatgaagactggtgggacaagaaacctctgaggaacagagacacggttagctttccattagtcggacgggtaatggagatgggtcgaagaggcttgatgctagcgactcatgccatgatgggttttggtaaagatcctgactcccaatgaacaaatggaaaatacaaaacacacatcatgttatagtgttcagtttcttcaaaacactacttgaatttaagaaactcctttaatcgatttggtttcgaatttagtttaaaaatatgtaatacagtatgttaatcgtctgttggtttttagtctggtacgatacagtcaataactgaatttg

SEQ ID NO: 1540 - protein, 820 aa, Arabidopsis thaliana
  misc_feature: GI Number: 34905882; NR Description: P0458E05.17 [Oryza sativa (japonica cultivar-group)] >gi|21902069|dbj|BAC05617.1|
AGTTTCTATTGTTGTTCATCTCTCAATCGTCTCTTTCGATATTTTCTCAGGAAAATCTTTACAACATCCGTGGAGAAGCAACACCAGAATCCGAATTCAGCGATGGATCCAGCGCGGGAATGCGAAGGCAAAGGAGCTTGCGAATTGAAATCGAACAAGCGATTTGCTGATAAAATCATGCCTCATCTTCTCAACTTGTACGGGTCTAGTGCAAAAGCCAACGATTTTGACATGTATGCACCAAATGCTTCATTTGAAGACCCTTTGACGCATGCTCAGGGAGTGAAGCAGATCAAATCAGCATTTTATTCACTCCCTAAGGTGTTTGGTGAGTCGAAAATAGTTGAATATCATATTCAAGAAAGTGAAACCTCGCCGGGGAAGAAAGAGATACTAATTGACAACAAACAACACTACAAGATCATGGGAAGGAACATAGATATGATCTCTCTCATTAAGCTCTATGTCGAGGACGGGAAGATCGTTCGACATGAAGACTGGTGGGACAAGAAACCTCTGAGGAACAGAGACACGGTTAGCTTTCCATTAGTCGGACGGGTAATGGAGATGGGTCGAAGAGGCTTGATGCTAGCGACTCATGCCATGATGGGTTTTGGTAAAGATCCTGACTCCCAATGAACAAATGGAAAATACAAAACACACATCATGTTATAGTGTTCAGTTTCTTCAAAACACTACTTGAATTTAAGAAACTCCTTTAATCGATTTGGTTTCGAATTTAGTTTAAAAATATGTAATACAGTATGTTAATCGTCTGTTGGTTTTTAGTCTGGTACGATACAGTCAATAACTGAATTTG

SEQ ID NO: 1541 - DNA, 1220 bp, Arabidopsis thaliana
  misc_feature (1)..(1220): Ceres cDNA ID no. 12652357
  misc_feature (1)..(1220): Also known as  Ceres CDNA ID no. 23659454
aagtacaacaatcaactctaagtctattatattcaagtctttgttttaacctaacaatggcttcaaataaacttatttcgattctagttctcgtagttacacttttactccaaggtgataacaattacgtcgtcgaagcacaactcacgactaacttctactcaacctcttgccccaacctcctctccaccgtccaaaccgccgttaaatctgccgttaacagcgaggctcgaatgggtgcatctatcctccgtctcttcttccacgattgctttgtcaacggatgcgacggttcgattctactagacgatacgtcaagcttcacaggagaacaaaacgcggctccaaaccgcaattcagctcgtgggtttaatgtgatcgacaacatcaaatcagcggttgagaaagcatgtcccggggttgtgtcttgtgctgatatcttagccattgctgctagagactccgtcgtagcccttggaggaccgaactggaatgtgaaagtaggaagaagagatgcaagaacggcgagtcaagcggcagcgaatagtaacattccggcaccgacttcgagtctgagccaactcattagtagtttcagtgctgttggactctccaccagagatatggttgctctctctggcgcacacacgatcggacaatcccgttgcacgaacttccgagcgagaatctacaacgagacaaacatcaatgccgccttcgccacgacacgtcaacgaacttgccctagagcctccggttccggcgacggaaacctagctccactagacgtcaccacggcagcttctttcgacaacaactacttcaagaatctcatgactcagagagggctcctccattccgaccaagtgctcttcaacggcggctctactgactccatcgtccgtggatacagcaacaatccgtcgagctttaactctgacttcacggcggcgatgataaaaatgggtgatatcagcccgttgactggtagtagcggtgaaatccgcaaggtttgcgggaggaccaactgattcaagtctactccacgtgtctttttcctattggatttaccttttattatttgagttggtgagtataataaagattgatcttctccaaaaaaattcgaaggtccctttcaatgttttttttttgtttgctttgctttgtgttgaagtgtgtatttccgcattaaaaatctaatgaaaattattccattt

SEQ ID NO: 1542 - protein, 1220 aa, Arabidopsis thaliana
  misc_feature: GI Number: 34905882; NR Description: P0458E05.17 [Oryza sativa (japonica cultivar-group)] >gi|21902069|dbj|BAC05617.1|
AAGTACAACAATCAACTCTAAGTCTATTATATTCAAGTCTTTGTTTTAACCTAACAATGGCTTCAAATAAACTTATTTCGATTCTAGTTCTCGTAGTTACACTTTTACTCCAAGGTGATAACAATTACGTCGTCGAAGCACAACTCACGACTAACTTCTACTCAACCTCTTGCCCCAACCTCCTCTCCACCGTCCAAACCGCCGTTAAATCTGCCGTTAACAGCGAGGCTCGAATGGGTGCATCTATCCTCCGTCTCTTCTTCCACGATTGCTTTGTCAACGGATGCGACGGTTCGATTCTACTAGACGATACGTCAAGCTTCACAGGAGAACAAAACGCGGCTCCAAACCGCAATTCAGCTCGTGGGTTTAATGTGATCGACAACATCAAATCAGCGGTTGAGAAAGCATGTCCCGGGGTTGTGTCTTGTGCTGATATCTTAGCCATTGCTGCTAGAGACTCCGTCGTAGCCCTTGGAGGACCGAACTGGAATGTGAAAGTAGGAAGAAGAGATGCAAGAACGGCGAGTCAAGCGGCAGCGAATAGTAACATTCCGGCACCGACTTCGAGTCTGAGCCAACTCATTAGTAGTTTCAGTGCTGTTGGACTCTCCACCAGAGATATGGTTGCTCTCTCTGGCGCACACACGATCGGACAATCCCGTTGCACGAACTTCCGAGCGAGAATCTACAACGAGACAAACATCAATGCCGCCTTCGCCACGACACGTCAACGAACTTGCCCTAGAGCCTCCGGTTCCGGCGACGGAAACCTAGCTCCACTAGACGTCACCACGGCAGCTTCTTTCGACAACAACTACTTCAAGAATCTCATGACTCAGAGAGGGCTCCTCCATTCCGACCAAGTGCTCTTCAACGGCGGCTCTACTGACTCCATCGTCCGTGGATACAGCAACAATCCGTCGAGCTTTAACTCTGACTTCACGGCGGCGATGATAAAAATGGGTGATATCAGCCCGTTGACTGGTAGTAGCGGTGAAATCCGCAAGGTTTGCGGGAGGACCAACTGATTCAAGTCTACTCCACGTGTCTTTTTCCTATTGGATTTACCTTTTATTATTTGAGTTGGTGAGTATAATAAAGATTGATCTTCTCCAAAAAAATTCGAAGGTCCCTTTCAATGTTTTTTTTTTGTTTGCTTTGCTTTGTGTTGAAGTGTGTATTTCCGCATTAAAAATCTAATGAAAATTATTCCATTT

SEQ ID NO: 1543 - DNA, 1188 bp, Arabidopsis thaliana
  misc_feature (1)..(1188): Ceres cDNA ID no. 12652534
  misc_feature (1)..(1188): Also known as  Ceres CDNA ID no. 23659454
atgggttggatcccgtgttctgggaaatcgagtgggaggaataagacaaggaggaacggtgaccacaaactcgacaggaagtcttctgattgttctgtgtctacttcagagaaatctagggccaagtcgtccttgagtgaatccaaaagtaaaggctctgatcacattgtggcacaaacgtttacattctctgagttagctactgccactagaaacttcagaaaagaatgtcttataggagaaggaggatttggtagagtttacaaaggatacttggccagcactagccagacagcggctatcaagcaacttgatcataatggtttacaaggaaacagggagttcctcgtcgaggttctcatgttgagtcttcttcatcacccgaatcttgttaacttaataggatattgtgctgatggagatcaaaggcttctagtctacgagtacatgcccctaggttcacttgaagatcatttgcacgacatttcacctggtaagcagccacttgactggaacaccagaatgaaaatagctgccggtgctgcaaaaggtttggagtatctgcatgacaaaaccatgcctccagtgatctatcgagatttgaaatgctcaaatattttgctcgatgatgattactttccaaagctatccgacttcgggttggctaaacttggcccagttggggacaagtctcatgtgtccactcgggttatgggaacatacggatactgtgctcccgagtatgcaatgacaggccagctaacactcaaatcagacgtttacagcttcggtgttgttctgttggagattataactggtcggaaagcaatagacagttcaagatctactggagaacagaatctagtcgcatgggcaaggcctttgtttaaagacaggaggaaattctctcagatggctgatccaatgcttcaaggtcaataccctccgcgagggttataccaagcactcgctgtagcagcgatgtgcgtacaagagcagccaaatcttagacctctcattgctgacgtcgtcactgcactttcttacctcgcctcccaaaagtttgatcctctggctcagccagtccaaggatcccttttcgctccagggactccacctagatcaaagagggaaaggtggatgattttcagactaagtgtgaatgtatggcttaagagctacttgtag

SEQ ID NO: 1544 - protein, 1188 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGGGTTGGATCCCGTGTTCTGGGAAATCGAGTGGGAGGAATAAGACAAGGAGGAACGGTGACCACAAACTCGACAGGAAGTCTTCTGATTGTTCTGTGTCTACTTCAGAGAAATCTAGGGCCAAGTCGTCCTTGAGTGAATCCAAAAGTAAAGGCTCTGATCACATTGTGGCACAAACGTTTACATTCTCTGAGTTAGCTACTGCCACTAGAAACTTCAGAAAAGAATGTCTTATAGGAGAAGGAGGATTTGGTAGAGTTTACAAAGGATACTTGGCCAGCACTAGCCAGACAGCGGCTATCAAGCAACTTGATCATAATGGTTTACAAGGAAACAGGGAGTTCCTCGTCGAGGTTCTCATGTTGAGTCTTCTTCATCACCCGAATCTTGTTAACTTAATAGGATATTGTGCTGATGGAGATCAAAGGCTTCTAGTCTACGAGTACATGCCCCTAGGTTCACTTGAAGATCATTTGCACGACATTTCACCTGGTAAGCAGCCACTTGACTGGAACACCAGAATGAAAATAGCTGCCGGTGCTGCAAAAGGTTTGGAGTATCTGCATGACAAAACCATGCCTCCAGTGATCTATCGAGATTTGAAATGCTCAAATATTTTGCTCGATGATGATTACTTTCCAAAGCTATCCGACTTCGGGTTGGCTAAACTTGGCCCAGTTGGGGACAAGTCTCATGTGTCCACTCGGGTTATGGGAACATACGGATACTGTGCTCCCGAGTATGCAATGACAGGCCAGCTAACACTCAAATCAGACGTTTACAGCTTCGGTGTTGTTCTGTTGGAGATTATAACTGGTCGGAAAGCAATAGACAGTTCAAGATCTACTGGAGAACAGAATCTAGTCGCATGGGCAAGGCCTTTGTTTAAAGACAGGAGGAAATTCTCTCAGATGGCTGATCCAATGCTTCAAGGTCAATACCCTCCGCGAGGGTTATACCAAGCACTCGCTGTAGCAGCGATGTGCGTACAAGAGCAGCCAAATCTTAGACCTCTCATTGCTGACGTCGTCACTGCACTTTCTTACCTCGCCTCCCAAAAGTTTGATCCTCTGGCTCAGCCAGTCCAAGGATCCCTTTTCGCTCCAGGGACTCCACCTAGATCAAAGAGGGAAAGGTGGATGATTTTCAGACTAAGTGTGAATGTATGGCTTAAGAGCTACTTGTAG

SEQ ID NO: 1545 - DNA, 1155 bp, Arabidopsis thaliana
  misc_feature (1)..(1155): Ceres cDNA ID no. 12652690
  misc_feature (1)..(1155): Also known as  Ceres CDNA ID no. 23659454
atgggttgtgtttcttcgaaactaggcaagaagaaactcataagagagattagagtcaacaatggcggcgatcacattgtctctcttacttcaactacttatggtcatctcgatctcgatgaacgagcagagacctctcctaagtcactggaagttactaaaggcgaagtctttgaatctgaaatcataccgagaagatctattaagagagatgatccggagattatcaatacttgggagcttatggaagatcttgaagattcaatgcacgtttctaatccacagaagattagtcccaaatctcgtggtattttcggtaaatcatggaagactccggtgaaatcggttgttgaatctccgaagagaggaagtagtaagagatttggagggaaagagaataattcgagaggtgtgagtccgaatcagattctgaagccgaagaacattcttgaaacaccgaagagaggtgtaatgcgtttgagttttcctcttaaatctgaagaatcttcggtgacggttacgcagaggaggaagagttatagtccaatgtttgatccagatcttgtggcttcttacgaaagagagttgtctcaagagaaagaacagatcaagatggtgatttctccggtggtgcacgagagcagaaaaacagagaaaacagagagaattcttgagaagttcccagagaaatgtccaccgggaggagagcactctgtggtgatctacataacaactcttagagggatacggaagacgtttgaggattgtaatgtggtaagatcgatattagattcacacgaagttcgattctcagagcgagatgtgtcgatgcactcggtttttaaggaagagatcaggggcattatgggaacgaaacatgtgaagatacctgcggtattcgttaaagggaggatggtaggaagtgttgaggaagtgatgaggttagaagaggagggcaaattgggaatattacttgaaggtattccggcggcgaggcttggaggcagttgctgccgtggatgtggaggaatgagatttatgatgtgtgttgtttgcaacggaagctgcaaggttagggaggaagagaagaagagtatggttaagtgtttgaagtgtaatgagaatggtttggttctatgtccaatttgttcttaa

SEQ ID NO: 1546 - protein, 1155 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGGGTTGTGTTTCTTCGAAACTAGGCAAGAAGAAACTCATAAGAGAGATTAGAGTCAACAATGGCGGCGATCACATTGTCTCTCTTACTTCAACTACTTATGGTCATCTCGATCTCGATGAACGAGCAGAGACCTCTCCTAAGTCACTGGAAGTTACTAAAGGCGAAGTCTTTGAATCTGAAATCATACCGAGAAGATCTATTAAGAGAGATGATCCGGAGATTATCAATACTTGGGAGCTTATGGAAGATCTTGAAGATTCAATGCACGTTTCTAATCCACAGAAGATTAGTCCCAAATCTCGTGGTATTTTCGGTAAATCATGGAAGACTCCGGTGAAATCGGTTGTTGAATCTCCGAAGAGAGGAAGTAGTAAGAGATTTGGAGGGAAAGAGAATAATTCGAGAGGTGTGAGTCCGAATCAGATTCTGAAGCCGAAGAACATTCTTGAAACACCGAAGAGAGGTGTAATGCGTTTGAGTTTTCCTCTTAAATCTGAAGAATCTTCGGTGACGGTTACGCAGAGGAGGAAGAGTTATAGTCCAATGTTTGATCCAGATCTTGTGGCTTCTTACGAAAGAGAGTTGTCTCAAGAGAAAGAACAGATCAAGATGGTGATTTCTCCGGTGGTGCACGAGAGCAGAAAAACAGAGAAAACAGAGAGAATTCTTGAGAAGTTCCCAGAGAAATGTCCACCGGGAGGAGAGCACTCTGTGGTGATCTACATAACAACTCTTAGAGGGATACGGAAGACGTTTGAGGATTGTAATGTGGTAAGATCGATATTAGATTCACACGAAGTTCGATTCTCAGAGCGAGATGTGTCGATGCACTCGGTTTTTAAGGAAGAGATCAGGGGCATTATGGGAACGAAACATGTGAAGATACCTGCGGTATTCGTTAAAGGGAGGATGGTAGGAAGTGTTGAGGAAGTGATGAGGTTAGAAGAGGAGGGCAAATTGGGAATATTACTTGAAGGTATTCCGGCGGCGAGGCTTGGAGGCAGTTGCTGCCGTGGATGTGGAGGAATGAGATTTATGATGTGTGTTGTTTGCAACGGAAGCTGCAAGGTTAGGGAGGAAGAGAAGAAGAGTATGGTTAAGTGTTTGAAGTGTAATGAGAATGGTTTGGTTCTATGTCCAATTTGTTCTTAA

SEQ ID NO: 1547 - DNA, 1566 bp, Arabidopsis thaliana
  misc_feature (1)..(1566): Ceres cDNA ID no. 12653174
  misc_feature (1)..(1566): Also known as  Ceres CDNA ID no. 23659454
atggggaattgcttagccaagaaatacggattggtgatgaaaccacaacaaaatggtgaaagatcagttgagatcgagaacagaagaaggagcacccaccaagatccgtctaaaatatccaccggaacgaatcaaccaccaccttggcggaatccagcgaaacacagtggtgctgcagctatactcgagaagccgtacgaagacgtgaaactgttctacactttgagcaaagaattgggtcgaggccagtttggagtaacgtatctgtgcacagagaagtcgacggggaagagattcgcttgcaagtcgatttccaagaagaaacttgtgacgaaaggtgataaagaagatatgaggagagagattcagattatgcagcatttgagtggacaacctaacattgttgagtttaaaggagcttatgaagatgagaaagctgtgaatttggttatggagctttgtgctggtggtgaattgttcgataggattttagcaaagggacattacagtgagagagcagctgcttctgtttgtagacagattgttaatgttgtcaatatttgtcatttcatgggtgtgatgcatagagacttaaagcctgagaatttcttgttatctagcaaagatgagaaggctcttatcaaagccactgatttcggattatcagtctttatcgaagaagggagagtgtataaagatatagttgggagtgcatattatgttgctcctgaagttttgaagcggagatatggtaaagaaatcgatatatggagtgctggaattatactatacattctacttagtggtgtgcctccgttttgggctgaaacggagaaagggatatttgatgctatattggaaggtgaaatcgactttgaatcccaaccttggccctcaatttccaatagtgctaaagatttggtacgtagaatgttgacacaagatccgaaaagacggatttctgctgctgaagttcttaagcatccatggctaagagaaggtggagaagcatcggataagcctattgatagtgctgttctctcaaggatgaagcaatttagagcgatgaataaactaaagaaacttgctttaaaggtcattgcggagaacattgacacggaagaaatacaaggcttaaaggcgatgtttgctaatatagatacagacaatagtggtactatcacatacgaagaattgaaagaaggattagccaaactgggatcaagactcactgaagctgaagtgaaacagctcatggatgctgctgacgttgatggaaatgggtcaatagattacattgagtttattactgcaacaatgcatagacataggcttgaaagtaatgagaacgtttacaaagccttccaacattttgacaaagatgggagtggatacattacgacagacgagctagaggctgctttgaaggaatatggaatgggagatgatgctactatcaaagagattttgtctgatgtcgacgctgataatgacggtagaatcaactatgacgagttttgtgctatgatgagaagtgggaatccacaacaaccaagattgttctaa

SEQ ID NO: 1548 - protein, 1566 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGGGGAATTGCTTAGCCAAGAAATACGGATTGGTGATGAAACCACAACAAAATGGTGAAAGATCAGTTGAGATCGAGAACAGAAGAAGGAGCACCCACCAAGATCCGTCTAAAATATCCACCGGAACGAATCAACCACCACCTTGGCGGAATCCAGCGAAACACAGTGGTGCTGCAGCTATACTCGAGAAGCCGTACGAAGACGTGAAACTGTTCTACACTTTGAGCAAAGAATTGGGTCGAGGCCAGTTTGGAGTAACGTATCTGTGCACAGAGAAGTCGACGGGGAAGAGATTCGCTTGCAAGTCGATTTCCAAGAAGAAACTTGTGACGAAAGGTGATAAAGAAGATATGAGGAGAGAGATTCAGATTATGCAGCATTTGAGTGGACAACCTAACATTGTTGAGTTTAAAGGAGCTTATGAAGATGAGAAAGCTGTGAATTTGGTTATGGAGCTTTGTGCTGGTGGTGAATTGTTCGATAGGATTTTAGCAAAGGGACATTACAGTGAGAGAGCAGCTGCTTCTGTTTGTAGACAGATTGTTAATGTTGTCAATATTTGTCATTTCATGGGTGTGATGCATAGAGACTTAAAGCCTGAGAATTTCTTGTTATCTAGCAAAGATGAGAAGGCTCTTATCAAAGCCACTGATTTCGGATTATCAGTCTTTATCGAAGAAGGGAGAGTGTATAAAGATATAGTTGGGAGTGCATATTATGTTGCTCCTGAAGTTTTGAAGCGGAGATATGGTAAAGAAATCGATATATGGAGTGCTGGAATTATACTATACATTCTACTTAGTGGTGTGCCTCCGTTTTGGGCTGAAACGGAGAAAGGGATATTTGATGCTATATTGGAAGGTGAAATCGACTTTGAATCCCAACCTTGGCCCTCAATTTCCAATAGTGCTAAAGATTTGGTACGTAGAATGTTGACACAAGATCCGAAAAGACGGATTTCTGCTGCTGAAGTTCTTAAGCATCCATGGCTAAGAGAAGGTGGAGAAGCATCGGATAAGCCTATTGATAGTGCTGTTCTCTCAAGGATGAAGCAATTTAGAGCGATGAATAAACTAAAGAAACTTGCTTTAAAGGTCATTGCGGAGAACATTGACACGGAAGAAATACAAGGCTTAAAGGCGATGTTTGCTAATATAGATACAGACAATAGTGGTACTATCACATACGAAGAATTGAAAGAAGGATTAGCCAAACTGGGATCAAGACTCACTGAAGCTGAAGTGAAACAGCTCATGGATGCTGCTGACGTTGATGGAAATGGGTCAATAGATTACATTGAGTTTATTACTGCAACAATGCATAGACATAGGCTTGAAAGTAATGAGAACGTTTACAAAGCCTTCCAACATTTTGACAAAGATGGGAGTGGATACATTACGACAGACGAGCTAGAGGCTGCTTTGAAGGAATATGGAATGGGAGATGATGCTACTATCAAAGAGATTTTGTCTGATGTCGACGCTGATAATGACGGTAGAATCAACTATGACGAGTTTTGTGCTATGATGAGAAGTGGGAATCCACAACAACCAAGATTGTTCTAA

SEQ ID NO: 1549 - DNA, 720 bp, Arabidopsis thaliana
  misc_feature (1)..(720): Ceres cDNA ID no. 12653495
  misc_feature (1)..(720): Also known as  Ceres CDNA ID no. 23659454
atgaagggaatgaaggaaagattggtgaagaaaatcaaactcatcaccactgtcaagacgttgaagcaaagcttaactcttcataagagtaccattgatcgcacaatccatcatctaagagacgaaatagtcgctgaatctggtcaaagcaaaggttgtgttacaccaacactactagagcttgaggatgcagaggaacataatcttgaagaagaaagagggattcttctggagtttaaagagaattgcccacccggaggagaagattcggttgtattctacacgacgggcctgcgaagtgtgaggaaaacatttgaagcttgcagaagagtgagattcttgttggagaatcaccaggtgatgtatagagagagagacgtttccatggattcagagtttagagaagagatgtggaggttgcttggtgggaaagttacctctccgaggctgttcattagaggtaggtacattggtggagcagaagaagttgtggcattgaacgagaacgggaagctgaagaagctactacaaggaatctcacaggttgattcaccttgcgagtcttgcgagaacgaaaggtttttgatatgttctagctgcaatggaagcacaagattgcttgcagagcatcacgatgaagagagtagtaatgataatatgtggacaagatgcagagaatgtaatgagaatggacttgtgaaatgtcctctttgtacgtag

SEQ ID NO: 1550 - protein, 720 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGAAGGGAATGAAGGAAAGATTGGTGAAGAAAATCAAACTCATCACCACTGTCAAGACGTTGAAGCAAAGCTTAACTCTTCATAAGAGTACCATTGATCGCACAATCCATCATCTAAGAGACGAAATAGTCGCTGAATCTGGTCAAAGCAAAGGTTGTGTTACACCAACACTACTAGAGCTTGAGGATGCAGAGGAACATAATCTTGAAGAAGAAAGAGGGATTCTTCTGGAGTTTAAAGAGAATTGCCCACCCGGAGGAGAAGATTCGGTTGTATTCTACACGACGGGCCTGCGAAGTGTGAGGAAAACATTTGAAGCTTGCAGAAGAGTGAGATTCTTGTTGGAGAATCACCAGGTGATGTATAGAGAGAGAGACGTTTCCATGGATTCAGAGTTTAGAGAAGAGATGTGGAGGTTGCTTGGTGGGAAAGTTACCTCTCCGAGGCTGTTCATTAGAGGTAGGTACATTGGTGGAGCAGAAGAAGTTGTGGCATTGAACGAGAACGGGAAGCTGAAGAAGCTACTACAAGGAATCTCACAGGTTGATTCACCTTGCGAGTCTTGCGAGAACGAAAGGTTTTTGATATGTTCTAGCTGCAATGGAAGCACAAGATTGCTTGCAGAGCATCACGATGAAGAGAGTAGTAATGATAATATGTGGACAAGATGCAGAGAATGTAATGAGAATGGACTTGTGAAATGTCCTCTTTGTACGTAG

SEQ ID NO: 1551 - DNA, 3426 bp, Arabidopsis thaliana
  misc_feature (1)..(3426): Ceres cDNA ID no. 12653553
  misc_feature (1)..(3426): Also known as  Ceres CDNA ID no. 23659454
atgaaacttcggcaaaaccctagtagattcacgtctgttctcaaatgggtatcacaactttctctagaaacccaattaaaaccctcaatttctggaactgggtttctcctccgatgtgcccaaacccctagatctttcgccaccgtcaccggtaacgaagtttgcagtgagaaatcgaaagtgaagagaacccgaaatgggtttaaaatcactcccaatgttaggaaattagctgaggaagcaatgttggattatttctattccactaggggtttacagtatatggttgcagagagtatgagcaagaacagtccaatttttattgataatcttttgaagaaagttgattgtgttactgcttctgatatcaaccaatctattactcgatatctacggtttcaccctgtcaatgaattcgagcctttccttgagagttcaggtttgaatcccagtgagtataatcatttggttccctgtgataaggtcttcttggatgaagaaggctttttgctggagaaccatcatgttttgtgttatagtggtgttgaccctaagaggattgggaagatcttcaaggaagctagggaagtttttagttatgaaaccggggttttagcttctaagattaaggcgtatgaggatttggggtttagcagattgtttctatctaagcttatcgtttgtagtccgagagtcttgatgggtcatacgaatattgaactggttcaggttgtaaagacgttgcaatctttagggtttgagttcgagtgggtaatggaaaacttgtcagatgagggacctgattggagctctgtgcatcgtgttttaagcttgcttagagaaatctgttttgatgaggaaaaactatatgggttaatcaggaactgtccaagtttgctttttgagaattcagggaaatggacagggattctagttgggtttgaaacaaagcttggggcatctagaagtgaactatgttcgttgtttcagaaattcccgctgattcaagtagagaaatgtgtttcgaatctaaggcagtgcttcttgttcttgaaagagatcgagatggaagatgatgagattcataaggttttccgttctcattcctggtggcttggttcatgtaagttaaagaaaaccagtagcttgcttgtgtttttgaaggctggtaaaactcgggtttgtcaggtcattcaagaaaaccctgaagagatgaaaaaatggacaatgggttcaaaaatccagccgttaccagctaccaacgtagacattgagtcgaaatcaatgaagactcagttcttattagacctcggatacaaagaaaactcagaggaaatggagacagcaatgaagaatttccgtggtaaaggatcagaactccgagagagatttaatgtcctcgtaagtttgggttttaccaagaaagatgtcaaagatatggtgaaagcatgtcctactatgctctcccagacctgtgatatcctagaatcaaaggtgaactaccttataaaggaattaggttatccgctttcgactttggtggatttcccttcatgtttaaagttcactcttcagcggatgaagctcagatttgcaatgttctcttggcttcaagcccgaggaaaagtagaccgcaagatcaaagttagcacaatgctcgcttgctcggacaaaatattcgtaatgtcttttatgcgaaaccctagattcaaaagtcttcttctcaattgggtatcacaagcttttgcagaaacccctttaaaaccccaactttctagaaaccctagatttttcgccacccaaagagcactcgtcgatgctgaagtttccggcgagaaatggggtcttagaactcgaaacgagattcgtaaagtggctcaagttgcgatgtttgattacttttatcaaacgagaggtttgcagtttctggttgctgagagtatgagtaagaatgctcctgtttttaatgataatcttttgaagaagcttaatggttgtgatgttgatgttgatgatgatgatgatatagttaaagctattactaggtttctatggtttcatcctgttaatgaatttgagccctttttagagagtttaggtttgaagccgtcagagtttagtcatttgattccttgtgataagatgtttttgaatgaagatgcttttttgctggagaactatcatgtcttttggaactatggaattggaagggagaagatggggaagatctttaaggaagctagggaagttttcgggtatgaaaccggggttttagcttccaagattaagtcttatgaggatttggggtttagcaaattgtttctatcgaaacttatagtttgtagcccaagtatcttgattggggatatgaatgttggactggctaaggtcatggagatgctgaaagctattggttttggtgttgattgggtaacagagaacttgtcagaggaggtgtcttatgattggagctctatgcatagatgtctaagttttcttagagatttgtatgttgatgaaaatgagctatgtgagttaatcagaaagatgccaagacttattttcgaggattcaggggaatggacattgattctagctgggtttgaagcaaaactagggtcatccagaagtgaactctcttcgttgtttcagaaattccctcagtgtcagagtttaggtaaatttgttttgaatttaaggcattgcttcttgtttctgaaagatattgagatggatgatgacgagatcggtaagattttccgtttgcactctttgtggattggtgtatctcgtttgaagcaaaccagtaccttacttatcaatttgaagggtgggaaagggcggctatgtcaagtcattcaagaaaatccagaagagatgaaaaaatggattatggggttaagagtccagccattaccagctactggatacaaggtaaacacaaagtcgaaaacaatgaagactcagttcttgttagacctcggatacaaagaaaactctgaggaaatggagagagcactcaagaatttccgtggcaaaggatctgaactccgagagagatttaatgtcctcgtgagtttcggtcttactgagaaagatgtcaaagatatggtgaaagcatgtcctagtatcctcacccaggcatgtgatatcttagaatcaaaggtgaactaccttgtaaaggaattaggttatccgctttcgacattggtgactttcccaacatgtcttaagtacactcttcagcggatgaagcttcgattttcaatgttctcttggcttcaagatcgaggaaaagcagacccaaagcttcaagttagtactatacttgtgtgctcggacaagttctttgccactagatttgtaaaccgtcaccccgatgggcctaagcatttggaagacctgaagaaactacttgtgtgttag

SEQ ID NO: 1552 - protein, 3426 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGAAACTTCGGCAAAACCCTAGTAGATTCACGTCTGTTCTCAAATGGGTATCACAACTTTCTCTAGAAACCCAATTAAAACCCTCAATTTCTGGAACTGGGTTTCTCCTCCGATGTGCCCAAACCCCTAGATCTTTCGCCACCGTCACCGGTAACGAAGTTTGCAGTGAGAAATCGAAAGTGAAGAGAACCCGAAATGGGTTTAAAATCACTCCCAATGTTAGGAAATTAGCTGAGGAAGCAATGTTGGATTATTTCTATTCCACTAGGGGTTTACAGTATATGGTTGCAGAGAGTATGAGCAAGAACAGTCCAATTTTTATTGATAATCTTTTGAAGAAAGTTGATTGTGTTACTGCTTCTGATATCAACCAATCTATTACTCGATATCTACGGTTTCACCCTGTCAATGAATTCGAGCCTTTCCTTGAGAGTTCAGGTTTGAATCCCAGTGAGTATAATCATTTGGTTCCCTGTGATAAGGTCTTCTTGGATGAAGAAGGCTTTTTGCTGGAGAACCATCATGTTTTGTGTTATAGTGGTGTTGACCCTAAGAGGATTGGGAAGATCTTCAAGGAAGCTAGGGAAGTTTTTAGTTATGAAACCGGGGTTTTAGCTTCTAAGATTAAGGCGTATGAGGATTTGGGGTTTAGCAGATTGTTTCTATCTAAGCTTATCGTTTGTAGTCCGAGAGTCTTGATGGGTCATACGAATATTGAACTGGTTCAGGTTGTAAAGACGTTGCAATCTTTAGGGTTTGAGTTCGAGTGGGTAATGGAAAACTTGTCAGATGAGGGACCTGATTGGAGCTCTGTGCATCGTGTTTTAAGCTTGCTTAGAGAAATCTGTTTTGATGAGGAAAAACTATATGGGTTAATCAGGAACTGTCCAAGTTTGCTTTTTGAGAATTCAGGGAAATGGACAGGGATTCTAGTTGGGTTTGAAACAAAGCTTGGGGCATCTAGAAGTGAACTATGTTCGTTGTTTCAGAAATTCCCGCTGATTCAAGTAGAGAAATGTGTTTCGAATCTAAGGCAGTGCTTCTTGTTCTTGAAAGAGATCGAGATGGAAGATGATGAGATTCATAAGGTTTTCCGTTCTCATTCCTGGTGGCTTGGTTCATGTAAGTTAAAGAAAACCAGTAGCTTGCTTGTGTTTTTGAAGGCTGGTAAAACTCGGGTTTGTCAGGTCATTCAAGAAAACCCTGAAGAGATGAAAAAATGGACAATGGGTTCAAAAATCCAGCCGTTACCAGCTACCAACGTAGACATTGAGTCGAAATCAATGAAGACTCAGTTCTTATTAGACCTCGGATACAAAGAAAACTCAGAGGAAATGGAGACAGCAATGAAGAATTTCCGTGGTAAAGGATCAGAACTCCGAGAGAGATTTAATGTCCTCGTAAGTTTGGGTTTTACCAAGAAAGATGTCAAAGATATGGTGAAAGCATGTCCTACTATGCTCTCCCAGACCTGTGATATCCTAGAATCAAAGGTGAACTACCTTATAAAGGAATTAGGTTATCCGCTTTCGACTTTGGTGGATTTCCCTTCATGTTTAAAGTTCACTCTTCAGCGGATGAAGCTCAGATTTGCAATGTTCTCTTGGCTTCAAGCCCGAGGAAAAGTAGACCGCAAGATCAAAGTTAGCACAATGCTCGCTTGCTCGGACAAAATATTCGTAATGTCTTTTATGCGAAACCCTAGATTCAAAAGTCTTCTTCTCAATTGGGTATCACAAGCTTTTGCAGAAACCCCTTTAAAACCCCAACTTTCTAGAAACCCTAGATTTTTCGCCACCCAAAGAGCACTCGTCGATGCTGAAGTTTCCGGCGAGAAATGGGGTCTTAGAACTCGAAACGAGATTCGTAAAGTGGCTCAAGTTGCGATGTTTGATTACTTTTATCAAACGAGAGGTTTGCAGTTTCTGGTTGCTGAGAGTATGAGTAAGAATGCTCCTGTTTTTAATGATAATCTTTTGAAGAAGCTTAATGGTTGTGATGTTGATGTTGATGATGATGATGATATAGTTAAAGCTATTACTAGGTTTCTATGGTTTCATCCTGTTAATGAATTTGAGCCCTTTTTAGAGAGTTTAGGTTTGAAGCCGTCAGAGTTTAGTCATTTGATTCCTTGTGATAAGATGTTTTTGAATGAAGATGCTTTTTTGCTGGAGAACTATCATGTCTTTTGGAACTATGGAATTGGAAGGGAGAAGATGGGGAAGATCTTTAAGGAAGCTAGGGAAGTTTTCGGGTATGAAACCGGGGTTTTAGCTTCCAAGATTAAGTCTTATGAGGATTTGGGGTTTAGCAAATTGTTTCTATCGAAACTTATAGTTTGTAGCCCAAGTATCTTGATTGGGGATATGAATGTTGGACTGGCTAAGGTCATGGAGATGCTGAAAGCTATTGGTTTTGGTGTTGATTGGGTAACAGAGAACTTGTCAGAGGAGGTGTCTTATGATTGGAGCTCTATGCATAGATGTCTAAGTTTTCTTAGAGATTTGTATGTTGATGAAAATGAGCTATGTGAGTTAATCAGAAAGATGCCAAGACTTATTTTCGAGGATTCAGGGGAATGGACATTGATTCTAGCTGGGTTTGAAGCAAAACTAGGGTCATCCAGAAGTGAACTCTCTTCGTTGTTTCAGAAATTCCCTCAGTGTCAGAGTTTAGGTAAATTTGTTTTGAATTTAAGGCATTGCTTCTTGTTTCTGAAAGATATTGAGATGGATGATGACGAGATCGGTAAGATTTTCCGTTTGCACTCTTTGTGGATTGGTGTATCTCGTTTGAAGCAAACCAGTACCTTACTTATCAATTTGAAGGGTGGGAAAGGGCGGCTATGTCAAGTCATTCAAGAAAATCCAGAAGAGATGAAAAAATGGATTATGGGGTTAAGAGTCCAGCCATTACCAGCTACTGGATACAAGGTAAACACAAAGTCGAAAACAATGAAGACTCAGTTCTTGTTAGACCTCGGATACAAAGAAAACTCTGAGGAAATGGAGAGAGCACTCAAGAATTTCCGTGGCAAAGGATCTGAACTCCGAGAGAGATTTAATGTCCTCGTGAGTTTCGGTCTTACTGAGAAAGATGTCAAAGATATGGTGAAAGCATGTCCTAGTATCCTCACCCAGGCATGTGATATCTTAGAATCAAAGGTGAACTACCTTGTAAAGGAATTAGGTTATCCGCTTTCGACATTGGTGACTTTCCCAACATGTCTTAAGTACACTCTTCAGCGGATGAAGCTTCGATTTTCAATGTTCTCTTGGCTTCAAGATCGAGGAAAAGCAGACCCAAAGCTTCAAGTTAGTACTATACTTGTGTGCTCGGACAAGTTCTTTGCCACTAGATTTGTAAACCGTCACCCCGATGGGCCTAAGCATTTGGAAGACCTGAAGAAACTACTTGTGTGTTAG

SEQ ID NO: 1553 - DNA, 1023 bp, Arabidopsis thaliana
  misc_feature (1)..(1023): Ceres cDNA ID no. 12653672
  misc_feature (1)..(1023): Also known as  Ceres CDNA ID no. 23659454
atgcagtttgtgaattttttcccactattggccctcgtagtcataagcttagccggaaaggctacggtagaggctgcgacgggattgaaccctccggtgaagcttgtctggcattattacaaacttactaacacttgtgatgatgcagagacttatattagataccaagttgaaaagttttataagaatgatagtagcattgccccaaagctgcttcgtctcctctactccgattgtatggttaatggatgtgatggttcgattcttttgcaaggaccaaactcagagaggacagctccacagaatcgagggcttggaggttttgtgataatcgataaaataaagcaagttcttgaatcacgttgtcctggtgtcgtttcttgcgctgatatcctcaaccttgccactagagatgctgttcacatggccggagcaccgtcttatcctgtgtttacggggagaagggacggtgggacattaaatgcagacgccgtagatctgccgtcaccgtccatctcagtcgatgagtcattggcatatttcaagtccaaaggtcttgacgttttggatatgactactcttctaggagcacactcaatggggaagacacattgtagctacgtagtggacagactatacaacttcaagaacacagggaaaccagatccgaccatgaacacgacattggtgtcacaacttcgatatctttgtcctccaagaacacaaaagggccaaaccgatccactggtttacctaaatccagactcaggctcgagcaacagattcacaagctcatactactctcgtgtcttgtctcataacgctgttttacgggtggaccaagagttgctcaacaacgatgactcgaaggagatcacgcaagagtttgcttccggttttgaagatttcagaaagtcttttgctttggcaatgtcgagaatgggatctatcaatgttttgacgggaacagctggagagattcgtcgagactgcagagttaccaacgctaatgacggggcctaa

SEQ ID NO: 1554 - protein, 1023 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGCAGTTTGTGAATTTTTTCCCACTATTGGCCCTCGTAGTCATAAGCTTAGCCGGAAAGGCTACGGTAGAGGCTGCGACGGGATTGAACCCTCCGGTGAAGCTTGTCTGGCATTATTACAAACTTACTAACACTTGTGATGATGCAGAGACTTATATTAGATACCAAGTTGAAAAGTTTTATAAGAATGATAGTAGCATTGCCCCAAAGCTGCTTCGTCTCCTCTACTCCGATTGTATGGTTAATGGATGTGATGGTTCGATTCTTTTGCAAGGACCAAACTCAGAGAGGACAGCTCCACAGAATCGAGGGCTTGGAGGTTTTGTGATAATCGATAAAATAAAGCAAGTTCTTGAATCACGTTGTCCTGGTGTCGTTTCTTGCGCTGATATCCTCAACCTTGCCACTAGAGATGCTGTTCACATGGCCGGAGCACCGTCTTATCCTGTGTTTACGGGGAGAAGGGACGGTGGGACATTAAATGCAGACGCCGTAGATCTGCCGTCACCGTCCATCTCAGTCGATGAGTCATTGGCATATTTCAAGTCCAAAGGTCTTGACGTTTTGGATATGACTACTCTTCTAGGAGCACACTCAATGGGGAAGACACATTGTAGCTACGTAGTGGACAGACTATACAACTTCAAGAACACAGGGAAACCAGATCCGACCATGAACACGACATTGGTGTCACAACTTCGATATCTTTGTCCTCCAAGAACACAAAAGGGCCAAACCGATCCACTGGTTTACCTAAATCCAGACTCAGGCTCGAGCAACAGATTCACAAGCTCATACTACTCTCGTGTCTTGTCTCATAACGCTGTTTTACGGGTGGACCAAGAGTTGCTCAACAACGATGACTCGAAGGAGATCACGCAAGAGTTTGCTTCCGGTTTTGAAGATTTCAGAAAGTCTTTTGCTTTGGCAATGTCGAGAATGGGATCTATCAATGTTTTGACGGGAACAGCTGGAGAGATTCGTCGAGACTGCAGAGTTACCAACGCTAATGACGGGGCCTAA

SEQ ID NO: 1555 - DNA, 1605 bp, Arabidopsis thaliana
  misc_feature (1)..(1605): Ceres cDNA ID no. 12653740
  misc_feature (1)..(1605): Also known as  Ceres CDNA ID no. 23659454
atggcaattaagctcattgcactagtaatcacactatgtgtagcatcatgggatgttgcacagggcagatctttaagattttctacaactcctctaaatcgttatagcttccctcctcattttgattttggtgttgcctcttccgcttatcagtatgaaggtgcagtagaagaaggagggaggagtctaagcatatgggacaatttcacacatgcatttccagaaaggacgaacatggacaatggagatgttgccgttgatttttaccatcgttataaggaagacatcaaactaataaaggaaatgaatatggatagtttcagattttccctgtcctggtcaagaatattaccaagtggaaaactaagtgatggggtcaataaagaaggtgttcaattctacaagaatcttattgatgaacttatcgagaacggtatcaaaccttttgtaacaatttatcactgggatatccctcaagctcttgatgatgagtatggtagctttttaagtcctcgaatcatagatgattttcgaaactatgccagattttgtttccaagagtttggggacaaggtcagtatgtggacaactttcaacgagccatatgtttatagcgtttcgggttatgatgcgggtaataaggcaatgggtcgatgttctaaatgggtaaacagtttatgtatcgccggtgactcgggcacggagccttatttagtctcccaccaccttcttctcgctcacgctgctgctgttgaagagttcaggaaatgtgacaagatttcgcaagattccaagataggcatagtgttgtctccttattggttcgagccatatgacagtgcttctaatgctgataaagaagcagttgaaagggctcttgctttcaatattggttggcatctcagccctctagttttcggagactatccagagacgataaagataagcgctggaaatagactgccatcttttaccaaagagcaatctatgatggttaaaaattcgtttgattttatcggtgtaaattactacactgcacggtttgttgctcacgatcttaacgtcgatatttcacggcctcgcttcatgaccgaccaacacctccaatacaaattgacaaatcgtaccggcgacaccatctcattggaatcggatggtaccaaaattctctggtcatatccggaagggttacgaaagattcttaattatatcaaaaataagtacaacaatccaactatctacataactgaaaacggtttcgatgactacgaaaatggaacggtgacacgtgaagagatactagaagacacaaagagaatagagtaccaccaaaaacatcttcaagaactccagaaagcgatcactgaggatgggtgtgacgtgaaaggctacttcacatggtcgttattggataattttgaatgggaacatggatatgcagtgagatttggtttgtactacgttgactataaaaatggtcttcaacgacatgctaaacattcagctatgtggttcaaacattttcttgagagatccggaaagccaatgccgatggatctgtttaagagtgtcaagagatggtggtctacattacagatgatttaa

SEQ ID NO: 1556 - protein, 1605 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGGCAATTAAGCTCATTGCACTAGTAATCACACTATGTGTAGCATCATGGGATGTTGCACAGGGCAGATCTTTAAGATTTTCTACAACTCCTCTAAATCGTTATAGCTTCCCTCCTCATTTTGATTTTGGTGTTGCCTCTTCCGCTTATCAGTATGAAGGTGCAGTAGAAGAAGGAGGGAGGAGTCTAAGCATATGGGACAATTTCACACATGCATTTCCAGAAAGGACGAACATGGACAATGGAGATGTTGCCGTTGATTTTTACCATCGTTATAAGGAAGACATCAAACTAATAAAGGAAATGAATATGGATAGTTTCAGATTTTCCCTGTCCTGGTCAAGAATATTACCAAGTGGAAAACTAAGTGATGGGGTCAATAAAGAAGGTGTTCAATTCTACAAGAATCTTATTGATGAACTTATCGAGAACGGTATCAAACCTTTTGTAACAATTTATCACTGGGATATCCCTCAAGCTCTTGATGATGAGTATGGTAGCTTTTTAAGTCCTCGAATCATAGATGATTTTCGAAACTATGCCAGATTTTGTTTCCAAGAGTTTGGGGACAAGGTCAGTATGTGGACAACTTTCAACGAGCCATATGTTTATAGCGTTTCGGGTTATGATGCGGGTAATAAGGCAATGGGTCGATGTTCTAAATGGGTAAACAGTTTATGTATCGCCGGTGACTCGGGCACGGAGCCTTATTTAGTCTCCCACCACCTTCTTCTCGCTCACGCTGCTGCTGTTGAAGAGTTCAGGAAATGTGACAAGATTTCGCAAGATTCCAAGATAGGCATAGTGTTGTCTCCTTATTGGTTCGAGCCATATGACAGTGCTTCTAATGCTGATAAAGAAGCAGTTGAAAGGGCTCTTGCTTTCAATATTGGTTGGCATCTCAGCCCTCTAGTTTTCGGAGACTATCCAGAGACGATAAAGATAAGCGCTGGAAATAGACTGCCATCTTTTACCAAAGAGCAATCTATGATGGTTAAAAATTCGTTTGATTTTATCGGTGTAAATTACTACACTGCACGGTTTGTTGCTCACGATCTTAACGTCGATATTTCACGGCCTCGCTTCATGACCGACCAACACCTCCAATACAAATTGACAAATCGTACCGGCGACACCATCTCATTGGAATCGGATGGTACCAAAATTCTCTGGTCATATCCGGAAGGGTTACGAAAGATTCTTAATTATATCAAAAATAAGTACAACAATCCAACTATCTACATAACTGAAAACGGTTTCGATGACTACGAAAATGGAACGGTGACACGTGAAGAGATACTAGAAGACACAAAGAGAATAGAGTACCACCAAAAACATCTTCAAGAACTCCAGAAAGCGATCACTGAGGATGGGTGTGACGTGAAAGGCTACTTCACATGGTCGTTATTGGATAATTTTGAATGGGAACATGGATATGCAGTGAGATTTGGTTTGTACTACGTTGACTATAAAAATGGTCTTCAACGACATGCTAAACATTCAGCTATGTGGTTCAAACATTTTCTTGAGAGATCCGGAAAGCCAATGCCGATGGATCTGTTTAAGAGTGTCAAGAGATGGTGGTCTACATTACAGATGATTTAA

SEQ ID NO: 1557 - DNA, 866 bp, Arabidopsis thaliana
  misc_feature (1)..(866): Ceres cDNA ID no. 12653958
  misc_feature (1)..(866): Also known as  Ceres CDNA ID no. 23659454
ggaagcagagatcgaaacgaagactcaaagaagaatggcgatttctactttaacactcacacaatctctctatacacgttccttcagaccaaccatcttcttttcttcttcttcttcctcgtccttttcgtgtctctgttcttcttcctccgattgcgagccgaaactctccgtcaagaaacgcgttttcggagtgggtttagggttcctagcttcttcgattctctctctaacgcctctggacgcagacgccacgaggattgactactacgccactgtaggagatcctctctgcgaatacagctacgcaaaatcaggacttggattttgcgatctcgatgttggatttggtgatgaagcccctcgtggcgtactcgtcaatatccattacacggcgaggtttgcagatggaacgttgtttgacagtagctataagcgtgcaagaccacttactatgcgaattggagtcggcaaggtaattaggggactagaccaggggattcttggaggcgaaggagtacctcctatgcgagtaggcggaaagcgtaaacttcagattccacctaagttagcttatggaccagagcctgcaggatgcttttctggtgactgcaacatacctggcaatgcaactttgctctatgatatcaactttgttgagatctacccaggaagtaatacaagatgaagccaactccaatcccgtttggtaaaggaacaaacaactatgtatgtgatgtatatcaccaggtgattacttttgacaagcttcagattataatttctgtaacctaaaacattgatgatttccaactgaatccaatgtctaacctcctattaaagaacaagacacatcttctctgtgc

SEQ ID NO: 1558 - protein, 866 aa, Arabidopsis thaliana
  misc_feature: GI Number: 34905882; NR Description: P0458E05.17 [Oryza sativa (japonica cultivar-group)] >gi|21902069|dbj|BAC05617.1|
GGAAGCAGAGATCGAAACGAAGACTCAAAGAAGAATGGCGATTTCTACTTTAACACTCACACAATCTCTCTATACACGTTCCTTCAGACCAACCATCTTCTTTTCTTCTTCTTCTTCCTCGTCCTTTTCGTGTCTCTGTTCTTCTTCCTCCGATTGCGAGCCGAAACTCTCCGTCAAGAAACGCGTTTTCGGAGTGGGTTTAGGGTTCCTAGCTTCTTCGATTCTCTCTCTAACGCCTCTGGACGCAGACGCCACGAGGATTGACTACTACGCCACTGTAGGAGATCCTCTCTGCGAATACAGCTACGCAAAATCAGGACTTGGATTTTGCGATCTCGATGTTGGATTTGGTGATGAAGCCCCTCGTGGCGTACTCGTCAATATCCATTACACGGCGAGGTTTGCAGATGGAACGTTGTTTGACAGTAGCTATAAGCGTGCAAGACCACTTACTATGCGAATTGGAGTCGGCAAGGTAATTAGGGGACTAGACCAGGGGATTCTTGGAGGCGAAGGAGTACCTCCTATGCGAGTAGGCGGAAAGCGTAAACTTCAGATTCCACCTAAGTTAGCTTATGGACCAGAGCCTGCAGGATGCTTTTCTGGTGACTGCAACATACCTGGCAATGCAACTTTGCTCTATGATATCAACTTTGTTGAGATCTACCCAGGAAGTAATACAAGATGAAGCCAACTCCAATCCCGTTTGGTAAAGGAACAAACAACTATGTATGTGATGTATATCACCAGGTGATTACTTTTGACAAGCTTCAGATTATAATTTCTGTAACCTAAAACATTGATGATTTCCAACTGAATCCAATGTCTAACCTCCTATTAAAGAACAAGACACATCTTCTCTGTGC

SEQ ID NO: 1559 - DNA, 1029 bp, Arabidopsis thaliana
  misc_feature (1)..(1029): Ceres cDNA ID no. 12654145
  misc_feature (1)..(1029): Also known as  Ceres CDNA ID no. 23659454
atgcacgcggctccaatgtacattgcagagactgctccaagtcaaatacgtggacggatgatatcactaaaggaattctccactgtccttgggatggttgggggttatggaatcggtagcctttggattacggttatttctggttggcgttacatgtacgcaacaattctcccttttccagttattatgggaactggaatgtgttggctaccagcatctccgaggtggcttttactgcgcgctctccagggacaaggaaatggggagaatcttcaacaggctgcgattagatctctttgtcgccttagagggtctgtcatagctgactcagcagctgaacaagtaaacgaaatattggctgaactttcccttgtgggtgaagacaaagaagctacatttggtgaattatttcgaggcaaatgcttgaaagctctcactatagcaggagggttagtcttgttccaacagataactgggcaaccaagtgtactatattatgcaccatcaatactacagactgccggcttttctgctgcagctgatgcaactcggatctcaattctgctcggcctattgaagttggttatgacaggagtttctgtgatagttatcgacagagttggaaggagacctttacttctttgtggtgttagcggaatggtgatctcattgttcctcctgggatcctactacatgttttataaaaatgtaccagctgttgctgtagctgcattgctactgtatgtaggctgttaccagctgtcctttggccctattggttggctgatgatttcagagatatttcccttaaaattaagaggtagaggaatcagtctagcagtgcttgtgaattttggcgcaaacgcacttgtgacattcgctttctcaccgctaaaggagctgttaggagctggaatactgttctgtgcatttggagtgatatgtgtcgtgtctctcttcttcatatactacattgtgccagagacaaagggtctcactcttgaagaaattgaagccaaatgtctctaa

SEQ ID NO: 1560 - protein, 1029 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGCACGCGGCTCCAATGTACATTGCAGAGACTGCTCCAAGTCAAATACGTGGACGGATGATATCACTAAAGGAATTCTCCACTGTCCTTGGGATGGTTGGGGGTTATGGAATCGGTAGCCTTTGGATTACGGTTATTTCTGGTTGGCGTTACATGTACGCAACAATTCTCCCTTTTCCAGTTATTATGGGAACTGGAATGTGTTGGCTACCAGCATCTCCGAGGTGGCTTTTACTGCGCGCTCTCCAGGGACAAGGAAATGGGGAGAATCTTCAACAGGCTGCGATTAGATCTCTTTGTCGCCTTAGAGGGTCTGTCATAGCTGACTCAGCAGCTGAACAAGTAAACGAAATATTGGCTGAACTTTCCCTTGTGGGTGAAGACAAAGAAGCTACATTTGGTGAATTATTTCGAGGCAAATGCTTGAAAGCTCTCACTATAGCAGGAGGGTTAGTCTTGTTCCAACAGATAACTGGGCAACCAAGTGTACTATATTATGCACCATCAATACTACAGACTGCCGGCTTTTCTGCTGCAGCTGATGCAACTCGGATCTCAATTCTGCTCGGCCTATTGAAGTTGGTTATGACAGGAGTTTCTGTGATAGTTATCGACAGAGTTGGAAGGAGACCTTTACTTCTTTGTGGTGTTAGCGGAATGGTGATCTCATTGTTCCTCCTGGGATCCTACTACATGTTTTATAAAAATGTACCAGCTGTTGCTGTAGCTGCATTGCTACTGTATGTAGGCTGTTACCAGCTGTCCTTTGGCCCTATTGGTTGGCTGATGATTTCAGAGATATTTCCCTTAAAATTAAGAGGTAGAGGAATCAGTCTAGCAGTGCTTGTGAATTTTGGCGCAAACGCACTTGTGACATTCGCTTTCTCACCGCTAAAGGAGCTGTTAGGAGCTGGAATACTGTTCTGTGCATTTGGAGTGATATGTGTCGTGTCTCTCTTCTTCATATACTACATTGTGCCAGAGACAAAGGGTCTCACTCTTGAAGAAATTGAAGCCAAATGTCTCTAA

SEQ ID NO: 1561 - DNA, 2309 bp, Arabidopsis thaliana
  misc_feature (1)..(2309): Ceres cDNA ID no. 12654405
  misc_feature (1)..(2309): Also known as  Ceres CDNA ID no. 23659454
ctcttatccctctcaccttctcacttggcaccgttgcagagagagaaccaaacatggtaaacaaagacgaccggattagaccggttcatgaagccgacggtgaaccgctttttgagactaggagaagaaccggtagagtgattgcgtaccggtttttctcagcctcggttttcgtgtgtatctgtttgatttggttctacagaattggtgagattggtgataaccgtaccgttttagatcgattaatctggtttgttatgtttattgtggagatttggttcggtttatattgggtagtcacacaatcttcccggtggaatccggtttggcgatttcccttctccgatagactctctcggagatacggaagcgaccttccgaggctcgacgtcttcgtttgcacggcggatccggtgattgagccgccgttgttggtggtaaacacagtcttatctgtgacggctcttgactacccaccggagaaactcgccgtttatctctcagatgacggtggttctgagctgacgttctatgctctcacggaggcagctgagtttgctaaaacttgggttcccttctgcaagaagttcaacgttgagccaacatctcccgctgcttacttgtcttccaaggcaaactgtcttgattctgcggctgaggaggtggctaagctgtatagagaaatggcggcgaggattgaaacggcggcgagactgggacgaataccggaggaggcgcgggtgaagtacggtgacgggttttcacagtgggatgctgacgctactcgaagaaaccatggaaccattcttcaagttttggtagatggaagagaagggaatacaatagcaataccaacgttggtgtatttatcaagagaaaagagacctcaacatcatcataacttcaaggctggagcaatgaacgcattgctgagggtttcttcgaaaattacttgtgggaaaatcatactaaacttggactgtgatatgtacgcaaacaactcaaagtcaacacgcgacgcgctctgcatcctcctcgatgagaaagagggaaaagagattgctttcgtgcagtttccgcagtgttttgacaatgttacaagaaatgatttgtatggaagcatgatgcgagtaggaattgatgtggaatttcttggattggatggaaatggtggtccgttatacattggaactggatgctttcacagaagagatgtgatctgtggaagaaagtatggagaggaagaagaagaagaagaatctgagagaattcacgaaaatttagagcctgagatgattaaggctctcgcgagctgcacttatgaggaaaacactcaatggggaaaggagatgggtgtgaaatatggttgcccggtagaggatgtaataactggtttgacgattcagtgtcgcggatggaaatcagcctacctgaacccggaaaagcaagcatttctcggggtagcgccgaccaatttgcatcaaatgctagtgcagcagaggagatggtcagagggagactttcagattatgctttcgaagtatagtccggtttggtatggaaaaggaaagatcagtttaggactgatacttggttactgttgctattgtctttgggctccatcttcactacctgtgctcatttactctgttttgacttctctctgtctcttcaaaggcattcctctgtttccaaaggtctcgagctcgtggtttattccgtttggatacgtcactgttgcagctaccgcatatagcctagccgagttcttgtggtgcggagggacgttccgtggatggtggaacgagcaaaggatgtggctttatagaagaacaagctcgtttcttttcggatttatggacacgattaagaagctacttggagtttctgagtctgcgtttgtgatcacagcaaaagtagcagaagaagaagcagcagagagatacaaggaagaggtaatggagtttggagtggagtctcccatgtttctcgtcctcggaacactcggtatgctcaatctcttctgcttcgccgcagcggttgcgagacttgtttccggagacggtggagatttgaaaacaatggggatgcaatttgtgataacaggagtactagttgtcataaactggcctctgtataaaggtatgttgttgaggcaagacaaaggaaagatgccaatgagcgttacagttaaatcagttgttttagctttatctgcctgtacctgtttagcgtttttgtaagattgattaacaacagtcaaaaaagtaatcaaaataatgaccagcagttataatatgtaattttct

SEQ ID NO: 1562 - protein, 2309 aa, Arabidopsis thaliana
  misc_feature: GI Number: 34905882; NR Description: P0458E05.17 [Oryza sativa (japonica cultivar-group)] >gi|21902069|dbj|BAC05617.1|
CTCTTATCCCTCTCACCTTCTCACTTGGCACCGTTGCAGAGAGAGAACCAAACATGGTAAACAAAGACGACCGGATTAGACCGGTTCATGAAGCCGACGGTGAACCGCTTTTTGAGACTAGGAGAAGAACCGGTAGAGTGATTGCGTACCGGTTTTTCTCAGCCTCGGTTTTCGTGTGTATCTGTTTGATTTGGTTCTACAGAATTGGTGAGATTGGTGATAACCGTACCGTTTTAGATCGATTAATCTGGTTTGTTATGTTTATTGTGGAGATTTGGTTCGGTTTATATTGGGTAGTCACACAATCTTCCCGGTGGAATCCGGTTTGGCGATTTCCCTTCTCCGATAGACTCTCTCGGAGATACGGAAGCGACCTTCCGAGGCTCGACGTCTTCGTTTGCACGGCGGATCCGGTGATTGAGCCGCCGTTGTTGGTGGTAAACACAGTCTTATCTGTGACGGCTCTTGACTACCCACCGGAGAAACTCGCCGTTTATCTCTCAGATGACGGTGGTTCTGAGCTGACGTTCTATGCTCTCACGGAGGCAGCTGAGTTTGCTAAAACTTGGGTTCCCTTCTGCAAGAAGTTCAACGTTGAGCCAACATCTCCCGCTGCTTACTTGTCTTCCAAGGCAAACTGTCTTGATTCTGCGGCTGAGGAGGTGGCTAAGCTGTATAGAGAAATGGCGGCGAGGATTGAAACGGCGGCGAGACTGGGACGAATACCGGAGGAGGCGCGGGTGAAGTACGGTGACGGGTTTTCACAGTGGGATGCTGACGCTACTCGAAGAAACCATGGAACCATTCTTCAAGTTTTGGTAGATGGAAGAGAAGGGAATACAATAGCAATACCAACGTTGGTGTATTTATCAAGAGAAAAGAGACCTCAACATCATCATAACTTCAAGGCTGGAGCAATGAACGCATTGCTGAGGGTTTCTTCGAAAATTACTTGTGGGAAAATCATACTAAACTTGGACTGTGATATGTACGCAAACAACTCAAAGTCAACACGCGACGCGCTCTGCATCCTCCTCGATGAGAAAGAGGGAAAAGAGATTGCTTTCGTGCAGTTTCCGCAGTGTTTTGACAATGTTACAAGAAATGATTTGTATGGAAGCATGATGCGAGTAGGAATTGATGTGGAATTTCTTGGATTGGATGGAAATGGTGGTCCGTTATACATTGGAACTGGATGCTTTCACAGAAGAGATGTGATCTGTGGAAGAAAGTATGGAGAGGAAGAAGAAGAAGAAGAATCTGAGAGAATTCACGAAAATTTAGAGCCTGAGATGATTAAGGCTCTCGCGAGCTGCACTTATGAGGAAAACACTCAATGGGGAAAGGAGATGGGTGTGAAATATGGTTGCCCGGTAGAGGATGTAATAACTGGTTTGACGATTCAGTGTCGCGGATGGAAATCAGCCTACCTGAACCCGGAAAAGCAAGCATTTCTCGGGGTAGCGCCGACCAATTTGCATCAAATGCTAGTGCAGCAGAGGAGATGGTCAGAGGGAGACTTTCAGATTATGCTTTCGAAGTATAGTCCGGTTTGGTATGGAAAAGGAAAGATCAGTTTAGGACTGATACTTGGTTACTGTTGCTATTGTCTTTGGGCTCCATCTTCACTACCTGTGCTCATTTACTCTGTTTTGACTTCTCTCTGTCTCTTCAAAGGCATTCCTCTGTTTCCAAAGGTCTCGAGCTCGTGGTTTATTCCGTTTGGATACGTCACTGTTGCAGCTACCGCATATAGCCTAGCCGAGTTCTTGTGGTGCGGAGGGACGTTCCGTGGATGGTGGAACGAGCAAAGGATGTGGCTTTATAGAAGAACAAGCTCGTTTCTTTTCGGATTTATGGACACGATTAAGAAGCTACTTGGAGTTTCTGAGTCTGCGTTTGTGATCACAGCAAAAGTAGCAGAAGAAGAAGCAGCAGAGAGATACAAGGAAGAGGTAATGGAGTTTGGAGTGGAGTCTCCCATGTTTCTCGTCCTCGGAACACTCGGTATGCTCAATCTCTTCTGCTTCGCCGCAGCGGTTGCGAGACTTGTTTCCGGAGACGGTGGAGATTTGAAAACAATGGGGATGCAATTTGTGATAACAGGAGTACTAGTTGTCATAAACTGGCCTCTGTATAAAGGTATGTTGTTGAGGCAAGACAAAGGAAAGATGCCAATGAGCGTTACAGTTAAATCAGTTGTTTTAGCTTTATCTGCCTGTACCTGTTTAGCGTTTTTGTAAGATTGATTAACAACAGTCAAAAAAGTAATCAAAATAATGACCAGCAGTTATAATATGTAATTTTCT

SEQ ID NO: 1563 - DNA, 2415 bp, Arabidopsis thaliana
  misc_feature (1)..(2415): Ceres cDNA ID no. 12655256
  misc_feature (1)..(2415): Also known as  Ceres CDNA ID no. 23659454
atgtcgctctctccttcttcctcgccggctccggcaacttccccgcctgccatgtcattacctccggcagattccgtacctgacacgtcatcacctccagctcctcctttgtctcctcttcccccaccattgagctctcctccgccgttgccttcaccaccgcctctctccgctcccaccgcttccccaccgcctcttccggttgaatccccaccgtctcctcctatagaatcaccaccgcctcctctactggaatcacctcctcctcctccgttggaatctccatctccaccgtctcctcacgtctcagctccttccggttcaccgccattacccttccttcccgccaaaccttctccgccgccttcttcacctccctccgagacagttccgccgggaaatacgatttctccaccacctcgttcacttccctccgaatcaaccccgccggtgaacacagcttctcctccaccgccatctcctcctcgccgccgtagtggccctaagccttcgtttcctcctcccatcaattcttctccaccaaatccttctccgaacactccgtcactcccagaaacttctcctccacctaaaccaccgctctcaacgacgccatttccctcctcatccactcccccgcctaagaagtcccctgcagcagtaactcttcctttctttgggccagcgggccaattaccggatgggaccgtagcacctcctattgggcctgttatagagcccaagacgagtccagccgaatcaatatctccgggaacgccacagccactggttccgaagagtctacctgtaacgacgtcgtatcaccgatcatccgccggattcttatttggcggtgtaatcgttggagctcttctactaattctgttaggtcttctctttgtcttctacagagctaccagaaatagaaataacaacagcagctctgctcatcatcaatccaaaactccctcaaaagttcaacatcatcggggcggtaatgctggtacgaaccaggcacatgttatcacaatgccaccaccaatccatgctaaatatatatctagtggaggttgtgatacgaaggagaacaattctgttgcgaaaaacatttcaatgccatctggaatgttctcctacgaagaactttcaaaagcaactggtggattttcagaggagaaccttttgggagaaggcggtttcggatatgttcacaaaggagtgttgaaaaacgggacagaagttgcggtgaagcagctgaagattgggagctatcaaggggaaagagaattccaagctgaggttgacacaatcagtagggttcatcataagcacctcgtttcattggttggttattgcgttaatggagataaaagactcttggtttacgagtttgttcctaaagataccttggagttccacttgcatgagaacagaggaagcgtgttggaatgggaaatgaggctcaggattgctgtaggagcagcaaaaggattagcttatcttcatgaggattgcagtccaactataattcaccgtgatatcaaagcagctaatatccttctagattccaaatttgaggcaaaggtctctgactttggactagccaagtttttctcagacaccaattcatcattcactcatatctctactcgagtggtaggaactttcggatacatggctccagaatacgcgtccagtggtaaagtaactgataaatcagatgtatattcctttggggtcgtgcttctagaactcatcactggacgtccatcaattttcgccaaagattcttccacaaaccagagtttagtagactgggcgaggccattgcttacgaaagcaatctctggagaaagttttgactttcttgtagactcaaggttggagaagaattacgatacaactcagatggcaaacatggctgcttgtgctgctgcttgcatacgccaatcagcttggcttcggcctagaatgagccaggtagtacgtgctcttgaaggcgaggtggccctgagaaaggtcgaagagactgggaatagcgtgacctatagctcttctgaaaacccgaatgacatcacaccacggtatggaacaaataagaggagattcgacacaggttcaagcgatggttacacttcagaatatggagttaacccttctcagtcgagcagtgaacatcaacaggtgaatacttagttcacaggttcaatagggcaagtttcaccacaattattgggttttcggatacagtcatcttgggttaacataaaatgttgtaagaaattagactacttcattcatttgtagttaaggggtccgaagaacactgcttgtgttttgttaaatgtataaattggttgtaatattggggcacaagtttaattatgttgcaaatactttgtttgcttctgatcg

SEQ ID NO: 1564 - protein, 2415 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGTCGCTCTCTCCTTCTTCCTCGCCGGCTCCGGCAACTTCCCCGCCTGCCATGTCATTACCTCCGGCAGATTCCGTACCTGACACGTCATCACCTCCAGCTCCTCCTTTGTCTCCTCTTCCCCCACCATTGAGCTCTCCTCCGCCGTTGCCTTCACCACCGCCTCTCTCCGCTCCCACCGCTTCCCCACCGCCTCTTCCGGTTGAATCCCCACCGTCTCCTCCTATAGAATCACCACCGCCTCCTCTACTGGAATCACCTCCTCCTCCTCCGTTGGAATCTCCATCTCCACCGTCTCCTCACGTCTCAGCTCCTTCCGGTTCACCGCCATTACCCTTCCTTCCCGCCAAACCTTCTCCGCCGCCTTCTTCACCTCCCTCCGAGACAGTTCCGCCGGGAAATACGATTTCTCCACCACCTCGTTCACTTCCCTCCGAATCAACCCCGCCGGTGAACACAGCTTCTCCTCCACCGCCATCTCCTCCTCGCCGCCGTAGTGGCCCTAAGCCTTCGTTTCCTCCTCCCATCAATTCTTCTCCACCAAATCCTTCTCCGAACACTCCGTCACTCCCAGAAACTTCTCCTCCACCTAAACCACCGCTCTCAACGACGCCATTTCCCTCCTCATCCACTCCCCCGCCTAAGAAGTCCCCTGCAGCAGTAACTCTTCCTTTCTTTGGGCCAGCGGGCCAATTACCGGATGGGACCGTAGCACCTCCTATTGGGCCTGTTATAGAGCCCAAGACGAGTCCAGCCGAATCAATATCTCCGGGAACGCCACAGCCACTGGTTCCGAAGAGTCTACCTGTAACGACGTCGTATCACCGATCATCCGCCGGATTCTTATTTGGCGGTGTAATCGTTGGAGCTCTTCTACTAATTCTGTTAGGTCTTCTCTTTGTCTTCTACAGAGCTACCAGAAATAGAAATAACAACAGCAGCTCTGCTCATCATCAATCCAAAACTCCCTCAAAAGTTCAACATCATCGGGGCGGTAATGCTGGTACGAACCAGGCACATGTTATCACAATGCCACCACCAATCCATGCTAAATATATATCTAGTGGAGGTTGTGATACGAAGGAGAACAATTCTGTTGCGAAAAACATTTCAATGCCATCTGGAATGTTCTCCTACGAAGAACTTTCAAAAGCAACTGGTGGATTTTCAGAGGAGAACCTTTTGGGAGAAGGCGGTTTCGGATATGTTCACAAAGGAGTGTTGAAAAACGGGACAGAAGTTGCGGTGAAGCAGCTGAAGATTGGGAGCTATCAAGGGGAAAGAGAATTCCAAGCTGAGGTTGACACAATCAGTAGGGTTCATCATAAGCACCTCGTTTCATTGGTTGGTTATTGCGTTAATGGAGATAAAAGACTCTTGGTTTACGAGTTTGTTCCTAAAGATACCTTGGAGTTCCACTTGCATGAGAACAGAGGAAGCGTGTTGGAATGGGAAATGAGGCTCAGGATTGCTGTAGGAGCAGCAAAAGGATTAGCTTATCTTCATGAGGATTGCAGTCCAACTATAATTCACCGTGATATCAAAGCAGCTAATATCCTTCTAGATTCCAAATTTGAGGCAAAGGTCTCTGACTTTGGACTAGCCAAGTTTTTCTCAGACACCAATTCATCATTCACTCATATCTCTACTCGAGTGGTAGGAACTTTCGGATACATGGCTCCAGAATACGCGTCCAGTGGTAAAGTAACTGATAAATCAGATGTATATTCCTTTGGGGTCGTGCTTCTAGAACTCATCACTGGACGTCCATCAATTTTCGCCAAAGATTCTTCCACAAACCAGAGTTTAGTAGACTGGGCGAGGCCATTGCTTACGAAAGCAATCTCTGGAGAAAGTTTTGACTTTCTTGTAGACTCAAGGTTGGAGAAGAATTACGATACAACTCAGATGGCAAACATGGCTGCTTGTGCTGCTGCTTGCATACGCCAATCAGCTTGGCTTCGGCCTAGAATGAGCCAGGTAGTACGTGCTCTTGAAGGCGAGGTGGCCCTGAGAAAGGTCGAAGAGACTGGGAATAGCGTGACCTATAGCTCTTCTGAAAACCCGAATGACATCACACCACGGTATGGAACAAATAAGAGGAGATTCGACACAGGTTCAAGCGATGGTTACACTTCAGAATATGGAGTTAACCCTTCTCAGTCGAGCAGTGAACATCAACAGGTGAATACTTAGTTCACAGGTTCAATAGGGCAAGTTTCACCACAATTATTGGGTTTTCGGATACAGTCATCTTGGGTTAACATAAAATGTTGTAAGAAATTAGACTACTTCATTCATTTGTAGTTAAGGGGTCCGAAGAACACTGCTTGTGTTTTGTTAAATGTATAAATTGGTTGTAATATTGGGGCACAAGTTTAATTATGTTGCAAATACTTTGTTTGCTTCTGATCG

SEQ ID NO: 1565 - DNA, 2973 bp, Arabidopsis thaliana
  misc_feature (1)..(2973): Ceres cDNA ID no. 12655327
  misc_feature (1)..(2973): Also known as  Ceres CDNA ID no. 23659454
atgcgatcaacctccaaggccatccctttctcctttcacacatctctcattgttcaatgtctccgtcctctgcgttttacttctgctgcttcgccgtcttcatcttcctcgtcttcgtcacaatggttcggctttcttcggaatgcaatcacctcgtcggacttgatgctcggaaaatgtacacacgcacgtatcctaaccttcgaggaaaacccagaacgattcctgattaacaatctcatctccatgtactccaagtgtggatcactcacttatgctcgccgagtgttcgataaaatgcctgacagagatcttgtttcctggaactcgattttagctgcctatgctcagtcttccgaatgcgttgtcgagaacattcaacaagcttttcttcttttcaggatattacgccaggacgttgtgtataccagtcgaatgactctgtctccaatgttgaaactttgtttgcattctgggtatgtgtgggcttcagagtcatttcatgggtatgcttgcaagattggtttggacggtgatgaatttgttgccggagctcttgttaacatatatttgaagtttggtaaggttaaggaaggtaaggttttgtttgaggagatgccttatagagatgtggtgttatggaacttgatgttgaaggcttatctggaaatgggttttaaggaagaagcaatagacctctcttctgcatttcattcaagtggtttaaatcccaatgaaatcactctgcgtttacttgctagaatttcaggtgatgattctgatgcaggacaagtgaaatcctttgcaaatggtaatgatgcttcttctgtttcagaaataatattcaggaacaaaggattgagtgaatatctccattcaggccagtattcagctcttctcaaatgttttgcggatatggtagagtccgacgtggaatgtgatcaagtcacatttattttaatgttagctacagctgttaaagtagatagtttagcattagggcagcaagttcattgtatggcattgaagttaggacttgatttgatgcttactgtttcgaatagtctaataaacatgtactgtaaactgagaaaattcggtttcgctaggacagtatttgacaatatgagtgaacgagatttgatttcgtggaattcagttattgccggaatagctcaaaatggcttagaagtagaagcagtgtgtctgtttatgcagctgttacgttgcggcctcaaaccagaccagtatactatgacgagtgttctaaaggctgcttcttctcttcctgaaggcttgtcgttgagtaaacaagtacatgttcatgcaattaaaatcaataatgtttctgatagttttgtctctactgctctgattgatgcctactctcggaacagatgtatgaaagaggcagagattttgtttgagaggcataattttgatctcgtcgcttggaatgccatgatggctggttatacccaaagtcatgacggtcataagactctgaagctttttgctttgatgcataaacagggagagagatctgatgatttcacgctcgcaacagtgtttaagacatgtggtttcttgtttgccataaatcaaggaaagcaagtccatgcttatgcaatcaaatctggatatgacttagatctatgggtcagcagtgggattttggatatgtatgtaaaatgtggcgatatgagtgcagcacaatttgcctttgatagtattcccgtacctgacgatgttgcttggacgactatgatatcaggatgcatagaaaatggagaagaagaaagagcgtttcatgtttttagccagatgaggctcatgggagtgttgcctgatgaatttacaatagccacacttgcgaaagcaagctcttgtttgacggcattagaacaggggcgccaaattcatgcaaatgccctcaagttgaattgtacgaatgaccctttcgttggaacttcacttgtggacatgtatgctaagtgtggaagcatagacgatgcatattgtttgtttaaaagaatagagatgatgaacatcactgcctggaatgccatgttagtgggattagctcaacatggggaagggaaagaaacgctccagcttttcaaacagatgaaatctctgggtataaaacctgataaggtcacatttatcggcgttctttctgcttgcagtcactcaggcttggtatcagaggcatacaagcatatgcgatcaatgcatggagactatggcattaaacctgaaatagaacactactcttgtttggctgatgcgcttggccgtgctggacttgttaaacaggctgaaaatttgatcgagtcaatgtccatggaagcttcagcatcgatgtacagaactttgcttgcagcttgccgagttcaaggggacacagaaacagggaagagagtggcaactaagcttttggagctagagccactggactcatcagcttatgttcttttatccaatatgtatgctgctgcttccaaatgggatgagatgaaacttgcccggacgatgatgaaagggcacaaagtgaaaaaagacccgggtttcagttggatcgaggtgaaaaacaagatacatatatttgtcgtggatgataggtcaaaccggcaaaccgagttgatatacaggaaagtaaaagacatgataagagacatcaaacaagaagggtatgttcctgagacagatttcacacttgtagatgtggaagaagaagagaaagagcgtgccctgtactaccacagtgagaagctagcagttgctttcggacttttgagcactcctccatccacaccaatccgtgtgattaagaatctacgcgtctgtggagattgtcacaacgcgatgaaatatatagcaaaggtgtataatagagagattgtacttagagatgcaaaccggtttcaccggttcaaggatggtatttgctcatgtggtgattattggtag

SEQ ID NO: 1566 - protein, 2973 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGCGATCAACCTCCAAGGCCATCCCTTTCTCCTTTCACACATCTCTCATTGTTCAATGTCTCCGTCCTCTGCGTTTTACTTCTGCTGCTTCGCCGTCTTCATCTTCCTCGTCTTCGTCACAATGGTTCGGCTTTCTTCGGAATGCAATCACCTCGTCGGACTTGATGCTCGGAAAATGTACACACGCACGTATCCTAACCTTCGAGGAAAACCCAGAACGATTCCTGATTAACAATCTCATCTCCATGTACTCCAAGTGTGGATCACTCACTTATGCTCGCCGAGTGTTCGATAAAATGCCTGACAGAGATCTTGTTTCCTGGAACTCGATTTTAGCTGCCTATGCTCAGTCTTCCGAATGCGTTGTCGAGAACATTCAACAAGCTTTTCTTCTTTTCAGGATATTACGCCAGGACGTTGTGTATACCAGTCGAATGACTCTGTCTCCAATGTTGAAACTTTGTTTGCATTCTGGGTATGTGTGGGCTTCAGAGTCATTTCATGGGTATGCTTGCAAGATTGGTTTGGACGGTGATGAATTTGTTGCCGGAGCTCTTGTTAACATATATTTGAAGTTTGGTAAGGTTAAGGAAGGTAAGGTTTTGTTTGAGGAGATGCCTTATAGAGATGTGGTGTTATGGAACTTGATGTTGAAGGCTTATCTGGAAATGGGTTTTAAGGAAGAAGCAATAGACCTCTCTTCTGCATTTCATTCAAGTGGTTTAAATCCCAATGAAATCACTCTGCGTTTACTTGCTAGAATTTCAGGTGATGATTCTGATGCAGGACAAGTGAAATCCTTTGCAAATGGTAATGATGCTTCTTCTGTTTCAGAAATAATATTCAGGAACAAAGGATTGAGTGAATATCTCCATTCAGGCCAGTATTCAGCTCTTCTCAAATGTTTTGCGGATATGGTAGAGTCCGACGTGGAATGTGATCAAGTCACATTTATTTTAATGTTAGCTACAGCTGTTAAAGTAGATAGTTTAGCATTAGGGCAGCAAGTTCATTGTATGGCATTGAAGTTAGGACTTGATTTGATGCTTACTGTTTCGAATAGTCTAATAAACATGTACTGTAAACTGAGAAAATTCGGTTTCGCTAGGACAGTATTTGACAATATGAGTGAACGAGATTTGATTTCGTGGAATTCAGTTATTGCCGGAATAGCTCAAAATGGCTTAGAAGTAGAAGCAGTGTGTCTGTTTATGCAGCTGTTACGTTGCGGCCTCAAACCAGACCAGTATACTATGACGAGTGTTCTAAAGGCTGCTTCTTCTCTTCCTGAAGGCTTGTCGTTGAGTAAACAAGTACATGTTCATGCAATTAAAATCAATAATGTTTCTGATAGTTTTGTCTCTACTGCTCTGATTGATGCCTACTCTCGGAACAGATGTATGAAAGAGGCAGAGATTTTGTTTGAGAGGCATAATTTTGATCTCGTCGCTTGGAATGCCATGATGGCTGGTTATACCCAAAGTCATGACGGTCATAAGACTCTGAAGCTTTTTGCTTTGATGCATAAACAGGGAGAGAGATCTGATGATTTCACGCTCGCAACAGTGTTTAAGACATGTGGTTTCTTGTTTGCCATAAATCAAGGAAAGCAAGTCCATGCTTATGCAATCAAATCTGGATATGACTTAGATCTATGGGTCAGCAGTGGGATTTTGGATATGTATGTAAAATGTGGCGATATGAGTGCAGCACAATTTGCCTTTGATAGTATTCCCGTACCTGACGATGTTGCTTGGACGACTATGATATCAGGATGCATAGAAAATGGAGAAGAAGAAAGAGCGTTTCATGTTTTTAGCCAGATGAGGCTCATGGGAGTGTTGCCTGATGAATTTACAATAGCCACACTTGCGAAAGCAAGCTCTTGTTTGACGGCATTAGAACAGGGGCGCCAAATTCATGCAAATGCCCTCAAGTTGAATTGTACGAATGACCCTTTCGTTGGAACTTCACTTGTGGACATGTATGCTAAGTGTGGAAGCATAGACGATGCATATTGTTTGTTTAAAAGAATAGAGATGATGAACATCACTGCCTGGAATGCCATGTTAGTGGGATTAGCTCAACATGGGGAAGGGAAAGAAACGCTCCAGCTTTTCAAACAGATGAAATCTCTGGGTATAAAACCTGATAAGGTCACATTTATCGGCGTTCTTTCTGCTTGCAGTCACTCAGGCTTGGTATCAGAGGCATACAAGCATATGCGATCAATGCATGGAGACTATGGCATTAAACCTGAAATAGAACACTACTCTTGTTTGGCTGATGCGCTTGGCCGTGCTGGACTTGTTAAACAGGCTGAAAATTTGATCGAGTCAATGTCCATGGAAGCTTCAGCATCGATGTACAGAACTTTGCTTGCAGCTTGCCGAGTTCAAGGGGACACAGAAACAGGGAAGAGAGTGGCAACTAAGCTTTTGGAGCTAGAGCCACTGGACTCATCAGCTTATGTTCTTTTATCCAATATGTATGCTGCTGCTTCCAAATGGGATGAGATGAAACTTGCCCGGACGATGATGAAAGGGCACAAAGTGAAAAAAGACCCGGGTTTCAGTTGGATCGAGGTGAAAAACAAGATACATATATTTGTCGTGGATGATAGGTCAAACCGGCAAACCGAGTTGATATACAGGAAAGTAAAAGACATGATAAGAGACATCAAACAAGAAGGGTATGTTCCTGAGACAGATTTCACACTTGTAGATGTGGAAGAAGAAGAGAAAGAGCGTGCCCTGTACTACCACAGTGAGAAGCTAGCAGTTGCTTTCGGACTTTTGAGCACTCCTCCATCCACACCAATCCGTGTGATTAAGAATCTACGCGTCTGTGGAGATTGTCACAACGCGATGAAATATATAGCAAAGGTGTATAATAGAGAGATTGTACTTAGAGATGCAAACCGGTTTCACCGGTTCAAGGATGGTATTTGCTCATGTGGTGATTATTGGTAG

SEQ ID NO: 1567 - DNA, 1413 bp, Arabidopsis thaliana
  misc_feature (1)..(1413): Ceres cDNA ID no. 12655475
  misc_feature (1)..(1413): Also known as  Ceres CDNA ID no. 23659454
atgagagattacattccgaaatacctgaacgcctttcttttggcatttgccacttttgctgtaggctttgccattttcatagcaaaagattcaaattcatcttctcatctttatttttcaacatcttcttcactatggacctcttccttctcacccgccttcatcacggtatccatctttcttaccgttcatcgatttagggaaaaaagaaagagaaacggatcaaatccaggttctggatattggaaaagggatgggaaagtagaagcagaattagcaaccgcgagggtgttgatcagagaagctcaattaaattatagttctactacatcgtctccccttggagacgaagactatgttcctcatggcgacatttaccggaacccttatgcctttcaccgaagttatcttcttatggagaagatgttcaagatatacgtatacgaagaaggagatccgccaatatttcactatggactttgtaaagacatatactccatggaaggattattcctaaactttatggaaaacgatgtccttaagtaccgaacccgagatccggacaaggctcatgtctacttcttaccttttagtgttgtgatgatcctacaccatcttttcgacccagttgttcgagataaggctgtcttggaacgtgtcatcgccgactatgtccaaataatttccaagaaatatccttattggaacacaagcgatgggtttgatcacttcatgttgtcttgccatgactggggtcacagggcaacatggtacgtaaagaaactatttttcaattccataagagtactatgcaacgccaacatatcagaatattttaatccagagaaagacgctccgtttcccgaaattaatttactgaccggagacatcaacaacttaaccggtggtttagatccaatctctcgtacaacacttgctttcttcgctggaaaatcacacggcaaaatccgtccggttcttcttaaccactggaaagaaaaggataaagatattctggtttacgagaatctaccggacggtttagattacacggagatgatgaggaaaagccggttttgtatttgcccgagtggtcacgaagttgccagtccgagagtaccggaagctatatacagcggatgtgtaccggttcttatttcggagaactatgttttgccgtttagtgatgttttgaactgggagaagttctcggtttcggtatcggttaaggaaataccggaactaaaaaggatactgatggatataccggaagagcggtatatgagattatacgagggagtgaagaaagtgaagaggcatattttggttaatgatcctccaaagagatacgatgtgtttaatatgattatacattccatttggttaagaagattaaatgttaaattgttatga

SEQ ID NO: 1568 - protein, 1413 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGAGAGATTACATTCCGAAATACCTGAACGCCTTTCTTTTGGCATTTGCCACTTTTGCTGTAGGCTTTGCCATTTTCATAGCAAAAGATTCAAATTCATCTTCTCATCTTTATTTTTCAACATCTTCTTCACTATGGACCTCTTCCTTCTCACCCGCCTTCATCACGGTATCCATCTTTCTTACCGTTCATCGATTTAGGGAAAAAAGAAAGAGAAACGGATCAAATCCAGGTTCTGGATATTGGAAAAGGGATGGGAAAGTAGAAGCAGAATTAGCAACCGCGAGGGTGTTGATCAGAGAAGCTCAATTAAATTATAGTTCTACTACATCGTCTCCCCTTGGAGACGAAGACTATGTTCCTCATGGCGACATTTACCGGAACCCTTATGCCTTTCACCGAAGTTATCTTCTTATGGAGAAGATGTTCAAGATATACGTATACGAAGAAGGAGATCCGCCAATATTTCACTATGGACTTTGTAAAGACATATACTCCATGGAAGGATTATTCCTAAACTTTATGGAAAACGATGTCCTTAAGTACCGAACCCGAGATCCGGACAAGGCTCATGTCTACTTCTTACCTTTTAGTGTTGTGATGATCCTACACCATCTTTTCGACCCAGTTGTTCGAGATAAGGCTGTCTTGGAACGTGTCATCGCCGACTATGTCCAAATAATTTCCAAGAAATATCCTTATTGGAACACAAGCGATGGGTTTGATCACTTCATGTTGTCTTGCCATGACTGGGGTCACAGGGCAACATGGTACGTAAAGAAACTATTTTTCAATTCCATAAGAGTACTATGCAACGCCAACATATCAGAATATTTTAATCCAGAGAAAGACGCTCCGTTTCCCGAAATTAATTTACTGACCGGAGACATCAACAACTTAACCGGTGGTTTAGATCCAATCTCTCGTACAACACTTGCTTTCTTCGCTGGAAAATCACACGGCAAAATCCGTCCGGTTCTTCTTAACCACTGGAAAGAAAAGGATAAAGATATTCTGGTTTACGAGAATCTACCGGACGGTTTAGATTACACGGAGATGATGAGGAAAAGCCGGTTTTGTATTTGCCCGAGTGGTCACGAAGTTGCCAGTCCGAGAGTACCGGAAGCTATATACAGCGGATGTGTACCGGTTCTTATTTCGGAGAACTATGTTTTGCCGTTTAGTGATGTTTTGAACTGGGAGAAGTTCTCGGTTTCGGTATCGGTTAAGGAAATACCGGAACTAAAAAGGATACTGATGGATATACCGGAAGAGCGGTATATGAGATTATACGAGGGAGTGAAGAAAGTGAAGAGGCATATTTTGGTTAATGATCCTCCAAAGAGATACGATGTGTTTAATATGATTATACATTCCATTTGGTTAAGAAGATTAAATGTTAAATTGTTATGA

SEQ ID NO: 1569 - DNA, 1303 bp, Arabidopsis thaliana
  misc_feature (1)..(1303): Ceres cDNA ID no. 12656167
  misc_feature (1)..(1303): Also known as  Ceres CDNA ID no. 23659454
aaatttagaccgactaaaaaattcattaacgtaaaaaagttcttgtttctttctttcttttcttcttcttcacgctcctctctttgtcattttctttttctttctttttggtttaagttttttctctttgttcttcgtcatgtctcatgaaatcaaagatcttaacaactatcactacacttcatcgtataatcattacaatatcaacaaccaaaatatgattaatctcccttacgtttctggtccatctgcttataatgcaaacatgatctcatcatcacaagtaggttttgatctaccctcgaagaacttgagtcctcaaggagccttcgagttgggtttcgagctttctccatcttcttctgacttttttaatccttccctcgatcaagagaacggtttgtataatgcttataattataatagtagtcaaaagagtcatgaagttgtcggtgatggttgtgcaaccattaagagtgaagttagggtttcagcatctccttcttcaagtgaggccgatcatcatccaggagaagattccggcaagatccggaagaaaagagaagttcgcgatggaggagaagatgatcaacgctctcagaaagtagttaaaacaaagaagaaagaggagaagaaaaaagagccacgagtctcgttcatgactaagaccgaagttgatcatctcgaagacggctatcgttggagaaagtatggccaaaaagcagtcaaaaacagtccttatccgaggagttactatagatgcacgactcagaagtgcaacgtgaagaagagagtggagagatcttaccaagacccaacggtcgtcatcacaacctacgagagtcaacacaaccatccgatcccgaccaatcgtcggacagcaatgttctctggaaccaccgcatctgattataacccatcatcgtctccaatattctccgatctcatcatcaatactccaagaagcttctcaaatgatgatctcttccgtgtgccatacgctagtgtgaacgtgaaccctagttatcatcaacagcaacatggatttcatcaacaggagagtgagttcgagctcttgaaggagatgtttccttcggttttcttcaaacaagagccttgatgatataatataatatagaaacaattttttttctgctaagaaatatagaacaaaacttggatgcataataagtgatgatagtgttatttattttttgcatgtatatattatacatgttttgttaactagctataggatatactgtagtaattaagcataaatatggagtcccttcgacttatt

SEQ ID NO: 1570 - protein, 1303 aa, Arabidopsis thaliana
  misc_feature: GI Number: 34905882; NR Description: P0458E05.17 [Oryza sativa (japonica cultivar-group)] >gi|21902069|dbj|BAC05617.1|
AAATTTAGACCGACTAAAAAATTCATTAACGTAAAAAAGTTCTTGTTTCTTTCTTTCTTTTCTTCTTCTTCACGCTCCTCTCTTTGTCATTTTCTTTTTCTTTCTTTTTGGTTTAAGTTTTTTCTCTTTGTTCTTCGTCATGTCTCATGAAATCAAAGATCTTAACAACTATCACTACACTTCATCGTATAATCATTACAATATCAACAACCAAAATATGATTAATCTCCCTTACGTTTCTGGTCCATCTGCTTATAATGCAAACATGATCTCATCATCACAAGTAGGTTTTGATCTACCCTCGAAGAACTTGAGTCCTCAAGGAGCCTTCGAGTTGGGTTTCGAGCTTTCTCCATCTTCTTCTGACTTTTTTAATCCTTCCCTCGATCAAGAGAACGGTTTGTATAATGCTTATAATTATAATAGTAGTCAAAAGAGTCATGAAGTTGTCGGTGATGGTTGTGCAACCATTAAGAGTGAAGTTAGGGTTTCAGCATCTCCTTCTTCAAGTGAGGCCGATCATCATCCAGGAGAAGATTCCGGCAAGATCCGGAAGAAAAGAGAAGTTCGCGATGGAGGAGAAGATGATCAACGCTCTCAGAAAGTAGTTAAAACAAAGAAGAAAGAGGAGAAGAAAAAAGAGCCACGAGTCTCGTTCATGACTAAGACCGAAGTTGATCATCTCGAAGACGGCTATCGTTGGAGAAAGTATGGCCAAAAAGCAGTCAAAAACAGTCCTTATCCGAGGAGTTACTATAGATGCACGACTCAGAAGTGCAACGTGAAGAAGAGAGTGGAGAGATCTTACCAAGACCCAACGGTCGTCATCACAACCTACGAGAGTCAACACAACCATCCGATCCCGACCAATCGTCGGACAGCAATGTTCTCTGGAACCACCGCATCTGATTATAACCCATCATCGTCTCCAATATTCTCCGATCTCATCATCAATACTCCAAGAAGCTTCTCAAATGATGATCTCTTCCGTGTGCCATACGCTAGTGTGAACGTGAACCCTAGTTATCATCAACAGCAACATGGATTTCATCAACAGGAGAGTGAGTTCGAGCTCTTGAAGGAGATGTTTCCTTCGGTTTTCTTCAAACAAGAGCCTTGATGATATAATATAATATAGAAACAATTTTTTTTCTGCTAAGAAATATAGAACAAAACTTGGATGCATAATAAGTGATGATAGTGTTATTTATTTTTTGCATGTATATATTATACATGTTTTGTTAACTAGCTATAGGATATACTGTAGTAATTAAGCATAAATATGGAGTCCCTTCGACTTATT

SEQ ID NO: 1571 - DNA, 995 bp, Arabidopsis thaliana
  misc_feature (1)..(995): Ceres cDNA ID no. 12656330
  misc_feature (1)..(995): Also known as  Ceres CDNA ID no. 23659454
tttcactcatcatacgttgtagaaagggaaccgcaaagtgaaaaaacagttgctccaccacgaggaacagatccatgtctgcttctagttcctccacaaatcccatgtcccgtgaggacgcaacaacactgcttccgtctgttcaagacaagtacggtggcgtgatgaccgagatgactcatcccatggatccttctctcttctccacacttctccgatcctctctatctacctggactcttcagggcaaaaagggagtgtggatcaagttgccaaagcagcttattggtcttgctgaaactgctgttaaggagggattctggtttcaccacgcggagaaagactacttgatgcttgtctattggattcccaaagaagacgatacgcttcctgccaatgcatctcaccgtgttggcataggtgcctttgtcattaaccacaacaaagaggtgctggtggttcaagagaagacagggagatttcaaggtcaaggtatctggaagttccccaccggagttgtgaatgagggtgaagacattcatgatggctcagtcagagaggtgaaagaagagaccggagtggatacagaattcgaccaaatattggccttcagacaaacacacaaagcgttctttggaaagtcagatttgttcttcgtgtgcatgttaaagcccctttctttggagatcaacgcacaggagtcagagattgaggcagctcagtggatgccttgggaggaatacataaatcaaccatttgtacaaaattatgagctattgaggtatatgacagacatttgctctgctaaaaccaacggagactacgaaggcttcactcctctccgcgtctctgcacctgatcaacaaggcaacttgtactacaacacccgcgacttacattcgcgcaattgaccttctttctcaacaaacagagctttcctcacagattctaacgaagctggtttctttgctgcctctctatgtaagcattttgac

SEQ ID NO: 1572 - protein, 995 aa, Arabidopsis thaliana
  misc_feature: GI Number: 34905882; NR Description: P0458E05.17 [Oryza sativa (japonica cultivar-group)] >gi|21902069|dbj|BAC05617.1|
TTTCACTCATCATACGTTGTAGAAAGGGAACCGCAAAGTGAAAAAACAGTTGCTCCACCACGAGGAACAGATCCATGTCTGCTTCTAGTTCCTCCACAAATCCCATGTCCCGTGAGGACGCAACAACACTGCTTCCGTCTGTTCAAGACAAGTACGGTGGCGTGATGACCGAGATGACTCATCCCATGGATCCTTCTCTCTTCTCCACACTTCTCCGATCCTCTCTATCTACCTGGACTCTTCAGGGCAAAAAGGGAGTGTGGATCAAGTTGCCAAAGCAGCTTATTGGTCTTGCTGAAACTGCTGTTAAGGAGGGATTCTGGTTTCACCACGCGGAGAAAGACTACTTGATGCTTGTCTATTGGATTCCCAAAGAAGACGATACGCTTCCTGCCAATGCATCTCACCGTGTTGGCATAGGTGCCTTTGTCATTAACCACAACAAAGAGGTGCTGGTGGTTCAAGAGAAGACAGGGAGATTTCAAGGTCAAGGTATCTGGAAGTTCCCCACCGGAGTTGTGAATGAGGGTGAAGACATTCATGATGGCTCAGTCAGAGAGGTGAAAGAAGAGACCGGAGTGGATACAGAATTCGACCAAATATTGGCCTTCAGACAAACACACAAAGCGTTCTTTGGAAAGTCAGATTTGTTCTTCGTGTGCATGTTAAAGCCCCTTTCTTTGGAGATCAACGCACAGGAGTCAGAGATTGAGGCAGCTCAGTGGATGCCTTGGGAGGAATACATAAATCAACCATTTGTACAAAATTATGAGCTATTGAGGTATATGACAGACATTTGCTCTGCTAAAACCAACGGAGACTACGAAGGCTTCACTCCTCTCCGCGTCTCTGCACCTGATCAACAAGGCAACTTGTACTACAACACCCGCGACTTACATTCGCGCAATTGACCTTCTTTCTCAACAAACAGAGCTTTCCTCACAGATTCTAACGAAGCTGGTTTCTTTGCTGCCTCTCTATGTAAGCATTTTGAC

SEQ ID NO: 1573 - DNA, 3331 bp, Arabidopsis thaliana
  misc_feature (1)..(3331): Ceres cDNA ID no. 12656625
  misc_feature (1)..(3331): Also known as  Ceres CDNA ID no. 23659454
aaaaactctctttctatcagaaagaaatgacatttttaatattacatgcctatacagttacaagaatacggttcatcctatagattgtcatgtaatctgcttatgaatgtttcatggtgaaatcattgggaaacctgcaggcgatctgatggacacatttcgttttggatgatcatagtttctgagataggagaccaatacaggcctgattatggcaaattcctttagaaacgattttatattcgttttctgtagcggctgccccttgcaactattaaaggttttttttgcaaaattataaacaaaaggtttcctgtagaaaagaagattgtatttcttttgtttactagtcgtcaactttgcaagtataattttcaagggaccaaaccaaatcaaggattttatttgacttttgtttatatatgtattgtaactgtaattgtaattgtatatcaacccaacatgctaatactataacttagatggagttgaagcgggtacgtgtagtagctgtccttttgatcttgcctcgtctatatattgcatgagagaacattttccataagaaagtaatcaaacacatttggtgataatgacacgtctacgccttctttcatggatttcaatcacgagctgtgtttgtctcgtttttgctcaagaccaatcaggttttattagtatcgattgtgggataccagatgattcaagctacactgatgagaaaacaaacatgaaatacgtttcggatttgggttttgttgagtctggaacaagtcatagcatagtctctgaccttcaaacaacttctcttgaaaggcagttccaaaacgtaagaagcttccctgaaggtaagagaaactgttacgacataaggcctcagcaagggaaaggtttcaagtatctgattagaactcgttttatgtacgggaactatgatggttttagtaaaacacctgagtttgatctctatattggagccaatctttgggaatctgttgttcttatcaatgaaacggctataatgaccaaagaaatcatttatacacctccatcagaccatattcatgtgtgtcttgttgataaaaacagaggaactccttttctctctgtcttggaaataagatttttgaagaacgatacatatgacactccttatgaagcgcttatgcttggtcgaagatgggatttcggcacagcgaccaatcttcaaatcaggtacaaagatgatttctatgatcgcatatggatgccttataagtctccgtaccagaaaactttgaatacatccctcaccatcgatgaaactaaccacaacggtttcagacctgctagtatagtcatgagatctgcgatagcacctggaaacgaaagcaatcccttgaagtttaactgggcaccagatgatccgaggtcgaagttttatatatacatgcacttcgctgaagttcgagagctacaaagaaacgagacacgagaattcgatatatacataaatgacgttatacttgccgagaatttccgtcctttttatttgtttacagacacacgctccactgtagatccagttggcagaaaaatgaatgaaattgtccttcagagaactggtgtatcgacccttccaccgatcatcaacgctatagagatctatcaaatcaacgagttccttcagttaccaacagatcaacaggatgttgatgccatgacgaagattaagttcaagtatagagtaaagaagaactggcaaggagacccatgtgttccagtggacaattcttgggaaggtcttgaatgtctccatagtgataataatacttctccaaaatccattgctctgaacttatcctccagtggactgactggccagattgatccagctttcgccaacctaacatcaataaataaattagacttatcaaacaacagcttaacagggaaagtacccgatttcctcgccagtttaccaaacttgactgaattaaacctggaaggaaacaagttaactggttcgattccagctaaactgttggagaaatcaaaagatggttctctttcgcttagatttggtggaaacccggacctttgtcagtctccctcatgtcaaacaacaacgaagaagaaaattggttacatcgtcccagtagtagcatcactcgcaggattgctcattgttttgaccgcattagctttgatctggcattttaaaaaacgatcacgaagaggtacaatctcaaacaaaccattaggtgtcaacaccggaccattggacacagccaaaagatactttatatactcagaagttgtgaatatcacaaacaacttcgagagagttcttggtaaaggaggttttggtaaagtataccatggtttcttgaatggagatcaagtagctgtgaagatactttccgaagagtcaactcaaggttacaaagagtttcgagcagaggttgagcttctgatgagagtccatcacacaaatttgacatctcttatcggatactgcaatgaagataaccacatggcacttatctacgagtacatggctaatggaaacttaggagactatttgtcaggaaaaagttccttaatcttgagctgggaagagagattacagatatcattggatgcagcacaaggcctcgagtatctccattacggttgcaagcctcccatagttcacagagatgtgaagccggcaaatatcttactgaacgagaatcttcaagccaagatagctgactttggtttatctagaagcttcccagtcgaaggtagtagtcaagtctccaccgttgtcgctggaaccatcggttacttagaccctgagtattacgcaacgcggcaaatgaacgagaagagtgatgtttacagcttcggggtggttcttcttgaagtaataacaggaaaaccggcaatttggcattcaagaacagagagtgtgcatctaagtgatcaggttggttcaatgttggcgaatggagacataaaaggtattgtggatcaacgtctgggagatagatttgaggttggctcggcttggaagatcactgaactagcattggcttgtgcgtctgagagttcagaacaaagaccgacaatgagccaagtcgttatggagctgaaacagagtatctttgggagagtgaacaatcgaagtgaccataaggaccctgtgagaatggttacgatgaacctcgatactgaaatggttcctcgggcgaggtaaagatggatatttgtatcttcataaaactatcagtgtattatcatcccatcattaccgttactatcagtatcattcaaaatcagccatgaatcatgttaaatgcacttg

SEQ ID NO: 1574 - protein, 3331 aa, Arabidopsis thaliana
  misc_feature: GI Number: 34905882; NR Description: P0458E05.17 [Oryza sativa (japonica cultivar-group)] >gi|21902069|dbj|BAC05617.1|
AAAAACTCTCTTTCTATCAGAAAGAAATGACATTTTTAATATTACATGCCTATACAGTTACAAGAATACGGTTCATCCTATAGATTGTCATGTAATCTGCTTATGAATGTTTCATGGTGAAATCATTGGGAAACCTGCAGGCGATCTGATGGACACATTTCGTTTTGGATGATCATAGTTTCTGAGATAGGAGACCAATACAGGCCTGATTATGGCAAATTCCTTTAGAAACGATTTTATATTCGTTTTCTGTAGCGGCTGCCCCTTGCAACTATTAAAGGTTTTTTTTGCAAAATTATAAACAAAAGGTTTCCTGTAGAAAAGAAGATTGTATTTCTTTTGTTTACTAGTCGTCAACTTTGCAAGTATAATTTTCAAGGGACCAAACCAAATCAAGGATTTTATTTGACTTTTGTTTATATATGTATTGTAACTGTAATTGTAATTGTATATCAACCCAACATGCTAATACTATAACTTAGATGGAGTTGAAGCGGGTACGTGTAGTAGCTGTCCTTTTGATCTTGCCTCGTCTATATATTGCATGAGAGAACATTTTCCATAAGAAAGTAATCAAACACATTTGGTGATAATGACACGTCTACGCCTTCTTTCATGGATTTCAATCACGAGCTGTGTTTGTCTCGTTTTTGCTCAAGACCAATCAGGTTTTATTAGTATCGATTGTGGGATACCAGATGATTCAAGCTACACTGATGAGAAAACAAACATGAAATACGTTTCGGATTTGGGTTTTGTTGAGTCTGGAACAAGTCATAGCATAGTCTCTGACCTTCAAACAACTTCTCTTGAAAGGCAGTTCCAAAACGTAAGAAGCTTCCCTGAAGGTAAGAGAAACTGTTACGACATAAGGCCTCAGCAAGGGAAAGGTTTCAAGTATCTGATTAGAACTCGTTTTATGTACGGGAACTATGATGGTTTTAGTAAAACACCTGAGTTTGATCTCTATATTGGAGCCAATCTTTGGGAATCTGTTGTTCTTATCAATGAAACGGCTATAATGACCAAAGAAATCATTTATACACCTCCATCAGACCATATTCATGTGTGTCTTGTTGATAAAAACAGAGGAACTCCTTTTCTCTCTGTCTTGGAAATAAGATTTTTGAAGAACGATACATATGACACTCCTTATGAAGCGCTTATGCTTGGTCGAAGATGGGATTTCGGCACAGCGACCAATCTTCAAATCAGGTACAAAGATGATTTCTATGATCGCATATGGATGCCTTATAAGTCTCCGTACCAGAAAACTTTGAATACATCCCTCACCATCGATGAAACTAACCACAACGGTTTCAGACCTGCTAGTATAGTCATGAGATCTGCGATAGCACCTGGAAACGAAAGCAATCCCTTGAAGTTTAACTGGGCACCAGATGATCCGAGGTCGAAGTTTTATATATACATGCACTTCGCTGAAGTTCGAGAGCTACAAAGAAACGAGACACGAGAATTCGATATATACATAAATGACGTTATACTTGCCGAGAATTTCCGTCCTTTTTATTTGTTTACAGACACACGCTCCACTGTAGATCCAGTTGGCAGAAAAATGAATGAAATTGTCCTTCAGAGAACTGGTGTATCGACCCTTCCACCGATCATCAACGCTATAGAGATCTATCAAATCAACGAGTTCCTTCAGTTACCAACAGATCAACAGGATGTTGATGCCATGACGAAGATTAAGTTCAAGTATAGAGTAAAGAAGAACTGGCAAGGAGACCCATGTGTTCCAGTGGACAATTCTTGGGAAGGTCTTGAATGTCTCCATAGTGATAATAATACTTCTCCAAAATCCATTGCTCTGAACTTATCCTCCAGTGGACTGACTGGCCAGATTGATCCAGCTTTCGCCAACCTAACATCAATAAATAAATTAGACTTATCAAACAACAGCTTAACAGGGAAAGTACCCGATTTCCTCGCCAGTTTACCAAACTTGACTGAATTAAACCTGGAAGGAAACAAGTTAACTGGTTCGATTCCAGCTAAACTGTTGGAGAAATCAAAAGATGGTTCTCTTTCGCTTAGATTTGGTGGAAACCCGGACCTTTGTCAGTCTCCCTCATGTCAAACAACAACGAAGAAGAAAATTGGTTACATCGTCCCAGTAGTAGCATCACTCGCAGGATTGCTCATTGTTTTGACCGCATTAGCTTTGATCTGGCATTTTAAAAAACGATCACGAAGAGGTACAATCTCAAACAAACCATTAGGTGTCAACACCGGACCATTGGACACAGCCAAAAGATACTTTATATACTCAGAAGTTGTGAATATCACAAACAACTTCGAGAGAGTTCTTGGTAAAGGAGGTTTTGGTAAAGTATACCATGGTTTCTTGAATGGAGATCAAGTAGCTGTGAAGATACTTTCCGAAGAGTCAACTCAAGGTTACAAAGAGTTTCGAGCAGAGGTTGAGCTTCTGATGAGAGTCCATCACACAAATTTGACATCTCTTATCGGATACTGCAATGAAGATAACCACATGGCACTTATCTACGAGTACATGGCTAATGGAAACTTAGGAGACTATTTGTCAGGAAAAAGTTCCTTAATCTTGAGCTGGGAAGAGAGATTACAGATATCATTGGATGCAGCACAAGGCCTCGAGTATCTCCATTACGGTTGCAAGCCTCCCATAGTTCACAGAGATGTGAAGCCGGCAAATATCTTACTGAACGAGAATCTTCAAGCCAAGATAGCTGACTTTGGTTTATCTAGAAGCTTCCCAGTCGAAGGTAGTAGTCAAGTCTCCACCGTTGTCGCTGGAACCATCGGTTACTTAGACCCTGAGTATTACGCAACGCGGCAAATGAACGAGAAGAGTGATGTTTACAGCTTCGGGGTGGTTCTTCTTGAAGTAATAACAGGAAAACCGGCAATTTGGCATTCAAGAACAGAGAGTGTGCATCTAAGTGATCAGGTTGGTTCAATGTTGGCGAATGGAGACATAAAAGGTATTGTGGATCAACGTCTGGGAGATAGATTTGAGGTTGGCTCGGCTTGGAAGATCACTGAACTAGCATTGGCTTGTGCGTCTGAGAGTTCAGAACAAAGACCGACAATGAGCCAAGTCGTTATGGAGCTGAAACAGAGTATCTTTGGGAGAGTGAACAATCGAAGTGACCATAAGGACCCTGTGAGAATGGTTACGATGAACCTCGATACTGAAATGGTTCCTCGGGCGAGGTAAAGATGGATATTTGTATCTTCATAAAACTATCAGTGTATTATCATCCCATCATTACCGTTACTATCAGTATCATTCAAAATCAGCCATGAATCATGTTAAATGCACTTG

SEQ ID NO: 1575 - DNA, 906 bp, Arabidopsis thaliana
  misc_feature (1)..(906): Ceres cDNA ID no. 12656703
  misc_feature (1)..(906): Also known as  Ceres CDNA ID no. 23659454
atggaagtcaacggcggggaaggaaaggtggagatgggatcgggactctaccctgactggtctgagttgactcgagaatgtcttcttgacatcttctcacggctaagccaggaacaaagatggattggaccgatgctggtcagcaagaactggatgaacgcatgctatgacccgacactaaacaccatcttcgacctcgaaactcggtttctgtcgttccctgagtcgatcaactggtggactcccgagtttgaggataaagtcgattcatttctccgatctgttgttgatcggagtgaaggaggtctcacagagattcggatcaggcattgtacagaacgctctctatcttacgccgccgagaggtgccctaatctagaggtactttggataaagaactgcccaaatgttacagatgcgtcaatggagaagatagctatgaactgtccaaatcttagagaacttgatataagctactcttatggcataactcacgagtctctgataacattggggaggagttgccaaaatttaaagattctgaaacggaatttgttgccccggctaggtcctagcctgccaacaatcgtcgcgccactagactatctggctacatttcctagatatgggaatatagaggctagaataattgggaaatacatgacacagctcaagcatttggagattcgatactccacattgactgctagaggacttgactcggtttgtaagggatgttcgaatctagagtacatggacttacgcggatgtatatcattgaccagaagtgatataaacactaatacgtcgggcttgaagaatttgacggagatcattaagccggatttcaatcctccgattgctgttttacgcgttccaagacctggtaatccaagagaggaatga

SEQ ID NO: 1576 - protein, 906 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGGAAGTCAACGGCGGGGAAGGAAAGGTGGAGATGGGATCGGGACTCTACCCTGACTGGTCTGAGTTGACTCGAGAATGTCTTCTTGACATCTTCTCACGGCTAAGCCAGGAACAAAGATGGATTGGACCGATGCTGGTCAGCAAGAACTGGATGAACGCATGCTATGACCCGACACTAAACACCATCTTCGACCTCGAAACTCGGTTTCTGTCGTTCCCTGAGTCGATCAACTGGTGGACTCCCGAGTTTGAGGATAAAGTCGATTCATTTCTCCGATCTGTTGTTGATCGGAGTGAAGGAGGTCTCACAGAGATTCGGATCAGGCATTGTACAGAACGCTCTCTATCTTACGCCGCCGAGAGGTGCCCTAATCTAGAGGTACTTTGGATAAAGAACTGCCCAAATGTTACAGATGCGTCAATGGAGAAGATAGCTATGAACTGTCCAAATCTTAGAGAACTTGATATAAGCTACTCTTATGGCATAACTCACGAGTCTCTGATAACATTGGGGAGGAGTTGCCAAAATTTAAAGATTCTGAAACGGAATTTGTTGCCCCGGCTAGGTCCTAGCCTGCCAACAATCGTCGCGCCACTAGACTATCTGGCTACATTTCCTAGATATGGGAATATAGAGGCTAGAATAATTGGGAAATACATGACACAGCTCAAGCATTTGGAGATTCGATACTCCACATTGACTGCTAGAGGACTTGACTCGGTTTGTAAGGGATGTTCGAATCTAGAGTACATGGACTTACGCGGATGTATATCATTGACCAGAAGTGATATAAACACTAATACGTCGGGCTTGAAGAATTTGACGGAGATCATTAAGCCGGATTTCAATCCTCCGATTGCTGTTTTACGCGTTCCAAGACCTGGTAATCCAAGAGAGGAATGA

SEQ ID NO: 1577 - DNA, 2459 bp, Arabidopsis thaliana
  misc_feature (1)..(2459): Ceres cDNA ID no. 12656710
  misc_feature (1)..(2459): Also known as  Ceres CDNA ID no. 23659454
atgctgctacggacagtatcgtccgccaccgccgagacaaccgccgcattgataagcaagaacacatatctcgatttcttcaaaagatcaacttctatatctcaccttgctcaaacccatgctcagatcattctccatggcttccgaaacgacatctcattgctcaccaagcttactcaacgactctccgacctcggcgccatttactacgcacgcgacattttcctctccgtccaaagacctgacgttttccttttcaacgtcctcatgcgtggcttctccgtcaacgaatcacctcactcttcgctctctgtgttcgctcatctaaggaaatccactgatctcaagcccaacagctccacctacgccttcgctatctcggctgcttctgggtttcgtgacgacagagctggccgtgttattcatggtcaagcggtcgttgatgggtgtgactcagaattgctgcttgggtctaacattgttaagatgtacttcaagttttggcgagtcgaagatgctaggaaggtgttcgacagaatgcctgagaaagacaccattttgtggaacacgatgatatctggctaccgaaagaatgaaatgtatgtggaatctattcaggttttcagggatttgatcaatgagagctgtacccgtttggacactacaactctgcttgatattcttcccgctgttgcagagttgcaggagctgagactcggcatgcaaatccatagtcttgctacaaaaactgggtgctactcccacgattatgttcttactggtttcatctcactatactcaaagtgtggaaagattaagatgggaagtgctctgtttcgtgagtttcgtaaaccagatatagtagcttacaatgcaatgattcatgggtacacatccaatggagagactgagctctctttaagcctgtttaaagagctgatgttatcaggagcaaggttgaggtcaagcacgttggtgagtctggtccctgtctctggtcatcttatgcttatatatgccattcatggttactgcttgaaatcgaatttcctgtctcatgcttctgtctcaaccgcgttaactacggtttatagtaaattgaatgagatagaatcagcccggaagctttttgatgagtctccggaaaaaagcttgccatcttggaatgcaatgatctcaggttacacccaaaacgggttgacagaggacgcgatatctctcttcagagaaatgcagaagtctgaattcagtccaaaccctgtcacaataacttgtattctatcagcttgtgcgcagttaggagctttaagtttggggaaatgggttcatgatttagtaaggagcacagattttgagtctagcatatatgtgtctactgctttgattggtatgtatgcaaagtgtggaagcattgcagaagcacgccgattgtttgacttgatgacaaagaagaatgaagttacatggaacacgatgatttctggttatggacttcatggacaaggacaagaagctctgaatattttctatgagatgttgaattccggtattacaccaacaccagtcactttcctctgcgttctttacgcttgtagtcatgctggcttggtcaaagaaggtgatgaaattttcaattccatgatccaccggtatggttttgaaccatcagtcaagcattacgcctgtatggttgatattcttggccgagcaggacacttacagagagcattgcagtttatagaggcaatgtcgattgagcctggttcttctgtgtgggaaacattgctaggagcttgtaggattcacaaagacacaaaccttgcccgaacagtctctgagaagctctttgagctagatccagacaatgtaggataccatgttttgctgtcgaatattcactcagctgatagaaactatccacaggctgctacggttagacaaactgcaaagaagaggaaactagccaaagctcctggatataccttaatagaaataggtgaaacgcctcatgtctttacctcaggtgatcagtcacatccacaggtaaaggaaatctatgagaagctggagaagcttgaagggaagatgagggaagctgggtaccaacccgagactgagttggccctgcatgatgtggaggaggaagaaagggagctgatggtgaaggttcacagcgagaggctagccattgcctttggactcatagctactgagccaggaactgaaatccggatcataaagaatcttcgagtctgtttagactgtcacaccgtaaccaaactcatctcaaagatcacagagagagtgattgttgtaagagatgccaaccgcttccatcacttcaaagacggtgtctgttcatgtggagattattggtagtgactcgtttttggcctcaacacaagtcatagtgtactcatcctgtaacattacctcactcataattgatttcttttttg

SEQ ID NO: 1578 - protein, 2459 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGCTGCTACGGACAGTATCGTCCGCCACCGCCGAGACAACCGCCGCATTGATAAGCAAGAACACATATCTCGATTTCTTCAAAAGATCAACTTCTATATCTCACCTTGCTCAAACCCATGCTCAGATCATTCTCCATGGCTTCCGAAACGACATCTCATTGCTCACCAAGCTTACTCAACGACTCTCCGACCTCGGCGCCATTTACTACGCACGCGACATTTTCCTCTCCGTCCAAAGACCTGACGTTTTCCTTTTCAACGTCCTCATGCGTGGCTTCTCCGTCAACGAATCACCTCACTCTTCGCTCTCTGTGTTCGCTCATCTAAGGAAATCCACTGATCTCAAGCCCAACAGCTCCACCTACGCCTTCGCTATCTCGGCTGCTTCTGGGTTTCGTGACGACAGAGCTGGCCGTGTTATTCATGGTCAAGCGGTCGTTGATGGGTGTGACTCAGAATTGCTGCTTGGGTCTAACATTGTTAAGATGTACTTCAAGTTTTGGCGAGTCGAAGATGCTAGGAAGGTGTTCGACAGAATGCCTGAGAAAGACACCATTTTGTGGAACACGATGATATCTGGCTACCGAAAGAATGAAATGTATGTGGAATCTATTCAGGTTTTCAGGGATTTGATCAATGAGAGCTGTACCCGTTTGGACACTACAACTCTGCTTGATATTCTTCCCGCTGTTGCAGAGTTGCAGGAGCTGAGACTCGGCATGCAAATCCATAGTCTTGCTACAAAAACTGGGTGCTACTCCCACGATTATGTTCTTACTGGTTTCATCTCACTATACTCAAAGTGTGGAAAGATTAAGATGGGAAGTGCTCTGTTTCGTGAGTTTCGTAAACCAGATATAGTAGCTTACAATGCAATGATTCATGGGTACACATCCAATGGAGAGACTGAGCTCTCTTTAAGCCTGTTTAAAGAGCTGATGTTATCAGGAGCAAGGTTGAGGTCAAGCACGTTGGTGAGTCTGGTCCCTGTCTCTGGTCATCTTATGCTTATATATGCCATTCATGGTTACTGCTTGAAATCGAATTTCCTGTCTCATGCTTCTGTCTCAACCGCGTTAACTACGGTTTATAGTAAATTGAATGAGATAGAATCAGCCCGGAAGCTTTTTGATGAGTCTCCGGAAAAAAGCTTGCCATCTTGGAATGCAATGATCTCAGGTTACACCCAAAACGGGTTGACAGAGGACGCGATATCTCTCTTCAGAGAAATGCAGAAGTCTGAATTCAGTCCAAACCCTGTCACAATAACTTGTATTCTATCAGCTTGTGCGCAGTTAGGAGCTTTAAGTTTGGGGAAATGGGTTCATGATTTAGTAAGGAGCACAGATTTTGAGTCTAGCATATATGTGTCTACTGCTTTGATTGGTATGTATGCAAAGTGTGGAAGCATTGCAGAAGCACGCCGATTGTTTGACTTGATGACAAAGAAGAATGAAGTTACATGGAACACGATGATTTCTGGTTATGGACTTCATGGACAAGGACAAGAAGCTCTGAATATTTTCTATGAGATGTTGAATTCCGGTATTACACCAACACCAGTCACTTTCCTCTGCGTTCTTTACGCTTGTAGTCATGCTGGCTTGGTCAAAGAAGGTGATGAAATTTTCAATTCCATGATCCACCGGTATGGTTTTGAACCATCAGTCAAGCATTACGCCTGTATGGTTGATATTCTTGGCCGAGCAGGACACTTACAGAGAGCATTGCAGTTTATAGAGGCAATGTCGATTGAGCCTGGTTCTTCTGTGTGGGAAACATTGCTAGGAGCTTGTAGGATTCACAAAGACACAAACCTTGCCCGAACAGTCTCTGAGAAGCTCTTTGAGCTAGATCCAGACAATGTAGGATACCATGTTTTGCTGTCGAATATTCACTCAGCTGATAGAAACTATCCACAGGCTGCTACGGTTAGACAAACTGCAAAGAAGAGGAAACTAGCCAAAGCTCCTGGATATACCTTAATAGAAATAGGTGAAACGCCTCATGTCTTTACCTCAGGTGATCAGTCACATCCACAGGTAAAGGAAATCTATGAGAAGCTGGAGAAGCTTGAAGGGAAGATGAGGGAAGCTGGGTACCAACCCGAGACTGAGTTGGCCCTGCATGATGTGGAGGAGGAAGAAAGGGAGCTGATGGTGAAGGTTCACAGCGAGAGGCTAGCCATTGCCTTTGGACTCATAGCTACTGAGCCAGGAACTGAAATCCGGATCATAAAGAATCTTCGAGTCTGTTTAGACTGTCACACCGTAACCAAACTCATCTCAAAGATCACAGAGAGAGTGATTGTTGTAAGAGATGCCAACCGCTTCCATCACTTCAAAGACGGTGTCTGTTCATGTGGAGATTATTGGTAGTGACTCGTTTTTGGCCTCAACACAAGTCATAGTGTACTCATCCTGTAACATTACCTCACTCATAATTGATTTCTTTTTTG

SEQ ID NO: 1579 - DNA, 1371 bp, Arabidopsis thaliana
  misc_feature (1)..(1371): Ceres cDNA ID no. 12657618
  misc_feature (1)..(1371): Also known as  Ceres CDNA ID no. 23659454
atggagaatctagatgaaatccgtaccgatattgtcgaatctactgctccgttgttgcaagaatcatcatcagagagcaacggaggaggagaattcaacggagcttcgtttagtggtgcggttttcaatctcgctacaacgatcatcggagctggtatcatggcattgcctgcgacgatgaagatcctcggtcttattcccggaatcacgatcatcgttctcatggctttcttaaccgatgcttcgattgagttcttgcttaggtttagtaacattgggaatcaaagatcttacggtggtgttatggatgattcttttggtaaatgtggaaggattatgttgcaagtttcgattctcgttagcaacattggtgttttgatcgtttatatgatcatcattggtgatgttttggctggtaagaatgaatatggaatccatcatgctggtatgcttgaaggatggtttgggattagttggtggaacagaagaacttttgttcttcttgttactactctcactgtctttgctccattgacttgcttcaaacgaattgattctttgagattcacatctgctatatcagttgctttagcggttgtttttcttgtcatcactgctggaattactatcattaagctgtttactgatggtttgatgatgccgagacttctacctaatgtcactgacttgtcgtcgttttggaaactcttcacggttgttcctgtgcttgtcaatgcatacatttgccattacaatgttcatagtatacagaacgagcttgaagacccttctcggataaaacctgttgttcgatcagcacttgcgatgtgttcttctgtttacgttatgacgagtttattcggatacctcttattcggtgatggtactcttgatgatgttcttgcaaactttgacacggatcttggaatcccttttggttcggttcttaatgatgcagtgagatttagctacgcagctcatctcatgcttgtgttccctgttgtcttctatcctctgcggattaacatcgacggtctcatctttcctacggctccaccacttacttcctctgagtctgatctgaggtttggctctattactgctggtctcattgctgtaatcttcttgggagcaaacttcataccaagcatttgggatgctttccaatttactggagcaactgctgctgtctgcatcggtttcatattccctgctgctgttatcttaaaggatcgtcataaccaagcaaccaagcgagacaagactatagccatttgcatgatcgtccttgcggttttctccaatgcaatcgccatttacagtgacgcctacgccttattcaagaagcacacatacgtatatccaatatga

SEQ ID NO: 1580 - protein, 1371 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGGAGAATCTAGATGAAATCCGTACCGATATTGTCGAATCTACTGCTCCGTTGTTGCAAGAATCATCATCAGAGAGCAACGGAGGAGGAGAATTCAACGGAGCTTCGTTTAGTGGTGCGGTTTTCAATCTCGCTACAACGATCATCGGAGCTGGTATCATGGCATTGCCTGCGACGATGAAGATCCTCGGTCTTATTCCCGGAATCACGATCATCGTTCTCATGGCTTTCTTAACCGATGCTTCGATTGAGTTCTTGCTTAGGTTTAGTAACATTGGGAATCAAAGATCTTACGGTGGTGTTATGGATGATTCTTTTGGTAAATGTGGAAGGATTATGTTGCAAGTTTCGATTCTCGTTAGCAACATTGGTGTTTTGATCGTTTATATGATCATCATTGGTGATGTTTTGGCTGGTAAGAATGAATATGGAATCCATCATGCTGGTATGCTTGAAGGATGGTTTGGGATTAGTTGGTGGAACAGAAGAACTTTTGTTCTTCTTGTTACTACTCTCACTGTCTTTGCTCCATTGACTTGCTTCAAACGAATTGATTCTTTGAGATTCACATCTGCTATATCAGTTGCTTTAGCGGTTGTTTTTCTTGTCATCACTGCTGGAATTACTATCATTAAGCTGTTTACTGATGGTTTGATGATGCCGAGACTTCTACCTAATGTCACTGACTTGTCGTCGTTTTGGAAACTCTTCACGGTTGTTCCTGTGCTTGTCAATGCATACATTTGCCATTACAATGTTCATAGTATACAGAACGAGCTTGAAGACCCTTCTCGGATAAAACCTGTTGTTCGATCAGCACTTGCGATGTGTTCTTCTGTTTACGTTATGACGAGTTTATTCGGATACCTCTTATTCGGTGATGGTACTCTTGATGATGTTCTTGCAAACTTTGACACGGATCTTGGAATCCCTTTTGGTTCGGTTCTTAATGATGCAGTGAGATTTAGCTACGCAGCTCATCTCATGCTTGTGTTCCCTGTTGTCTTCTATCCTCTGCGGATTAACATCGACGGTCTCATCTTTCCTACGGCTCCACCACTTACTTCCTCTGAGTCTGATCTGAGGTTTGGCTCTATTACTGCTGGTCTCATTGCTGTAATCTTCTTGGGAGCAAACTTCATACCAAGCATTTGGGATGCTTTCCAATTTACTGGAGCAACTGCTGCTGTCTGCATCGGTTTCATATTCCCTGCTGCTGTTATCTTAAAGGATCGTCATAACCAAGCAACCAAGCGAGACAAGACTATAGCCATTTGCATGATCGTCCTTGCGGTTTTCTCCAATGCAATCGCCATTTACAGTGACGCCTACGCCTTATTCAAGAAGCACACATACGTATATCCAATATGA

SEQ ID NO: 1581 - DNA, 1413 bp, Arabidopsis thaliana
  misc_feature (1)..(1413): Ceres cDNA ID no. 12657781
  misc_feature (1)..(1413): Also known as  Ceres CDNA ID no. 23659454
atgatgatgatgggcgattcatttggaagtataggctcaagcatggcaagtttgttctttctttgggcaacaatacaacaaatcttccctgaccacttgaagatcacaatcaaagagtttcttttgtcttcattccaacaactctgttttgctcaaagagtttccgatcatttcaccaacctcttctctccttatgtcgagatccactttccggaaagcgatgagtacagtttcaaccaagctttctcggccattgatacctaccttgactcaaaagcaaccgacaagaccaaacatcttagaggaagccaagtgaaagaaagcaaaggtttggtattgaaacgaaacgaggctaaagtcagagacgagtacaaaggagctaatgtctggtgggagagagtggttgataatgatggaaaccgatattataagctcacttttcacaaccgcgcaaggacccttataaccaattcatatataaaatatgtggttgaagaagggaaatctattatagtcaagaacaagcaaacaaggcttttcacgaataacttaagtacgcaatgggtttttggccaaaatatgtggagatctattgaatttgagcaccccgcgagttttcagacactagctatggatccaaagaagaaagaagagatcgtgaatgacctcatcgcctttagtaatggtaaggagtattacaagaagatagggaaagcttggaagagaggttatttgttgtacggaccaccaggaaccggtaagtcgaccatgatctcagctatggctaatcttctaaactataacatctatgatctcgaacttacggcggtaaagaacaactcggagttgaaaaaactgcttacagcaacatccagcaagtctattattgtgattgaagacatagattgctcagcagatttcacaagtaacagaatcaagaaagagagcaactcaagggaaagatatggaaaagaagataaagacgaaaactcggttacactctcaggtcttctcaacttcattgatggtatttggtcagcttgtggacaagaaaggattgttgtattcacaacaaaccacttggagaagcttgacccagctttgattaggagaggaagaatggatatgcacattgagttgtcttactgcacttacgaagcgttcaagattcttgccaagaattaccttgatcttgatggtgatgatgctcatcccttgtttagcgaaatcaaggctctgttggaggaaacaaagatttctccagctgatgtcgcggaaaatcttatggccagaaaccaacaaatcgacgttgataaatccttgaaccttctaatcagcgctctagaggaagagaaccaatatcagaggagccaacaagagaagaagaaaagcaagttcaaaatatttggttga

SEQ ID NO: 1582 - protein, 1413 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGATGATGATGGGCGATTCATTTGGAAGTATAGGCTCAAGCATGGCAAGTTTGTTCTTTCTTTGGGCAACAATACAACAAATCTTCCCTGACCACTTGAAGATCACAATCAAAGAGTTTCTTTTGTCTTCATTCCAACAACTCTGTTTTGCTCAAAGAGTTTCCGATCATTTCACCAACCTCTTCTCTCCTTATGTCGAGATCCACTTTCCGGAAAGCGATGAGTACAGTTTCAACCAAGCTTTCTCGGCCATTGATACCTACCTTGACTCAAAAGCAACCGACAAGACCAAACATCTTAGAGGAAGCCAAGTGAAAGAAAGCAAAGGTTTGGTATTGAAACGAAACGAGGCTAAAGTCAGAGACGAGTACAAAGGAGCTAATGTCTGGTGGGAGAGAGTGGTTGATAATGATGGAAACCGATATTATAAGCTCACTTTTCACAACCGCGCAAGGACCCTTATAACCAATTCATATATAAAATATGTGGTTGAAGAAGGGAAATCTATTATAGTCAAGAACAAGCAAACAAGGCTTTTCACGAATAACTTAAGTACGCAATGGGTTTTTGGCCAAAATATGTGGAGATCTATTGAATTTGAGCACCCCGCGAGTTTTCAGACACTAGCTATGGATCCAAAGAAGAAAGAAGAGATCGTGAATGACCTCATCGCCTTTAGTAATGGTAAGGAGTATTACAAGAAGATAGGGAAAGCTTGGAAGAGAGGTTATTTGTTGTACGGACCACCAGGAACCGGTAAGTCGACCATGATCTCAGCTATGGCTAATCTTCTAAACTATAACATCTATGATCTCGAACTTACGGCGGTAAAGAACAACTCGGAGTTGAAAAAACTGCTTACAGCAACATCCAGCAAGTCTATTATTGTGATTGAAGACATAGATTGCTCAGCAGATTTCACAAGTAACAGAATCAAGAAAGAGAGCAACTCAAGGGAAAGATATGGAAAAGAAGATAAAGACGAAAACTCGGTTACACTCTCAGGTCTTCTCAACTTCATTGATGGTATTTGGTCAGCTTGTGGACAAGAAAGGATTGTTGTATTCACAACAAACCACTTGGAGAAGCTTGACCCAGCTTTGATTAGGAGAGGAAGAATGGATATGCACATTGAGTTGTCTTACTGCACTTACGAAGCGTTCAAGATTCTTGCCAAGAATTACCTTGATCTTGATGGTGATGATGCTCATCCCTTGTTTAGCGAAATCAAGGCTCTGTTGGAGGAAACAAAGATTTCTCCAGCTGATGTCGCGGAAAATCTTATGGCCAGAAACCAACAAATCGACGTTGATAAATCCTTGAACCTTCTAATCAGCGCTCTAGAGGAAGAGAACCAATATCAGAGGAGCCAACAAGAGAAGAAGAAAAGCAAGTTCAAAATATTTGGTTGA

SEQ ID NO: 1583 - DNA, 1545 bp, Arabidopsis thaliana
  misc_feature (1)..(1545): Ceres cDNA ID no. 12657785
  misc_feature (1)..(1545): Also known as  Ceres CDNA ID no. 23659454
atggtgaaaatgggtgaagtatggactaatacgggctctgctctcgcaagtttagtgtttatatacacaatcttcgaaagattcttcccttaccgtctcagagagcacttcgaaccattagctcagagcctcatcggttttatctacccttatattcagataacgttccatgaatatagcggtgagcggttcaagcgaagcgatgtctatgacgcgatccagagctatcttagcaaagactcttcttctcgagccaagaaactaacagcaaacacaatcaaaggaaataaatctattatccttagcatggacgaccacgaagagatcactgatgagtttcaaggggtcaaagtttggtggcaatctaagaagcatcaaagtgaaagccgggcgatctccttttaccctaaagccgacgagtcaagattctacatgcttaagtttcatagacgtgacagggaagtaatcacaaagaaatatcttaatcatgttattagtgaaggcaagacaattgaggttaagaacagagaaaggaagctttattcaaataatcctagccagaattggtctggctataagcaaacgaagtggagccacgtcactttcgagcatcctgctacatttgatacacttgctatggaatataagaagaaggaagagatcaagaacgatttgatcaagtttagtaatagcaaagattactacaagaagatcgggaaagcgtggaaacgagggtatctcttgtttggtccaccaggaaccggaaaatcaacaatgatcgctgcgatggcgaatctcttggagtatgatgtttatgatcttgaattgacaacagtcaaggataacacagagctgagaaggttgttgattgagacttcagggaaatcgataattgttattgaagatatcgattgttctcttgacctaactggtcagagaaagcagaagaaggacgaggaggaagacgaagatgagactagcccgattgagaagcagatgaagaaagatcaaggtgagaataaaggaagtaaagtgacattatcagggttactgaatttcattgatgggttatggtcagcttgtggtggtgagaggatcattgtgttcactactaatttcatagataagttagatccggctttgattcgaaaaggaagaatggataagcatatagagatgtcctactgcggttttgaagcgtttaaagtgttggcaaacaattacttggatgctaaggaagaagatgataatgagttgtttgatgagatcaagaggttacttgaggtagaagaaataaagatgactcctgctgatgtgggagagaatctgttgaagaaatcagaagttgagactaaggagatttgtttgaagcgattgattgaagcgttgaaggaggagaaagaggaagcgaagaggaggattgaggatgaggagaagaagaagaaagaagaggaagagattaagaggaagaagagagaggagaagaagataaagaaggaagagaaggaagagaaggaagaaaatgaaacaacgatgaaagattaa

SEQ ID NO: 1584 - protein, 1545 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGGTGAAAATGGGTGAAGTATGGACTAATACGGGCTCTGCTCTCGCAAGTTTAGTGTTTATATACACAATCTTCGAAAGATTCTTCCCTTACCGTCTCAGAGAGCACTTCGAACCATTAGCTCAGAGCCTCATCGGTTTTATCTACCCTTATATTCAGATAACGTTCCATGAATATAGCGGTGAGCGGTTCAAGCGAAGCGATGTCTATGACGCGATCCAGAGCTATCTTAGCAAAGACTCTTCTTCTCGAGCCAAGAAACTAACAGCAAACACAATCAAAGGAAATAAATCTATTATCCTTAGCATGGACGACCACGAAGAGATCACTGATGAGTTTCAAGGGGTCAAAGTTTGGTGGCAATCTAAGAAGCATCAAAGTGAAAGCCGGGCGATCTCCTTTTACCCTAAAGCCGACGAGTCAAGATTCTACATGCTTAAGTTTCATAGACGTGACAGGGAAGTAATCACAAAGAAATATCTTAATCATGTTATTAGTGAAGGCAAGACAATTGAGGTTAAGAACAGAGAAAGGAAGCTTTATTCAAATAATCCTAGCCAGAATTGGTCTGGCTATAAGCAAACGAAGTGGAGCCACGTCACTTTCGAGCATCCTGCTACATTTGATACACTTGCTATGGAATATAAGAAGAAGGAAGAGATCAAGAACGATTTGATCAAGTTTAGTAATAGCAAAGATTACTACAAGAAGATCGGGAAAGCGTGGAAACGAGGGTATCTCTTGTTTGGTCCACCAGGAACCGGAAAATCAACAATGATCGCTGCGATGGCGAATCTCTTGGAGTATGATGTTTATGATCTTGAATTGACAACAGTCAAGGATAACACAGAGCTGAGAAGGTTGTTGATTGAGACTTCAGGGAAATCGATAATTGTTATTGAAGATATCGATTGTTCTCTTGACCTAACTGGTCAGAGAAAGCAGAAGAAGGACGAGGAGGAAGACGAAGATGAGACTAGCCCGATTGAGAAGCAGATGAAGAAAGATCAAGGTGAGAATAAAGGAAGTAAAGTGACATTATCAGGGTTACTGAATTTCATTGATGGGTTATGGTCAGCTTGTGGTGGTGAGAGGATCATTGTGTTCACTACTAATTTCATAGATAAGTTAGATCCGGCTTTGATTCGAAAAGGAAGAATGGATAAGCATATAGAGATGTCCTACTGCGGTTTTGAAGCGTTTAAAGTGTTGGCAAACAATTACTTGGATGCTAAGGAAGAAGATGATAATGAGTTGTTTGATGAGATCAAGAGGTTACTTGAGGTAGAAGAAATAAAGATGACTCCTGCTGATGTGGGAGAGAATCTGTTGAAGAAATCAGAAGTTGAGACTAAGGAGATTTGTTTGAAGCGATTGATTGAAGCGTTGAAGGAGGAGAAAGAGGAAGCGAAGAGGAGGATTGAGGATGAGGAGAAGAAGAAGAAAGAAGAGGAAGAGATTAAGAGGAAGAAGAGAGAGGAGAAGAAGATAAAGAAGGAAGAGAAGGAAGAGAAGGAAGAAAATGAAACAACGATGAAAGATTAA

SEQ ID NO: 1585 - DNA, 1058 bp, Arabidopsis thaliana
  misc_feature (1)..(1058): Ceres cDNA ID no. 12657971
  misc_feature (1)..(1058): Also known as  Ceres CDNA ID no. 23659454
atagaaaatcgtgtcgaccttttttctctcacttacccaataagagcttttttcgcgttttccaccgcaaccaccgtcaccttcaaccgccggagccgccgcaaggaaggctcatcatccgccgtggcaattttttgaggtgtacaaagcattgcctatttgacgaaccaggaaatggttaaaaggcatggagagttttgatttacaagatatatcatgtcgcagtgcatagacggtttcaagcatgtatgctcctcttttttccggtgttttgatatcgatatttacaaacaatctggaggccttggtgaccctgaacttcttgcgagagagacagtttttagcgtgagtgaaatagaggctctctatgagctgtttaagaaaatcagcagtgctgtgattgatgatgggctaataaacaaggaagaatttcagttagccttgttcaagacaaataaaaaagagagcttgtttgcagaccgggtattcgatttgtttgacacaaagcataatggaatactggggtttgaggagtttgcgcgtgctctctctgtctttcatccaaatgctcccatagaagacaagattgacttttcgtttcagctatatgatcttaagcagcaaggtttcatagagaggcaagaggtgaagcaaatggtggtggctactcttgctgagtccggcatgaacctgtcagacgaaatcatagagagtataatcgacaagacatttgaggaagctgatacaaaacatgacgggaggatcgataaggaagagtggagaacccttgttctcaggcatccttcccttctaaagaatatgactctccagtatcttaaggatataacaactacatttccgagctttgtgttccactcgcaggtggaagatacctgagaaaaacaatagcatattagcagaggagacaatttgggaattgtgtttgttttctgattatgtatcatgtctatttgtttcaatctctctgaacattttcaagattttgttgttacttgtgtgaattaaaagtaaagaaaacaaatctgtatttttgctac

SEQ ID NO: 1586 - protein, 1058 aa, Arabidopsis thaliana
  misc_feature: GI Number: 34905882; NR Description: P0458E05.17 [Oryza sativa (japonica cultivar-group)] >gi|21902069|dbj|BAC05617.1|
ATAGAAAATCGTGTCGACCTTTTTTCTCTCACTTACCCAATAAGAGCTTTTTTCGCGTTTTCCACCGCAACCACCGTCACCTTCAACCGCCGGAGCCGCCGCAAGGAAGGCTCATCATCCGCCGTGGCAATTTTTTGAGGTGTACAAAGCATTGCCTATTTGACGAACCAGGAAATGGTTAAAAGGCATGGAGAGTTTTGATTTACAAGATATATCATGTCGCAGTGCATAGACGGTTTCAAGCATGTATGCTCCTCTTTTTTCCGGTGTTTTGATATCGATATTTACAAACAATCTGGAGGCCTTGGTGACCCTGAACTTCTTGCGAGAGAGACAGTTTTTAGCGTGAGTGAAATAGAGGCTCTCTATGAGCTGTTTAAGAAAATCAGCAGTGCTGTGATTGATGATGGGCTAATAAACAAGGAAGAATTTCAGTTAGCCTTGTTCAAGACAAATAAAAAAGAGAGCTTGTTTGCAGACCGGGTATTCGATTTGTTTGACACAAAGCATAATGGAATACTGGGGTTTGAGGAGTTTGCGCGTGCTCTCTCTGTCTTTCATCCAAATGCTCCCATAGAAGACAAGATTGACTTTTCGTTTCAGCTATATGATCTTAAGCAGCAAGGTTTCATAGAGAGGCAAGAGGTGAAGCAAATGGTGGTGGCTACTCTTGCTGAGTCCGGCATGAACCTGTCAGACGAAATCATAGAGAGTATAATCGACAAGACATTTGAGGAAGCTGATACAAAACATGACGGGAGGATCGATAAGGAAGAGTGGAGAACCCTTGTTCTCAGGCATCCTTCCCTTCTAAAGAATATGACTCTCCAGTATCTTAAGGATATAACAACTACATTTCCGAGCTTTGTGTTCCACTCGCAGGTGGAAGATACCTGAGAAAAACAATAGCATATTAGCAGAGGAGACAATTTGGGAATTGTGTTTGTTTTCTGATTATGTATCATGTCTATTTGTTTCAATCTCTCTGAACATTTTCAAGATTTTGTTGTTACTTGTGTGAATTAAAAGTAAAGAAAACAAATCTGTATTTTTGCTAC

SEQ ID NO: 1587 - DNA, 1710 bp, Arabidopsis thaliana
  misc_feature (1)..(1710): Ceres cDNA ID no. 12658234
  misc_feature (1)..(1710): Also known as  Ceres CDNA ID no. 23659454
atggctaatatagtttggtgtaacattgccatgttcttgttggtctcgttgtttctcactgacgatgctgttgttgttcttgatgccttggacaacgttcccaataatatcaagaaccaaccttaccgaaccggttatcatttccagcctcccaaaaattggatgaacgggcctatgatatacaaaggaatctatcatctattctatcaatggaaccaaaacggcgccgtcatggacgttaacaaaaccgtatggggccatgcaacatcaacggatctaatcaactggatcacactttctccagcaatcagaccatctcgaccgtccgatattaacggatgctggtccggctccgtcacgattctccctaatggcaaacctgtaattctttacaccggcaacgaccgttataaccgccaggtccaaaacttagttaaacctaaaaacctcaccgatccatatctacggcactggaccaaatcgccggaaaatcccctcgtgacacctagccccgtcaaccacatcaactccagcgcgtttcgtgatccaaccaccgcgtggtttggccgtgacgggcgttggcgcataaccaccggaagccaagaaggtcgacgtggattagcgattctacacacgagcaaagatttcgtaatatggaagcaatctccaaagcctcttcattaccacgacggtaccggaatgtgggagtgccctgattttttcccggtggctagaactgattcacggggcctagatacgtctttttcaagtgggccgatggttaaacacgtccttaaagtgagcttaacagatacgtttaatgattactacacgattggtacgtacgatgaagtgagagatgtctacgtaccggacaagggttttgttcaggacgaaacggctccgagatatgattacggcaaattttatgcgtcgaaaacattttacgactctgttaatcagcgcaggattttgtggggttgggttaacgagtcgtcaccggagaaagataacatcaagaagggttgggccggtttacaggctattcctaggaaagtatggcttgatgaatcaggaaagagattggtgcaatggccggttaaggaaatagagaggttacgtacaacgcaagtcaagtggggaaacaaactattgaaaggagggtcggtaatggaggttcatggagtcacagctccacaagcagatgtggaagttttcttcaaagtgagtggttttgacttagagaaagcagatgtgattgaaccgggctggaccgatccgcaattgatctgcagtcagaggaatgcgtcatcaggtttaggtccattcggtttaatggttctagcttccaagaacatggaagagtatacatcggtcaatatcagaatcttcagagctggtgagaatagtaaggagcacgtagtggtcatgtgcagtgaccaaagcacatcaagtttagagaaagggaatgataaaacaacttatggtgcttttttagatatctctccttatcaaccaatctctctcaggactttgattgataaatcaatagtggagagctttggtgggaaagggaaaacatgtattacctcgagagtttatccaaaattggcaataggagaaagaacacatctctttgcttttaacaagggatctcaaaatgttaatgttttaagcctaagtgcttggagcatgaagtcttctctttaa

SEQ ID NO: 1588 - protein, 1710 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGGCTAATATAGTTTGGTGTAACATTGCCATGTTCTTGTTGGTCTCGTTGTTTCTCACTGACGATGCTGTTGTTGTTCTTGATGCCTTGGACAACGTTCCCAATAATATCAAGAACCAACCTTACCGAACCGGTTATCATTTCCAGCCTCCCAAAAATTGGATGAACGGGCCTATGATATACAAAGGAATCTATCATCTATTCTATCAATGGAACCAAAACGGCGCCGTCATGGACGTTAACAAAACCGTATGGGGCCATGCAACATCAACGGATCTAATCAACTGGATCACACTTTCTCCAGCAATCAGACCATCTCGACCGTCCGATATTAACGGATGCTGGTCCGGCTCCGTCACGATTCTCCCTAATGGCAAACCTGTAATTCTTTACACCGGCAACGACCGTTATAACCGCCAGGTCCAAAACTTAGTTAAACCTAAAAACCTCACCGATCCATATCTACGGCACTGGACCAAATCGCCGGAAAATCCCCTCGTGACACCTAGCCCCGTCAACCACATCAACTCCAGCGCGTTTCGTGATCCAACCACCGCGTGGTTTGGCCGTGACGGGCGTTGGCGCATAACCACCGGAAGCCAAGAAGGTCGACGTGGATTAGCGATTCTACACACGAGCAAAGATTTCGTAATATGGAAGCAATCTCCAAAGCCTCTTCATTACCACGACGGTACCGGAATGTGGGAGTGCCCTGATTTTTTCCCGGTGGCTAGAACTGATTCACGGGGCCTAGATACGTCTTTTTCAAGTGGGCCGATGGTTAAACACGTCCTTAAAGTGAGCTTAACAGATACGTTTAATGATTACTACACGATTGGTACGTACGATGAAGTGAGAGATGTCTACGTACCGGACAAGGGTTTTGTTCAGGACGAAACGGCTCCGAGATATGATTACGGCAAATTTTATGCGTCGAAAACATTTTACGACTCTGTTAATCAGCGCAGGATTTTGTGGGGTTGGGTTAACGAGTCGTCACCGGAGAAAGATAACATCAAGAAGGGTTGGGCCGGTTTACAGGCTATTCCTAGGAAAGTATGGCTTGATGAATCAGGAAAGAGATTGGTGCAATGGCCGGTTAAGGAAATAGAGAGGTTACGTACAACGCAAGTCAAGTGGGGAAACAAACTATTGAAAGGAGGGTCGGTAATGGAGGTTCATGGAGTCACAGCTCCACAAGCAGATGTGGAAGTTTTCTTCAAAGTGAGTGGTTTTGACTTAGAGAAAGCAGATGTGATTGAACCGGGCTGGACCGATCCGCAATTGATCTGCAGTCAGAGGAATGCGTCATCAGGTTTAGGTCCATTCGGTTTAATGGTTCTAGCTTCCAAGAACATGGAAGAGTATACATCGGTCAATATCAGAATCTTCAGAGCTGGTGAGAATAGTAAGGAGCACGTAGTGGTCATGTGCAGTGACCAAAGCACATCAAGTTTAGAGAAAGGGAATGATAAAACAACTTATGGTGCTTTTTTAGATATCTCTCCTTATCAACCAATCTCTCTCAGGACTTTGATTGATAAATCAATAGTGGAGAGCTTTGGTGGGAAAGGGAAAACATGTATTACCTCGAGAGTTTATCCAAAATTGGCAATAGGAGAAAGAACACATCTCTTTGCTTTTAACAAGGGATCTCAAAATGTTAATGTTTTAAGCCTAAGTGCTTGGAGCATGAAGTCTTCTCTTTAA

SEQ ID NO: 1589 - DNA, 1955 bp, Arabidopsis thaliana
  misc_feature (1)..(1955): Ceres cDNA ID no. 12658238
  misc_feature (1)..(1955): Also known as  Ceres CDNA ID no. 23659454
aagccacaaagaaattaaatacacacaatgaccaaagaagtttgctccaacattggactttggttattgctcacgttacttattggtaactatgtcgtcaatcttgaagcctcgcaccatgtctacaagagacttacccaaagcactaacaccaaatctccttccgtaaaccagccctaccggaccggtttccatttccaaccccccaaaaattggatgaacgatcctaatgggcctatgatatacaaaggaatatatcatcttttctaccaatggaacccgaaaggagccgtgtggggtaacatcgtgtgggctcattccacgtcaacagacttaatcaattgggatccacatcctccagctatcttcccatctgcacccttcgatatcaacggatgctggtccggttcagctactattctccctaatggaaaaccggttatcctctataccggaatcgaccctaagaaccaacaggtccaaaacatagccgagcctaagaatctctccgatccttatctccgagaatggaaaaagtcgccgttaaatcctctcatggctcctgacgccgttaacggaatcaacgccagctcgttccgtgacccaaccaccgcgtggctaggccaagacaagaaatggagagtgatcatcggaagcaagattcaccgtcgtggactagccattacttacacgagtaaagactttctaaaatgggaaaaatctccagagccgttgcattacgacgacggaagtggaatgtgggaatgtcctgattttttcccggtcacgaggtttggttctaacggcgtggaaacgtcttcgtttggtgaacctaatgagattttgaagcacgtgttgaaaataagtttggacgacacgaaacatgattattacacgattggtacgtacgatcgggttaaagataaattcgtaccggacaatggtttcaagatggacggtacggctccgagatacgattacggaaagtattacgcgtctaaaacgttttttgactcggctaagaaccggagaatcttgtggggttggactaacgagtcatcgtcggttgaggatgatgttgagaaaggctggtccggtattcagacgattccaaggaaaatatggcttgatagatcagggaaacaattaattcagtggccggttagggaagttgaaagattacgtacaaaacaagtcaaaaacttacgcaacaaagttctaaagtcaggatctaggcttgaagtctatggtgtgacagctgcacaggcggatgtagaagtattgttcaaagtgagagacttggagaaagcggatgtgatagaaccaagttggactgatccgcagttgatttgtagcaagatgaatgtatcggttaagtctggtttaggtccattcggtttaatggttttggcatctaagaatttggaagagtacacatctgtttattttagaatcttcaaagcccgtcaaaacagcaataagtacgttgtgctcatgtgcagtgaccaaagcagatcttcgctgaaggaagataatgacaaaacgacatacggagcttttgtggatattaatcctcaccaaccactatccctcagagccttgattgatcattcagtagtggagagtttcggtggaaagggaagagcatgcattacctcaagagtgtatccaaaattggcaataggaaaaagttcacatctctttgcttttaattatggatatcaaagtgttgatgtcttaaacttaaatgcttggagcatgaactctgcccaaatcagttgatcacgtaaagatacacacatgtaaacacattacatctccattgatttagcatttatatgagttgattttggagagatcttatatggtccactttgtttggttgtcaataaaattgtccaatttgtttgtttgaaataattctaaaaggctaatatatatgacattttatttga

SEQ ID NO: 1590 - protein, 1955 aa, Arabidopsis thaliana
  misc_feature: GI Number: 34905882; NR Description: P0458E05.17 [Oryza sativa (japonica cultivar-group)] >gi|21902069|dbj|BAC05617.1|
AAGCCACAAAGAAATTAAATACACACAATGACCAAAGAAGTTTGCTCCAACATTGGACTTTGGTTATTGCTCACGTTACTTATTGGTAACTATGTCGTCAATCTTGAAGCCTCGCACCATGTCTACAAGAGACTTACCCAAAGCACTAACACCAAATCTCCTTCCGTAAACCAGCCCTACCGGACCGGTTTCCATTTCCAACCCCCCAAAAATTGGATGAACGATCCTAATGGGCCTATGATATACAAAGGAATATATCATCTTTTCTACCAATGGAACCCGAAAGGAGCCGTGTGGGGTAACATCGTGTGGGCTCATTCCACGTCAACAGACTTAATCAATTGGGATCCACATCCTCCAGCTATCTTCCCATCTGCACCCTTCGATATCAACGGATGCTGGTCCGGTTCAGCTACTATTCTCCCTAATGGAAAACCGGTTATCCTCTATACCGGAATCGACCCTAAGAACCAACAGGTCCAAAACATAGCCGAGCCTAAGAATCTCTCCGATCCTTATCTCCGAGAATGGAAAAAGTCGCCGTTAAATCCTCTCATGGCTCCTGACGCCGTTAACGGAATCAACGCCAGCTCGTTCCGTGACCCAACCACCGCGTGGCTAGGCCAAGACAAGAAATGGAGAGTGATCATCGGAAGCAAGATTCACCGTCGTGGACTAGCCATTACTTACACGAGTAAAGACTTTCTAAAATGGGAAAAATCTCCAGAGCCGTTGCATTACGACGACGGAAGTGGAATGTGGGAATGTCCTGATTTTTTCCCGGTCACGAGGTTTGGTTCTAACGGCGTGGAAACGTCTTCGTTTGGTGAACCTAATGAGATTTTGAAGCACGTGTTGAAAATAAGTTTGGACGACACGAAACATGATTATTACACGATTGGTACGTACGATCGGGTTAAAGATAAATTCGTACCGGACAATGGTTTCAAGATGGACGGTACGGCTCCGAGATACGATTACGGAAAGTATTACGCGTCTAAAACGTTTTTTGACTCGGCTAAGAACCGGAGAATCTTGTGGGGTTGGACTAACGAGTCATCGTCGGTTGAGGATGATGTTGAGAAAGGCTGGTCCGGTATTCAGACGATTCCAAGGAAAATATGGCTTGATAGATCAGGGAAACAATTAATTCAGTGGCCGGTTAGGGAAGTTGAAAGATTACGTACAAAACAAGTCAAAAACTTACGCAACAAAGTTCTAAAGTCAGGATCTAGGCTTGAAGTCTATGGTGTGACAGCTGCACAGGCGGATGTAGAAGTATTGTTCAAAGTGAGAGACTTGGAGAAAGCGGATGTGATAGAACCAAGTTGGACTGATCCGCAGTTGATTTGTAGCAAGATGAATGTATCGGTTAAGTCTGGTTTAGGTCCATTCGGTTTAATGGTTTTGGCATCTAAGAATTTGGAAGAGTACACATCTGTTTATTTTAGAATCTTCAAAGCCCGTCAAAACAGCAATAAGTACGTTGTGCTCATGTGCAGTGACCAAAGCAGATCTTCGCTGAAGGAAGATAATGACAAAACGACATACGGAGCTTTTGTGGATATTAATCCTCACCAACCACTATCCCTCAGAGCCTTGATTGATCATTCAGTAGTGGAGAGTTTCGGTGGAAAGGGAAGAGCATGCATTACCTCAAGAGTGTATCCAAAATTGGCAATAGGAAAAAGTTCACATCTCTTTGCTTTTAATTATGGATATCAAAGTGTTGATGTCTTAAACTTAAATGCTTGGAGCATGAACTCTGCCCAAATCAGTTGATCACGTAAAGATACACACATGTAAACACATTACATCTCCATTGATTTAGCATTTATATGAGTTGATTTTGGAGAGATCTTATATGGTCCACTTTGTTTGGTTGTCAATAAAATTGTCCAATTTGTTTGTTTGAAATAATTCTAAAAGGCTAATATATATGACATTTTATTTGA

SEQ ID NO: 1591 - DNA, 984 bp, Arabidopsis thaliana
  misc_feature (1)..(984): Ceres cDNA ID no. 12658352
  misc_feature (1)..(984): Also known as  Ceres CDNA ID no. 23659454
atggctacggtcactgagatgcccactgatgttgttgttgtcgacgatgttaaggaagttagtaccaaaagcgaaaagatcatcgatgagggaattgagaagagctcgatcacggattctaaaaccgaaactgaatctcggcttgatatgcacaagcttgtggctatgttcaagaaactgaatcctttggccaaggagtttttcccttcttactacgatccgaagaagaacaatcaggtagctaaggctaaccaatttctgccggctgacgattttgagaccaccaagaagcaatctggtgaagaatttgatcttgatgccaagaaggatgacaatacccgcaagagaagaaactatagccaagggagaaggaggttaactggaagaatttctaaggctcaaagagaggatagtattagaagaacagtttatgtttctgacattgaccagagtgtgactgaggagggtcttgctggcttgtttagtaactgtggacaagttgttgactgtagaatttgtggcgatccacattcggttcttcgatttgcgtttgttgagtttgctgatgaccagggcgcacatgaagctttaagccttggtggaacaatgctcgggttctacccggtgagggtcttaccctcaaaaactgccatcctaccagtgaatcccacatttcttccaaggtcagaagatgaaagggagatgtgcacaaggacaatctattgcaccaacatcgacaagaaagtttctcaagctgatgtgagaaacttctttgaatctgcatgtggtgaggtaactcgtctgaggcttcttggcgatcaattgcattcaactcgcatagcttttgttgaatttgctctggcagatagtgcacttagcgcgctcaattgcagcggaatggtcgttggatcacaaccgataagggtaagtccatcaaagacaccagtgaggccaagaatcactcgaccaccatcgacaaactag

SEQ ID NO: 1592 - protein, 984 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGGCTACGGTCACTGAGATGCCCACTGATGTTGTTGTTGTCGACGATGTTAAGGAAGTTAGTACCAAAAGCGAAAAGATCATCGATGAGGGAATTGAGAAGAGCTCGATCACGGATTCTAAAACCGAAACTGAATCTCGGCTTGATATGCACAAGCTTGTGGCTATGTTCAAGAAACTGAATCCTTTGGCCAAGGAGTTTTTCCCTTCTTACTACGATCCGAAGAAGAACAATCAGGTAGCTAAGGCTAACCAATTTCTGCCGGCTGACGATTTTGAGACCACCAAGAAGCAATCTGGTGAAGAATTTGATCTTGATGCCAAGAAGGATGACAATACCCGCAAGAGAAGAAACTATAGCCAAGGGAGAAGGAGGTTAACTGGAAGAATTTCTAAGGCTCAAAGAGAGGATAGTATTAGAAGAACAGTTTATGTTTCTGACATTGACCAGAGTGTGACTGAGGAGGGTCTTGCTGGCTTGTTTAGTAACTGTGGACAAGTTGTTGACTGTAGAATTTGTGGCGATCCACATTCGGTTCTTCGATTTGCGTTTGTTGAGTTTGCTGATGACCAGGGCGCACATGAAGCTTTAAGCCTTGGTGGAACAATGCTCGGGTTCTACCCGGTGAGGGTCTTACCCTCAAAAACTGCCATCCTACCAGTGAATCCCACATTTCTTCCAAGGTCAGAAGATGAAAGGGAGATGTGCACAAGGACAATCTATTGCACCAACATCGACAAGAAAGTTTCTCAAGCTGATGTGAGAAACTTCTTTGAATCTGCATGTGGTGAGGTAACTCGTCTGAGGCTTCTTGGCGATCAATTGCATTCAACTCGCATAGCTTTTGTTGAATTTGCTCTGGCAGATAGTGCACTTAGCGCGCTCAATTGCAGCGGAATGGTCGTTGGATCACAACCGATAAGGGTAAGTCCATCAAAGACACCAGTGAGGCCAAGAATCACTCGACCACCATCGACAAACTAG

SEQ ID NO: 1593 - DNA, 1255 bp, Arabidopsis thaliana
  misc_feature (1)..(1255): Ceres cDNA ID no. 12658563
  misc_feature (1)..(1255): Also known as  Ceres CDNA ID no. 23659454
acaaagaaaactgaacaaaatttgaagagttattaaaatggggtgtacatcttccaagcaagcaaaagctaacgtcgtcgccgacgtttacaaaccaccgccgtctagtttcgcggtgtttgatgtcaacgccatccaagagccatggctaaaatttgaacatgaagatgatgagaaaccgccacgctccaccgtcttcgaccgtctcgacgaggatgatgatgatgatgatgatgatggtgatgacgctcctaaaacatgggaagaagtcagcaaatctctagaaactaaacttaaacctgccgccgttaaaccgccggaagtagactctgttaaacctccggcgactcctccacggcggcttccgcggaagagcgcatcgttccacacactggacgagcttgaagtgagggccaaaagaagcatcgccgcgcaaatcccgacgacaatggttaagcttaagagaaccgagtcgatgtccaagctaagacccgagtcagatgatcgaaccgagtccactcagtcgtcctactcggggcctcggtcagtgaaggagaacatattcgtcaagagagacagagaacggagggagaaagaagggaacaagaagccggtgatgaactgggacccacttagggagttcccggagaagtgtccgccgggaggaggggaaggtttgattgtctacacgacgtcgttgcaaggagtgcgtcgcacgtacgaggattgtatgcgtgtgagggccatcatggagcagcaaggagttgtggtggacgagagggacgtgtctttagacgccggagtcttgagcgagcttaaggagcttctccaagacgaagcatcagtggcgccgccgcgagtgtttgtgaaagggaggtacttgggaggagcagcggaagtgacagcgatgaatgagaacgggaagttagggagggtgttgcggtgggcacgtgtggagagagtaggggaggaagggaggctcacgtgtgaagggtgcggaggagcgaggtggttgccttgtttcgagtgcggcggaagctgtaaggtggcggcggttggggcggccaaaggtgaaaggtgggagaggtgtgtcaagtgtaatgagaatggattgattcgttgtcccgtgtgttttgttaattaagaacattattagtttacacaagcaaatagaggtgtgtcaaatatactttgtcccgtttgttttgttatatgtatgtgacacgtttgattttgtggaattgaaaatgatttg

SEQ ID NO: 1594 - protein, 1255 aa, Arabidopsis thaliana
  misc_feature: GI Number: 34905882; NR Description: P0458E05.17 [Oryza sativa (japonica cultivar-group)] >gi|21902069|dbj|BAC05617.1|
ACAAAGAAAACTGAACAAAATTTGAAGAGTTATTAAAATGGGGTGTACATCTTCCAAGCAAGCAAAAGCTAACGTCGTCGCCGACGTTTACAAACCACCGCCGTCTAGTTTCGCGGTGTTTGATGTCAACGCCATCCAAGAGCCATGGCTAAAATTTGAACATGAAGATGATGAGAAACCGCCACGCTCCACCGTCTTCGACCGTCTCGACGAGGATGATGATGATGATGATGATGATGGTGATGACGCTCCTAAAACATGGGAAGAAGTCAGCAAATCTCTAGAAACTAAACTTAAACCTGCCGCCGTTAAACCGCCGGAAGTAGACTCTGTTAAACCTCCGGCGACTCCTCCACGGCGGCTTCCGCGGAAGAGCGCATCGTTCCACACACTGGACGAGCTTGAAGTGAGGGCCAAAAGAAGCATCGCCGCGCAAATCCCGACGACAATGGTTAAGCTTAAGAGAACCGAGTCGATGTCCAAGCTAAGACCCGAGTCAGATGATCGAACCGAGTCCACTCAGTCGTCCTACTCGGGGCCTCGGTCAGTGAAGGAGAACATATTCGTCAAGAGAGACAGAGAACGGAGGGAGAAAGAAGGGAACAAGAAGCCGGTGATGAACTGGGACCCACTTAGGGAGTTCCCGGAGAAGTGTCCGCCGGGAGGAGGGGAAGGTTTGATTGTCTACACGACGTCGTTGCAAGGAGTGCGTCGCACGTACGAGGATTGTATGCGTGTGAGGGCCATCATGGAGCAGCAAGGAGTTGTGGTGGACGAGAGGGACGTGTCTTTAGACGCCGGAGTCTTGAGCGAGCTTAAGGAGCTTCTCCAAGACGAAGCATCAGTGGCGCCGCCGCGAGTGTTTGTGAAAGGGAGGTACTTGGGAGGAGCAGCGGAAGTGACAGCGATGAATGAGAACGGGAAGTTAGGGAGGGTGTTGCGGTGGGCACGTGTGGAGAGAGTAGGGGAGGAAGGGAGGCTCACGTGTGAAGGGTGCGGAGGAGCGAGGTGGTTGCCTTGTTTCGAGTGCGGCGGAAGCTGTAAGGTGGCGGCGGTTGGGGCGGCCAAAGGTGAAAGGTGGGAGAGGTGTGTCAAGTGTAATGAGAATGGATTGATTCGTTGTCCCGTGTGTTTTGTTAATTAAGAACATTATTAGTTTACACAAGCAAATAGAGGTGTGTCAAATATACTTTGTCCCGTTTGTTTTGTTATATGTATGTGACACGTTTGATTTTGTGGAATTGAAAATGATTTG

SEQ ID NO: 1595 - DNA, 1591 bp, Arabidopsis thaliana
  misc_feature (1)..(1591): Ceres cDNA ID no. 12658618
  misc_feature (1)..(1591): Also known as  Ceres CDNA ID no. 23659454
gacctttggtttctgtgttgtgtgatatttactacgaaaccacttgtcaccaaaggttcttctttctgttagcgttgggttcgtgattccaagatcaatggttgtgaacttcactagttagagatactgaatcaaagagatgattcttccgagaattgggtaaatcttcgattctgattttctggattaaagaacacgtaacctattttcaattcgcgggtttgattccatagcttcttcagatcatacattctcgcaagtgttcgatacgggagtagaagaagaagagtctttctatgctcctgatcatgatgtcttgactctgcttcaacctaacttcaccagcaacgatgtctagtagtaccaagaacattccaaaacctcctcctcttccttgtattacctaccagcgttttcaatctagtacaaggaaaccttcgagcttaatgcgccttgtgcctaaagaagcacttgaaacttgggataagcttttcaaggaaggatctggagcagatacatatgttgaaaccgataacaagtctcactttcctgcccattcaagtgtcctggctgcagcctcaccagttatagcgacacttctgaatcaatcgagggataagaatgggaatacatacctcaaaatccatggagttccttgtgaagcagtctacatgttcattaggtttctatactcttcctgctacgaggaggaagaaatgaagaagtttgtgctccatttattggttctgtcacattgctactcggtcccatctcttaaaagactttgtgtagagattctcgatcaaggatggattaacaaggagaatgtgatcgatgtgcttcaactagcgagaaactgtgacgtgacaaggatttgctttgtatgtctttccatggtcatcaaagacttcaaatctgtatcttcaacagagggatggaaagtgatgaaacgctctaatcctttgctcgaacaagagctcattgaggcagtcatcgaatccgacagtaggaaacaagaaagaagaagaaaactggaggagagagaagtgtatttgcagctctatgaagccatggaagctcttgtccacatatgtcgtgaaggttgtgggacaattggacctcgcgataaggcccttaaaggaagccataccgtgtgtaaattcccggcgtgtaaagggcttgaaggtgcgctcagacatttcttgggatgcaagtctagggcttcatgttctcattgcaaaaggatgtggcagcttcttcagcttcactcttgtatctgtgatgattctaattcttgcaaagtttctctctgctggaatttcaaggagaaaatgaagaagcttagcaagaaagaacaatctaaatggcgattgcttgtagaaaacattattagggcgaggaacagtctcgggcccttctcgtcacgttcttctggtttgatatagaaacaggttttagattttagtgtatagccagttagacacaaaaagaaaacgtacataggcgcagggtatagtgtatattgcgcaccaatacggcgcacaatagtggttttgaacaaacattgtctatatcaagttggttgttatat

SEQ ID NO: 1596 - protein, 1591 aa, Arabidopsis thaliana
  misc_feature: GI Number: 34905882; NR Description: P0458E05.17 [Oryza sativa (japonica cultivar-group)] >gi|21902069|dbj|BAC05617.1|
GACCTTTGGTTTCTGTGTTGTGTGATATTTACTACGAAACCACTTGTCACCAAAGGTTCTTCTTTCTGTTAGCGTTGGGTTCGTGATTCCAAGATCAATGGTTGTGAACTTCACTAGTTAGAGATACTGAATCAAAGAGATGATTCTTCCGAGAATTGGGTAAATCTTCGATTCTGATTTTCTGGATTAAAGAACACGTAACCTATTTTCAATTCGCGGGTTTGATTCCATAGCTTCTTCAGATCATACATTCTCGCAAGTGTTCGATACGGGAGTAGAAGAAGAAGAGTCTTTCTATGCTCCTGATCATGATGTCTTGACTCTGCTTCAACCTAACTTCACCAGCAACGATGTCTAGTAGTACCAAGAACATTCCAAAACCTCCTCCTCTTCCTTGTATTACCTACCAGCGTTTTCAATCTAGTACAAGGAAACCTTCGAGCTTAATGCGCCTTGTGCCTAAAGAAGCACTTGAAACTTGGGATAAGCTTTTCAAGGAAGGATCTGGAGCAGATACATATGTTGAAACCGATAACAAGTCTCACTTTCCTGCCCATTCAAGTGTCCTGGCTGCAGCCTCACCAGTTATAGCGACACTTCTGAATCAATCGAGGGATAAGAATGGGAATACATACCTCAAAATCCATGGAGTTCCTTGTGAAGCAGTCTACATGTTCATTAGGTTTCTATACTCTTCCTGCTACGAGGAGGAAGAAATGAAGAAGTTTGTGCTCCATTTATTGGTTCTGTCACATTGCTACTCGGTCCCATCTCTTAAAAGACTTTGTGTAGAGATTCTCGATCAAGGATGGATTAACAAGGAGAATGTGATCGATGTGCTTCAACTAGCGAGAAACTGTGACGTGACAAGGATTTGCTTTGTATGTCTTTCCATGGTCATCAAAGACTTCAAATCTGTATCTTCAACAGAGGGATGGAAAGTGATGAAACGCTCTAATCCTTTGCTCGAACAAGAGCTCATTGAGGCAGTCATCGAATCCGACAGTAGGAAACAAGAAAGAAGAAGAAAACTGGAGGAGAGAGAAGTGTATTTGCAGCTCTATGAAGCCATGGAAGCTCTTGTCCACATATGTCGTGAAGGTTGTGGGACAATTGGACCTCGCGATAAGGCCCTTAAAGGAAGCCATACCGTGTGTAAATTCCCGGCGTGTAAAGGGCTTGAAGGTGCGCTCAGACATTTCTTGGGATGCAAGTCTAGGGCTTCATGTTCTCATTGCAAAAGGATGTGGCAGCTTCTTCAGCTTCACTCTTGTATCTGTGATGATTCTAATTCTTGCAAAGTTTCTCTCTGCTGGAATTTCAAGGAGAAAATGAAGAAGCTTAGCAAGAAAGAACAATCTAAATGGCGATTGCTTGTAGAAAACATTATTAGGGCGAGGAACAGTCTCGGGCCCTTCTCGTCACGTTCTTCTGGTTTGATATAGAAACAGGTTTTAGATTTTAGTGTATAGCCAGTTAGACACAAAAAGAAAACGTACATAGGCGCAGGGTATAGTGTATATTGCGCACCAATACGGCGCACAATAGTGGTTTTGAACAAACATTGTCTATATCAAGTTGGTTGTTATAT

SEQ ID NO: 1597 - DNA, 1363 bp, Arabidopsis thaliana
  misc_feature (1)..(1363): Ceres cDNA ID no. 12658622
atttttcttttagaaaccaaacttttcagatttctctctctccatttggcgatagaagaagtcatgtaccaatcatcatcctccacgtcatcatcatcgcagagatcatcgcttcccggcggcggaggactgatccgttacggctcagctccgggatcgtttctaaactctgtggttgacgaagtcatcggaggaggctcatcaaacgctcgtgacttcaccggctatcaaccgtcgtcggataacttcatcggtaactttttcaccggagctgctgactcatcctcgctgagatccgattcgacgacttgtggagtcaacaactcatccgacggacagaaacagctaggcaataacaataataataatagtaataaagatatcttcctcgacagatcctacggtggattcaacgagatctcgcaacaacacaagagcaacgacatcggaggaggaaacagctcaggatcttactctctcgctagacaacgtagctctcccgccgatttcttcacctacctcgcctcagataaaaacaatttctcgttgaaccaaccaaccagtgattatagtccgcaaggagggtctaatgggggacgaggacattccagattgaagtctcagctaagcttcacgaatcacgactctctggctcggatcaacgaggtcaatgagaccccagtccacgacggttcaggccattcgttttctgcggctagctttggtgcagccactactgattcttgggatgacggttccggttcgatagggtttaccgtgactaggcccagtaaacgatccaaggacatggactctggtctcttttcgcagtcttccttcagacacttcaatgaactacatggataacttcatgcagcttccagaagattctgtaccctgcaaaatccgggccaaacgcggctgcgccacccatcctagaagcatcgctgagcgggagaggagaacgagaataagtgggaagctaaagaagctacaagatcttgtccccaacatggataagcaaacaagctattcagacatgctggatttagctgtacaacacatcaaaggccttcagcatcaacttcagaatttgaaaaaagatcaagagaattgcacgtgtgggtgcagtgagaaaccaagctagctcaaacccaaaggtagggtcatcctaattttatttgcattgttccgattttatcatatgagagaattagagaagatgtaaataaaatagattatattaaatgtctaatcctcttataattaagctcctcattcgttatcattataagatagaacagtgacaattgtccattatgtttttgtttcaagtttatgttttgagtgtcgcctattttgt

SEQ ID NO: 1598 - protein, 288 aa, Arabidopsis thaliana
  misc_feature: PFam Name: HLH; PFam Description: Helix-loop-helix
  misc_feature: GI Number: 21554238; NR Description: Contains similarity to bHLH transcription factor GBOF-1 from Tulipa gesneriana gb|AF185269
  misc_feature: GI Number: 56784863; NR Description: putative helix-loop-helix protein 1A [Oryza sativa (japonica
  misc_feature: GI Number: 34907702; NR Description: P0035F12.11 [Oryza sativa (japonica cultivar-group)] >gi|20161021|dbj|BAB89954.1| P0035F12.11 [Oryza sativa (japonica cultivar-group)] >gi|20161601|dbj|BAB90521.1| B1065G12.3 [Oryza sativa (japonica
  misc_feature: GI Number: 19401700; NR Description: transcription factor
  misc_feature: GI Number: 52421281; NR Description: At2g42280 [Arabidopsis thaliana] gi|51536448|gb|AAU05462.1| At2g42280 [Arabidopsis thaliana] gi|42569863|ref|NP_181757.2| basic helix-loop-helix
IFLLETKLFRFLSLHLAIEEVMYQSSSSTSSSSQRSSLPGGGGLIRYGSAPGSFLNSVVDEVIGGGSSNARDFTGYQPSSDNFIGNFFTGAADSSSLRSDSTTCGVNNSSDGQKQLGNNNNNNSNKDIFLDRSYGGFNEISQQHKSNDIGGGNSSGSYSLARQRSSPADFFTYLASDKNNFSLNQPTSDYSPQGGSNGGRGHSRLKSQLSFTNHDSLARINEVNETPVHDGSGHSFSAASFGAATTDSWDDGSGSIGFTVTRPSKRSKDMDSGLFSQSSFRHFNELHG

SEQ ID NO: 1599 - DNA, 699 bp, Arabidopsis thaliana
  misc_feature (1)..(699): Ceres cDNA ID no. 12659722
  misc_feature (1)..(699): Also known as  Ceres CDNA ID no. 23659454
atgcttgggctttcttacggtgagctcttactcatcgtcggcgccacagctgctcttgtaggacccaaggatcttccgattattgctagagcaggaggaagattattcggacgagccattggttacatcaatatggctcgtggtcacttggatggtgtcatgaaacaacctcagatgcaagagatatcgaaagaagttcaagatttacgagcacaagtagatgcgattagccatggagcaagattttctctatttgattctagtcctttgactcgaagagtggataaccaaaaaactcaagaacctagtccaagcaccaccaatgggattgttacatccgttaatgttgaagaaaaacagaagcctgtagatcattatacaaaggctcaagaatttagtggctcgtcgtcagcttctgttaacctgcacgctcaagcaacatcatttgcacgattatctgagacagtcaatggaaaaactcacagtctaaacagtgattcacctgttcttccagtatcagctgagatggcaaagttgcttcctcaacgcaaagagagtgcaagaggatctgatttaatgttagaggcggttcttgaagcggaagtagcacacaaggcgaaaagctttttcgcacaagccgagaaagaaactccagctttgaaagggaagtttttcagtgacaggaaaggagaaaattga

SEQ ID NO: 1600 - protein, 699 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGCTTGGGCTTTCTTACGGTGAGCTCTTACTCATCGTCGGCGCCACAGCTGCTCTTGTAGGACCCAAGGATCTTCCGATTATTGCTAGAGCAGGAGGAAGATTATTCGGACGAGCCATTGGTTACATCAATATGGCTCGTGGTCACTTGGATGGTGTCATGAAACAACCTCAGATGCAAGAGATATCGAAAGAAGTTCAAGATTTACGAGCACAAGTAGATGCGATTAGCCATGGAGCAAGATTTTCTCTATTTGATTCTAGTCCTTTGACTCGAAGAGTGGATAACCAAAAAACTCAAGAACCTAGTCCAAGCACCACCAATGGGATTGTTACATCCGTTAATGTTGAAGAAAAACAGAAGCCTGTAGATCATTATACAAAGGCTCAAGAATTTAGTGGCTCGTCGTCAGCTTCTGTTAACCTGCACGCTCAAGCAACATCATTTGCACGATTATCTGAGACAGTCAATGGAAAAACTCACAGTCTAAACAGTGATTCACCTGTTCTTCCAGTATCAGCTGAGATGGCAAAGTTGCTTCCTCAACGCAAAGAGAGTGCAAGAGGATCTGATTTAATGTTAGAGGCGGTTCTTGAAGCGGAAGTAGCACACAAGGCGAAAAGCTTTTTCGCACAAGCCGAGAAAGAAACTCCAGCTTTGAAAGGGAAGTTTTTCAGTGACAGGAAAGGAGAAAATTGA

SEQ ID NO: 1601 - DNA, 1245 bp, Arabidopsis thaliana
  misc_feature (1)..(1245): Ceres cDNA ID no. 12659944
  misc_feature (1)..(1245): Also known as  Ceres CDNA ID no. 23659454
atgtttgagaactttcatgttctttgctattatgggattccccgtgacaagattggtcgtttgtataaggaagcaagagagatttttgtatacgagaatggggttttggcatcgaaacttgaaccttatgagatcttggttcttagaaaggctatagtcattaagcttgttacttgttgcccgttgcttctggttggtggcattgattgtgagtttgtttctgtggtaaataagttgaagggattaaacttaggatgcgattggcttgcgcggtatttgtcagttagaaaaacatataactggcgccggattcttgagacaatggagctccttgagaaggtggggtttaaagagaagaagttgagtaatcttttaaaagcgtatccagatttggtaggtgaaacttctggcaataaagcttatattatgtttgaaaagtttcataaagttggacttcagatgaatgaaattgataaattactgatagacaactccgagatgttattagagaaatctgtaaaaagaattttagaggcgttgaaattcttgaaatgtatcagaatagaaaagcagtttgtcgttaggtttttacagtgtcacatgaagcatatctgttcatcctctttgctagtacctagagctgtttggaatagattgaaaatcagaagagatgagttatgtcagatcattaaggaagagcctttgagattgttcagtatagcttctaaaactaataaaggtagaattgaacttgattcactggattcgaggaatgcagagaagacgacattcttgttgaagttagggtatgtagagaattccgatgagatggtgagggctctgaaaaagttccaagggaggggagatgagctacaggagagatttgattgctttgtgaaggctggtttggactataatgtggttagccagcttgttaagcgggcgcctcatatacttaaccggccgaaagatatcatagaaaagaagatcattatgctaatagattatttggtttatccaatagaatccgtgatagagtccccaacatatttgtgttatagtatgaagagaatacatcagagattcacaatgtacatttggttgagggaaagagatgcagtaataccgaggctgacactaggcactgttgtcggtatttctaatacccttattgtgccatactttgtcaatacccacccggaaggtccagctacttgggaaaatataaagaaagcatctacctga

SEQ ID NO: 1602 - protein, 1245 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGTTTGAGAACTTTCATGTTCTTTGCTATTATGGGATTCCCCGTGACAAGATTGGTCGTTTGTATAAGGAAGCAAGAGAGATTTTTGTATACGAGAATGGGGTTTTGGCATCGAAACTTGAACCTTATGAGATCTTGGTTCTTAGAAAGGCTATAGTCATTAAGCTTGTTACTTGTTGCCCGTTGCTTCTGGTTGGTGGCATTGATTGTGAGTTTGTTTCTGTGGTAAATAAGTTGAAGGGATTAAACTTAGGATGCGATTGGCTTGCGCGGTATTTGTCAGTTAGAAAAACATATAACTGGCGCCGGATTCTTGAGACAATGGAGCTCCTTGAGAAGGTGGGGTTTAAAGAGAAGAAGTTGAGTAATCTTTTAAAAGCGTATCCAGATTTGGTAGGTGAAACTTCTGGCAATAAAGCTTATATTATGTTTGAAAAGTTTCATAAAGTTGGACTTCAGATGAATGAAATTGATAAATTACTGATAGACAACTCCGAGATGTTATTAGAGAAATCTGTAAAAAGAATTTTAGAGGCGTTGAAATTCTTGAAATGTATCAGAATAGAAAAGCAGTTTGTCGTTAGGTTTTTACAGTGTCACATGAAGCATATCTGTTCATCCTCTTTGCTAGTACCTAGAGCTGTTTGGAATAGATTGAAAATCAGAAGAGATGAGTTATGTCAGATCATTAAGGAAGAGCCTTTGAGATTGTTCAGTATAGCTTCTAAAACTAATAAAGGTAGAATTGAACTTGATTCACTGGATTCGAGGAATGCAGAGAAGACGACATTCTTGTTGAAGTTAGGGTATGTAGAGAATTCCGATGAGATGGTGAGGGCTCTGAAAAAGTTCCAAGGGAGGGGAGATGAGCTACAGGAGAGATTTGATTGCTTTGTGAAGGCTGGTTTGGACTATAATGTGGTTAGCCAGCTTGTTAAGCGGGCGCCTCATATACTTAACCGGCCGAAAGATATCATAGAAAAGAAGATCATTATGCTAATAGATTATTTGGTTTATCCAATAGAATCCGTGATAGAGTCCCCAACATATTTGTGTTATAGTATGAAGAGAATACATCAGAGATTCACAATGTACATTTGGTTGAGGGAAAGAGATGCAGTAATACCGAGGCTGACACTAGGCACTGTTGTCGGTATTTCTAATACCCTTATTGTGCCATACTTTGTCAATACCCACCCGGAAGGTCCAGCTACTTGGGAAAATATAAAGAAAGCATCTACCTGA

SEQ ID NO: 1603 - DNA, 1131 bp, Arabidopsis thaliana
  misc_feature (1)..(1131): Ceres cDNA ID no. 12659983
  misc_feature (1)..(1131): Also known as  Ceres CDNA ID no. 23659454
atgtcttgggttcgattcacaattgagcaaaaagatgggaactttgcgtacccaccaccgttttacaaagacccaattctttctccgccgtctcctccaccaccgtcgtccggtaacagaatcagtccggcggttttgtttgtaattgtgattctagctgtcttgttcttcatttctgggcttcttcatttgctcgtcaggtttcttattaagcatccttctgctactgcttcttcaaggtctaatagattcccagagatctcaactagtgatgctcttcaaagacagcttcaacagctttttcatttgaatgattctggtcttgatcaagcttttatcgatgctttacctgtttttcactacaaggagattgttggtagtgctggtggtggtggtggtaatggtgctgctcaagagccgtttgattgcgcggtttgtctctgtgagttctctgagaaagataagctgaggttgttgccaatgtgtagccatgcttttcatttgaactgtattgatacttggcttcagtcaaattcgacttgtcctctttgtcgtggtactctcttttcccctggtttctcaatggagaacccgatgtttgatttcgatgatataagagaagacgaagagggtgtgaccgagaatggaagtcagaaaactatggagattcaagaaatcgttgtggagaaaggtgttttaccggttagattggggaaatttaagaggcttgacaatgttggtaatggccaaggtcaggatgttgttgccggaggagagactagtagtagtaatttggatgcaaggagatgtttctcaatgggttcgtatcagtatatactcggtaactcggaacttaaagtcccgtttgccaacgacagactgccgcgtttgaaacctcaggacaaagaatctgagcagacagggaattcatcatcagaagacaataaaaagatcaatactgtggctaaaggagagagcttttcggtttcgaagatttggttgtggcctaagaaagataagttctcttcagatgctcaaagaaggttgccttcttcatcacttaacgttgatgatcttccgaaacttccatggatggaagaacataagaagctggagaacgacggaaggtag

SEQ ID NO: 1604 - protein, 1131 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGTCTTGGGTTCGATTCACAATTGAGCAAAAAGATGGGAACTTTGCGTACCCACCACCGTTTTACAAAGACCCAATTCTTTCTCCGCCGTCTCCTCCACCACCGTCGTCCGGTAACAGAATCAGTCCGGCGGTTTTGTTTGTAATTGTGATTCTAGCTGTCTTGTTCTTCATTTCTGGGCTTCTTCATTTGCTCGTCAGGTTTCTTATTAAGCATCCTTCTGCTACTGCTTCTTCAAGGTCTAATAGATTCCCAGAGATCTCAACTAGTGATGCTCTTCAAAGACAGCTTCAACAGCTTTTTCATTTGAATGATTCTGGTCTTGATCAAGCTTTTATCGATGCTTTACCTGTTTTTCACTACAAGGAGATTGTTGGTAGTGCTGGTGGTGGTGGTGGTAATGGTGCTGCTCAAGAGCCGTTTGATTGCGCGGTTTGTCTCTGTGAGTTCTCTGAGAAAGATAAGCTGAGGTTGTTGCCAATGTGTAGCCATGCTTTTCATTTGAACTGTATTGATACTTGGCTTCAGTCAAATTCGACTTGTCCTCTTTGTCGTGGTACTCTCTTTTCCCCTGGTTTCTCAATGGAGAACCCGATGTTTGATTTCGATGATATAAGAGAAGACGAAGAGGGTGTGACCGAGAATGGAAGTCAGAAAACTATGGAGATTCAAGAAATCGTTGTGGAGAAAGGTGTTTTACCGGTTAGATTGGGGAAATTTAAGAGGCTTGACAATGTTGGTAATGGCCAAGGTCAGGATGTTGTTGCCGGAGGAGAGACTAGTAGTAGTAATTTGGATGCAAGGAGATGTTTCTCAATGGGTTCGTATCAGTATATACTCGGTAACTCGGAACTTAAAGTCCCGTTTGCCAACGACAGACTGCCGCGTTTGAAACCTCAGGACAAAGAATCTGAGCAGACAGGGAATTCATCATCAGAAGACAATAAAAAGATCAATACTGTGGCTAAAGGAGAGAGCTTTTCGGTTTCGAAGATTTGGTTGTGGCCTAAGAAAGATAAGTTCTCTTCAGATGCTCAAAGAAGGTTGCCTTCTTCATCACTTAACGTTGATGATCTTCCGAAACTTCCATGGATGGAAGAACATAAGAAGCTGGAGAACGACGGAAGGTAG

SEQ ID NO: 1605 - DNA, 1191 bp, Arabidopsis thaliana
  misc_feature (1)..(1191): Ceres cDNA ID no. 12660033
  misc_feature (1)..(1191): Also known as  Ceres CDNA ID no. 23659454
atggctactcattcaaggtttatatacgtgcttcttcttctttcatgcattgtttttgcattgcttgggggtagttgtggagatagtgtggagaataacaatgacgatgatgattgttcttcccggagttggcgtggttgtggtagtttctacggaaaaggtgctaaaagatatggcggtggaggcggaggaggaggtggcggtggaggaggtggtggtgaaggaggtgatgggtatggccatggagaaggatatggtgctggagctggtatgagtggctatggtggtgttggaggaggtggaggaagaggcggcggagaaggtggtggcagtagtgcaaatggaggttctgggcatggaagtggatccggtgctggtgctggtgttggtggaacaactggtggagtaggaggaggtggaggaggcggtggcggtggcggagaaggaggtggttcaagtggaggatcaggtcatgggagtggttctggagctggagctggtgctggagttggtggatcatctgggggagctgggggaggtggaggaggtggtggcggagaaggcggtggtgcgaatggaggttcaggtcatggaagtggggctggtgctggtgctggagttggaggagcagctggtggagtaggaggagggggaggaggcggtggtggagaaggcggtggtgccaatggaggatcaggtcatggaagcggatccggtgctggtggtggagttagtggagcagcaggtggaggaggaggaggaggaggaggtggtggtagcggtggtagtaaagtcggtggaggatatggtcatggtagtggttttggtggtggagttggctttggaaatagtggaggaggaggtggtggtggtggaggaggtggaggtggaggcggtggtggaaatggatctggttatggaagtggtagtggttacggttctggtatgggaaaaggtagtggtagtggtggcggtggtggtggtggtggtggaggtagcggtggaggcaacggaagcggaagtggaagtggagaaggatatggaatgggaggaggagccggaacaggcaatggaggaggagggggagtgggttttggaatgggcattggatttggtattggcattggaggaggaagtggtggtggtaccacttatcaaaccaatcttaccggtgataaaaattctccctag

SEQ ID NO: 1606 - protein, 1191 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGGCTACTCATTCAAGGTTTATATACGTGCTTCTTCTTCTTTCATGCATTGTTTTTGCATTGCTTGGGGGTAGTTGTGGAGATAGTGTGGAGAATAACAATGACGATGATGATTGTTCTTCCCGGAGTTGGCGTGGTTGTGGTAGTTTCTACGGAAAAGGTGCTAAAAGATATGGCGGTGGAGGCGGAGGAGGAGGTGGCGGTGGAGGAGGTGGTGGTGAAGGAGGTGATGGGTATGGCCATGGAGAAGGATATGGTGCTGGAGCTGGTATGAGTGGCTATGGTGGTGTTGGAGGAGGTGGAGGAAGAGGCGGCGGAGAAGGTGGTGGCAGTAGTGCAAATGGAGGTTCTGGGCATGGAAGTGGATCCGGTGCTGGTGCTGGTGTTGGTGGAACAACTGGTGGAGTAGGAGGAGGTGGAGGAGGCGGTGGCGGTGGCGGAGAAGGAGGTGGTTCAAGTGGAGGATCAGGTCATGGGAGTGGTTCTGGAGCTGGAGCTGGTGCTGGAGTTGGTGGATCATCTGGGGGAGCTGGGGGAGGTGGAGGAGGTGGTGGCGGAGAAGGCGGTGGTGCGAATGGAGGTTCAGGTCATGGAAGTGGGGCTGGTGCTGGTGCTGGAGTTGGAGGAGCAGCTGGTGGAGTAGGAGGAGGGGGAGGAGGCGGTGGTGGAGAAGGCGGTGGTGCCAATGGAGGATCAGGTCATGGAAGCGGATCCGGTGCTGGTGGTGGAGTTAGTGGAGCAGCAGGTGGAGGAGGAGGAGGAGGAGGAGGTGGTGGTAGCGGTGGTAGTAAAGTCGGTGGAGGATATGGTCATGGTAGTGGTTTTGGTGGTGGAGTTGGCTTTGGAAATAGTGGAGGAGGAGGTGGTGGTGGTGGAGGAGGTGGAGGTGGAGGCGGTGGTGGAAATGGATCTGGTTATGGAAGTGGTAGTGGTTACGGTTCTGGTATGGGAAAAGGTAGTGGTAGTGGTGGCGGTGGTGGTGGTGGTGGTGGAGGTAGCGGTGGAGGCAACGGAAGCGGAAGTGGAAGTGGAGAAGGATATGGAATGGGAGGAGGAGCCGGAACAGGCAATGGAGGAGGAGGGGGAGTGGGTTTTGGAATGGGCATTGGATTTGGTATTGGCATTGGAGGAGGAAGTGGTGGTGGTACCACTTATCAAACCAATCTTACCGGTGATAAAAATTCTCCCTAG

SEQ ID NO: 1607 - DNA, 2487 bp, Arabidopsis thaliana
  misc_feature (1)..(2487): Ceres cDNA ID no. 12660285
  misc_feature (1)..(2487): Also known as  Ceres CDNA ID no. 23659454
atggcagattcaagttcttctctccttcctctttgcgaaaggatttcacacaaaagctacattttaagaattgtcgatctcacaattctcgttcttctcttttctcttctctggtaccgaatcctacatatgtgcgaaaacaacaccatttggcttgtggcttttctctgtgaatcttgtttctcattcatgtggttgattattacctgcataaaatggagtcctgctgaagataaaccctatccaaatagacttgatgaaagggttcatgaccttccttcagtagatatgttcgtgcccacggcagatccggttagggagccgccgattattgttgtgaacactgtgctttcgctattagctgtgaattatccagcgaataaactagcgtgttatgtgtcggacgatggatgttctcctctcacttacttttctctcaaggaagcttctaagttcgttaaaatttgggctcccttctgcaagaaatacaacgttagagttagagctccttttagatatttcttaaaccctttggttgcaacagatgattcagtattcagcaaagattggaaaatgatgaagatttataaggttttttattatgtttatttttgtattaatatgaagagggagtacgtgaagttatgccggaaagttgaagatgccacaggagattcccattggttggatgcagacgatgattttgaagctttctcaaacacaaaaccaaatgatcattcaactattgttaaggtattactaaaattgtttttaaaaactacagtcagggtatttgtacaattttccaaagttatgtacatattaaaacttataatagtggtatgggagaacaagggaggtgtaggagacgagaaagaagtccctcatcttgtatacatttcaagagagaaaagaccaaattaccttcatcattacaaaactggagccatgaactttctggttaacgatttttatcttacacatctctctttttttgatatattaatatatttaaaaataaatgtcaatgattgtagagctgtttctttttgttattatgataaaaatatgatgagcctaatatataattttaaacagttaagagtgtcaggattgatgacaaatgcaccatacatgttgaacgtagactgtgacatgtatgccaatgaaccagatgtggtgcgacaagcaatgtgtgtatttttacaaaactcaaagaactcaaaccattgtgcttttgttcagttccctcaaaacttctatgattcttacaccaacgaacttgtcgtcttacaacattatatgaaacgaggagttgcgggaatccaaggaccgatatatattggatcaggctgcttccacactagaagagttatgtacggtttatcttcagacgatttagaagacgatggaagtctttcttcggttgcttcaagggagtttttgtccgaggatagtttagtgaggaaatatgggagttccaaagagttggtgaaatcagtggtggatgcattgcaaagaaaatcaaacccccaaaaaagtcttgcaaacctcgtagaagcggcccaagaagtggggcattgtcactacgagtaccaaaccagttggggcaacctcggttggttatatgattcagtggcagaagatacaaacacgagtattggaatccatttgagaggatggactagttcattcatttctccggaccctcccgcgtttctaggatcaactccgtcggtaggaccagaggcgatagtccaacaccggcgatgggcaacgggatcgatcgaagtcctttttaacaaacaaagtccgttgatcggtttccgtcggaaaataaaattccgacaaagattagcttatttttgggttctcatgtgtataaggtcaatccctgagctcgtgtactgtctcttgcctgcttattgcctactcaacaactctgccttgtttcccaagggaccttgtctaggcataatagtcacacttgtggggatgcattgtctctacactctatggcaattcatgatccttggtttttcggtaaaatcgtgttggttatttagcatccaagatatcatactcaagcttcttggaatctcgaaaatcggttttatagtcgcgaaaaagaatatgcctgagactaggtcaggatatgaatctaaatctaaaccatctcaaggagaagatgatggtctaaaattagagttagctggttttttggttcgtctacaacggtcaagttatagtcatggaggaggaggtggttcggctttggcagagacttgtggatgtgctatgattgtttttggtgaaaatgatggatctcaagaaggtcttgaattgcctaaacttaactcaaagagaggtatctcctcaattgttgaaaaaacgtttgtggcatgcatcttaccatttgtaagaaatcataaagtaaatgaaaaaaaaaatcaccacattaatatagatagaccaaatttgttgtga

SEQ ID NO: 1608 - protein, 2487 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGGCAGATTCAAGTTCTTCTCTCCTTCCTCTTTGCGAAAGGATTTCACACAAAAGCTACATTTTAAGAATTGTCGATCTCACAATTCTCGTTCTTCTCTTTTCTCTTCTCTGGTACCGAATCCTACATATGTGCGAAAACAACACCATTTGGCTTGTGGCTTTTCTCTGTGAATCTTGTTTCTCATTCATGTGGTTGATTATTACCTGCATAAAATGGAGTCCTGCTGAAGATAAACCCTATCCAAATAGACTTGATGAAAGGGTTCATGACCTTCCTTCAGTAGATATGTTCGTGCCCACGGCAGATCCGGTTAGGGAGCCGCCGATTATTGTTGTGAACACTGTGCTTTCGCTATTAGCTGTGAATTATCCAGCGAATAAACTAGCGTGTTATGTGTCGGACGATGGATGTTCTCCTCTCACTTACTTTTCTCTCAAGGAAGCTTCTAAGTTCGTTAAAATTTGGGCTCCCTTCTGCAAGAAATACAACGTTAGAGTTAGAGCTCCTTTTAGATATTTCTTAAACCCTTTGGTTGCAACAGATGATTCAGTATTCAGCAAAGATTGGAAAATGATGAAGATTTATAAGGTTTTTTATTATGTTTATTTTTGTATTAATATGAAGAGGGAGTACGTGAAGTTATGCCGGAAAGTTGAAGATGCCACAGGAGATTCCCATTGGTTGGATGCAGACGATGATTTTGAAGCTTTCTCAAACACAAAACCAAATGATCATTCAACTATTGTTAAGGTATTACTAAAATTGTTTTTAAAAACTACAGTCAGGGTATTTGTACAATTTTCCAAAGTTATGTACATATTAAAACTTATAATAGTGGTATGGGAGAACAAGGGAGGTGTAGGAGACGAGAAAGAAGTCCCTCATCTTGTATACATTTCAAGAGAGAAAAGACCAAATTACCTTCATCATTACAAAACTGGAGCCATGAACTTTCTGGTTAACGATTTTTATCTTACACATCTCTCTTTTTTTGATATATTAATATATTTAAAAATAAATGTCAATGATTGTAGAGCTGTTTCTTTTTGTTATTATGATAAAAATATGATGAGCCTAATATATAATTTTAAACAGTTAAGAGTGTCAGGATTGATGACAAATGCACCATACATGTTGAACGTAGACTGTGACATGTATGCCAATGAACCAGATGTGGTGCGACAAGCAATGTGTGTATTTTTACAAAACTCAAAGAACTCAAACCATTGTGCTTTTGTTCAGTTCCCTCAAAACTTCTATGATTCTTACACCAACGAACTTGTCGTCTTACAACATTATATGAAACGAGGAGTTGCGGGAATCCAAGGACCGATATATATTGGATCAGGCTGCTTCCACACTAGAAGAGTTATGTACGGTTTATCTTCAGACGATTTAGAAGACGATGGAAGTCTTTCTTCGGTTGCTTCAAGGGAGTTTTTGTCCGAGGATAGTTTAGTGAGGAAATATGGGAGTTCCAAAGAGTTGGTGAAATCAGTGGTGGATGCATTGCAAAGAAAATCAAACCCCCAAAAAAGTCTTGCAAACCTCGTAGAAGCGGCCCAAGAAGTGGGGCATTGTCACTACGAGTACCAAACCAGTTGGGGCAACCTCGGTTGGTTATATGATTCAGTGGCAGAAGATACAAACACGAGTATTGGAATCCATTTGAGAGGATGGACTAGTTCATTCATTTCTCCGGACCCTCCCGCGTTTCTAGGATCAACTCCGTCGGTAGGACCAGAGGCGATAGTCCAACACCGGCGATGGGCAACGGGATCGATCGAAGTCCTTTTTAACAAACAAAGTCCGTTGATCGGTTTCCGTCGGAAAATAAAATTCCGACAAAGATTAGCTTATTTTTGGGTTCTCATGTGTATAAGGTCAATCCCTGAGCTCGTGTACTGTCTCTTGCCTGCTTATTGCCTACTCAACAACTCTGCCTTGTTTCCCAAGGGACCTTGTCTAGGCATAATAGTCACACTTGTGGGGATGCATTGTCTCTACACTCTATGGCAATTCATGATCCTTGGTTTTTCGGTAAAATCGTGTTGGTTATTTAGCATCCAAGATATCATACTCAAGCTTCTTGGAATCTCGAAAATCGGTTTTATAGTCGCGAAAAAGAATATGCCTGAGACTAGGTCAGGATATGAATCTAAATCTAAACCATCTCAAGGAGAAGATGATGGTCTAAAATTAGAGTTAGCTGGTTTTTTGGTTCGTCTACAACGGTCAAGTTATAGTCATGGAGGAGGAGGTGGTTCGGCTTTGGCAGAGACTTGTGGATGTGCTATGATTGTTTTTGGTGAAAATGATGGATCTCAAGAAGGTCTTGAATTGCCTAAACTTAACTCAAAGAGAGGTATCTCCTCAATTGTTGAAAAAACGTTTGTGGCATGCATCTTACCATTTGTAAGAAATCATAAAGTAAATGAAAAAAAAAATCACCACATTAATATAGATAGACCAAATTTGTTGTGA

SEQ ID NO: 1609 - DNA, 1209 bp, Arabidopsis thaliana
  misc_feature (1)..(1209): Ceres cDNA ID no. 12660445
  misc_feature (1)..(1209): Also known as  Ceres CDNA ID no. 23659454
atggcgaccgccgccgccaccactaccgcttccgctgccggaaccttgaccagagcctccacctaccccaacacctattccaattccaatcccaatgccgacgcctcctccatgccctccaccaacaccaccaccgtgccccaaacctcctcctcctccacctccagcaccaccaccgccaccgagtcctcctccggcaccaccgccgagtcctcctccagcaccaaatccgccaccatgtccggatccaccacccacaccacctcctccgccaccgcctcctccaccgcctccaccagcacctcctcctactccacctcctactccacctccagcaccaaaaccactaccatgaccggatccaccattagcaccaccgcctccgccgcccccacctccaccgcctccaccagcacctcctcctactccacctcctactccacctccagcaccaaaaccactaccgtgaccggatccaccattggcaccaccgcctccgccgcccccacctccacctccacctccaccgccaactcctccgccagctccaccaccaatccctcctccggctccaaacccactgccatgaccggaaccaccgccaacacctccccctccgcccccaccagctccccctccaccaccaattcctccagcaccgccgcctacacctcctccggctccaaacccaccaccgtgaccagaaccaccgccaacacctcctcctccgcctccaccagctccgcctcccccaccaattcctccaccagcacccccaccaactcctccgccggctccaaacccaccaccatgaccggaaccaccaccaatacctcctccaccaccaccaccagctccgcctccaccaccaagtcctcctccagctccgccaccaactcctcctccggctccaaaccctccaccttgtccaccaccaccgcctataccgccaccacttcctctcccaccgccgaaccctccaccaccaccgcgtccaaaccggccacgtccagcacacctccggccccacctacaatcatcgtctctaaacctcgcaggacccaccacagatccatcccccaaaacacattccacacacgaattaagcaaaaccaaagaaagaagcaaacaagtaacgcccttaagttccatctacaaggagagagagagagaaataacaataaaatgtcttctcttgtttgcttgtga

SEQ ID NO: 1610 - protein, 1209 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGGCGACCGCCGCCGCCACCACTACCGCTTCCGCTGCCGGAACCTTGACCAGAGCCTCCACCTACCCCAACACCTATTCCAATTCCAATCCCAATGCCGACGCCTCCTCCATGCCCTCCACCAACACCACCACCGTGCCCCAAACCTCCTCCTCCTCCACCTCCAGCACCACCACCGCCACCGAGTCCTCCTCCGGCACCACCGCCGAGTCCTCCTCCAGCACCAAATCCGCCACCATGTCCGGATCCACCACCCACACCACCTCCTCCGCCACCGCCTCCTCCACCGCCTCCACCAGCACCTCCTCCTACTCCACCTCCTACTCCACCTCCAGCACCAAAACCACTACCATGACCGGATCCACCATTAGCACCACCGCCTCCGCCGCCCCCACCTCCACCGCCTCCACCAGCACCTCCTCCTACTCCACCTCCTACTCCACCTCCAGCACCAAAACCACTACCGTGACCGGATCCACCATTGGCACCACCGCCTCCGCCGCCCCCACCTCCACCTCCACCTCCACCGCCAACTCCTCCGCCAGCTCCACCACCAATCCCTCCTCCGGCTCCAAACCCACTGCCATGACCGGAACCACCGCCAACACCTCCCCCTCCGCCCCCACCAGCTCCCCCTCCACCACCAATTCCTCCAGCACCGCCGCCTACACCTCCTCCGGCTCCAAACCCACCACCGTGACCAGAACCACCGCCAACACCTCCTCCTCCGCCTCCACCAGCTCCGCCTCCCCCACCAATTCCTCCACCAGCACCCCCACCAACTCCTCCGCCGGCTCCAAACCCACCACCATGACCGGAACCACCACCAATACCTCCTCCACCACCACCACCAGCTCCGCCTCCACCACCAAGTCCTCCTCCAGCTCCGCCACCAACTCCTCCTCCGGCTCCAAACCCTCCACCTTGTCCACCACCACCGCCTATACCGCCACCACTTCCTCTCCCACCGCCGAACCCTCCACCACCACCGCGTCCAAACCGGCCACGTCCAGCACACCTCCGGCCCCACCTACAATCATCGTCTCTAAACCTCGCAGGACCCACCACAGATCCATCCCCCAAAACACATTCCACACACGAATTAAGCAAAACCAAAGAAAGAAGCAAACAAGTAACGCCCTTAAGTTCCATCTACAAGGAGAGAGAGAGAGAAATAACAATAAAATGTCTTCTCTTGTTTGCTTGTGA

SEQ ID NO: 1611 - DNA, 1258 bp, Arabidopsis thaliana
  misc_feature (1)..(1258): Ceres cDNA ID no. 12660466
  misc_feature (1)..(1258): Also known as  Ceres CDNA ID no. 23659454
atctccaaagctcgttctcaccttacttggcaaacactcaacgaagaaaggagagagagacggtaatggcgatcaagaacattctcgcccttgtggttcttcttagcgtggttggagtttctgtcgccattccacagttgcttgacctcgactactaccggtctaagtgtcccaaggcagaggaaattgttcgtggtgtcacagtacaatatgtttctcgccagaaaacccttgccgctaaacttctaaggatgcatttccatgattgtttcgtcagaggatgtgatggttccgttcttctgaaatctgcaaagaatgatgcggaaagagacgctgtccccaacctgaccctgaaaggttatgaagtggtggatgcggccaagacagcgctggagaggaagtgtcctaatctcatttcttgcgctgatgttcttgccttggtcgccagagatgccgtggcagtgatcgggggaccatggtggccggttccattgggccgcagggatggacgcatctcgaaattgaacgatgcattgctaaatttaccatctcctttcgccgacataaagacgctgaagaagaactttgccaacaagggtcttaacgctaaagaccttgtggttctctcagggggtcacaccattggaatctctagttgcgctctcgtcaacagtcgtctctacaacttcacaggaaagggcgattctgacccatccatgaaccctagctacgtgagggaattgaagagaaagtgcccgcctacagatttcagaacctcactgaacatggacccaggcagtgcgttgacattcgacactcactacttcaaggtcgtggctcagaagaaagggctcttcacatctgactctacgcttctcgatgacattgagaccaaaaactacgttcagactcaggccattctccctcctgtgttttcttctttcaataaagatttctccgattccatggtcaaacttggtttcgtccaaattcttaccggcaaaaatggtgagatcaggaagagatgcgccttccctaactaatttggatcgatcagaccgggtttcggatgattttgagtctacacgtttttctctgcttattttctttctttttcttttttctttcacggaagtttgagctttggtgttgtcttcttctgtttcttccatgaataattgttttttgttgagtaactttacatttgtattctttacggtgactgtgttttgtaatggaaaaagtttgtttcgaattc

SEQ ID NO: 1612 - protein, 1258 aa, Arabidopsis thaliana
  misc_feature: GI Number: 34905882; NR Description: P0458E05.17 [Oryza sativa (japonica cultivar-group)] >gi|21902069|dbj|BAC05617.1|
ATCTCCAAAGCTCGTTCTCACCTTACTTGGCAAACACTCAACGAAGAAAGGAGAGAGAGACGGTAATGGCGATCAAGAACATTCTCGCCCTTGTGGTTCTTCTTAGCGTGGTTGGAGTTTCTGTCGCCATTCCACAGTTGCTTGACCTCGACTACTACCGGTCTAAGTGTCCCAAGGCAGAGGAAATTGTTCGTGGTGTCACAGTACAATATGTTTCTCGCCAGAAAACCCTTGCCGCTAAACTTCTAAGGATGCATTTCCATGATTGTTTCGTCAGAGGATGTGATGGTTCCGTTCTTCTGAAATCTGCAAAGAATGATGCGGAAAGAGACGCTGTCCCCAACCTGACCCTGAAAGGTTATGAAGTGGTGGATGCGGCCAAGACAGCGCTGGAGAGGAAGTGTCCTAATCTCATTTCTTGCGCTGATGTTCTTGCCTTGGTCGCCAGAGATGCCGTGGCAGTGATCGGGGGACCATGGTGGCCGGTTCCATTGGGCCGCAGGGATGGACGCATCTCGAAATTGAACGATGCATTGCTAAATTTACCATCTCCTTTCGCCGACATAAAGACGCTGAAGAAGAACTTTGCCAACAAGGGTCTTAACGCTAAAGACCTTGTGGTTCTCTCAGGGGGTCACACCATTGGAATCTCTAGTTGCGCTCTCGTCAACAGTCGTCTCTACAACTTCACAGGAAAGGGCGATTCTGACCCATCCATGAACCCTAGCTACGTGAGGGAATTGAAGAGAAAGTGCCCGCCTACAGATTTCAGAACCTCACTGAACATGGACCCAGGCAGTGCGTTGACATTCGACACTCACTACTTCAAGGTCGTGGCTCAGAAGAAAGGGCTCTTCACATCTGACTCTACGCTTCTCGATGACATTGAGACCAAAAACTACGTTCAGACTCAGGCCATTCTCCCTCCTGTGTTTTCTTCTTTCAATAAAGATTTCTCCGATTCCATGGTCAAACTTGGTTTCGTCCAAATTCTTACCGGCAAAAATGGTGAGATCAGGAAGAGATGCGCCTTCCCTAACTAATTTGGATCGATCAGACCGGGTTTCGGATGATTTTGAGTCTACACGTTTTTCTCTGCTTATTTTCTTTCTTTTTCTTTTTTCTTTCACGGAAGTTTGAGCTTTGGTGTTGTCTTCTTCTGTTTCTTCCATGAATAATTGTTTTTTGTTGAGTAACTTTACATTTGTATTCTTTACGGTGACTGTGTTTTGTAATGGAAAAAGTTTGTTTCGAATTC

SEQ ID NO: 1613 - DNA, 1743 bp, Arabidopsis thaliana
  misc_feature (1)..(1743): Ceres cDNA ID no. 12660531
  misc_feature (1)..(1743): Also known as  Ceres CDNA ID no. 23659454
atgctaactctttccaagtttcatgtgatactaatcccaatactcttcttcattacgcttctttcgccattgttctccattgctctacctatcaacatttggccaaagccgagatttctctcatggcctcaacataaagccattgcactctctccaaatttcactatccttgcccctgaacaccaatacctttcggcctctgtaacacggtatcacaacctgatccgttctgagaattactcgcctctcattagctatcctgtcaaacttatgaaaagatacaccttgaggaaccttgtagtcactgttaccgatttttctcttccgcttcaccacggtgttgatgagtcttacaaactctccatccccattggcagcttctccgcgcacttgttagctcattcggcttggggagctatgcgtggccttgagacattctctcagatgatttggggaacatctcctgatttgtgcttacccgttggaatttatattcaggattctcctctgtttggccatagaggtgttttgctcgatacatcgaggaattactatggagtagatgatataatgaggactattaaggccatgagtgcaaacaaactcaatgtgttccattggcatatcactgattcacaatcttttccactggtgcttccttctgaaccttcacttgctgcaaaaggatctcttggaccagacatggtatacactcccgaggatgtctcaaagattgttcagtatggttttgagcatggtgttagagtacttcctgaaatagacactcctggtcatacaggatcatggggagaagcttacccggaaattgtgacatgtgccaatatgttctggtggcctgctggaaaaagttgggaagagcggttagctagtgaacctgggactggtcagcttaaccctttgagtcctaaaacatatgaagttgttaaaaacgtcatacaagatatcgttaatcaatttccagaatctttctttcatggaggtggagatgaagttatcccaggctgttggaaaaccgatcctgccatcaattctttcttgtcctctggtggaacactaagccagcttcttgaaaagtacataaactcgacattaccttacatcgtgtcacagaaccgcacagttgtttactgggaagatgttctgttggatgcacaaatcaaggcggatccatctgttcttcctaaagagcacacaatcttacagacttggaataacggtccggagaacacaaagagaatcgtagctgctggttacagagtaattgtctcttcatcagagttctactacttagactgtggtcacggcgggtttctagggaatgatagtatatatgatcagaaagaaagcggtggcgggtcttggtgtgcaccatttaagacgtggcagagcatatacaactatgatatagctgatggtttgctcaatgaggaagagaggaagctggtgctaggaggagaggttgcattgtggtcagagcaagctgactcgacggttttagactcacgtctttggccacgtgcctctgcgttggcggagagcttgtggtcagggaatagagacgagagaggtgttaagagatgtggtgaagccgtggaccgtttaaacctgtggaggtataggatggttaagagagggattggagctgaacctatccaaccattgtggtgtttgaagaatcctggaatgtgtaatacagtccatggtgctcttcaagatcaataa

SEQ ID NO: 1614 - protein, 1743 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGCTAACTCTTTCCAAGTTTCATGTGATACTAATCCCAATACTCTTCTTCATTACGCTTCTTTCGCCATTGTTCTCCATTGCTCTACCTATCAACATTTGGCCAAAGCCGAGATTTCTCTCATGGCCTCAACATAAAGCCATTGCACTCTCTCCAAATTTCACTATCCTTGCCCCTGAACACCAATACCTTTCGGCCTCTGTAACACGGTATCACAACCTGATCCGTTCTGAGAATTACTCGCCTCTCATTAGCTATCCTGTCAAACTTATGAAAAGATACACCTTGAGGAACCTTGTAGTCACTGTTACCGATTTTTCTCTTCCGCTTCACCACGGTGTTGATGAGTCTTACAAACTCTCCATCCCCATTGGCAGCTTCTCCGCGCACTTGTTAGCTCATTCGGCTTGGGGAGCTATGCGTGGCCTTGAGACATTCTCTCAGATGATTTGGGGAACATCTCCTGATTTGTGCTTACCCGTTGGAATTTATATTCAGGATTCTCCTCTGTTTGGCCATAGAGGTGTTTTGCTCGATACATCGAGGAATTACTATGGAGTAGATGATATAATGAGGACTATTAAGGCCATGAGTGCAAACAAACTCAATGTGTTCCATTGGCATATCACTGATTCACAATCTTTTCCACTGGTGCTTCCTTCTGAACCTTCACTTGCTGCAAAAGGATCTCTTGGACCAGACATGGTATACACTCCCGAGGATGTCTCAAAGATTGTTCAGTATGGTTTTGAGCATGGTGTTAGAGTACTTCCTGAAATAGACACTCCTGGTCATACAGGATCATGGGGAGAAGCTTACCCGGAAATTGTGACATGTGCCAATATGTTCTGGTGGCCTGCTGGAAAAAGTTGGGAAGAGCGGTTAGCTAGTGAACCTGGGACTGGTCAGCTTAACCCTTTGAGTCCTAAAACATATGAAGTTGTTAAAAACGTCATACAAGATATCGTTAATCAATTTCCAGAATCTTTCTTTCATGGAGGTGGAGATGAAGTTATCCCAGGCTGTTGGAAAACCGATCCTGCCATCAATTCTTTCTTGTCCTCTGGTGGAACACTAAGCCAGCTTCTTGAAAAGTACATAAACTCGACATTACCTTACATCGTGTCACAGAACCGCACAGTTGTTTACTGGGAAGATGTTCTGTTGGATGCACAAATCAAGGCGGATCCATCTGTTCTTCCTAAAGAGCACACAATCTTACAGACTTGGAATAACGGTCCGGAGAACACAAAGAGAATCGTAGCTGCTGGTTACAGAGTAATTGTCTCTTCATCAGAGTTCTACTACTTAGACTGTGGTCACGGCGGGTTTCTAGGGAATGATAGTATATATGATCAGAAAGAAAGCGGTGGCGGGTCTTGGTGTGCACCATTTAAGACGTGGCAGAGCATATACAACTATGATATAGCTGATGGTTTGCTCAATGAGGAAGAGAGGAAGCTGGTGCTAGGAGGAGAGGTTGCATTGTGGTCAGAGCAAGCTGACTCGACGGTTTTAGACTCACGTCTTTGGCCACGTGCCTCTGCGTTGGCGGAGAGCTTGTGGTCAGGGAATAGAGACGAGAGAGGTGTTAAGAGATGTGGTGAAGCCGTGGACCGTTTAAACCTGTGGAGGTATAGGATGGTTAAGAGAGGGATTGGAGCTGAACCTATCCAACCATTGTGGTGTTTGAAGAATCCTGGAATGTGTAATACAGTCCATGGTGCTCTTCAAGATCAATAA

SEQ ID NO: 1615 - DNA, 1242 bp, Arabidopsis thaliana
  misc_feature (1)..(1242): Ceres cDNA ID no. 12660749
  misc_feature (1)..(1242): Also known as  Ceres CDNA ID no. 23659454
actttctcagtctttcttcttcttcttcgttgtgataggtcaggtcagggaacaacaatggcttcttctgcaacagcaccaaattcgctatctttcttctcatcttctctctttttatcctcctctcaccaaatccctaaaacctacatttccgtttcaaaactcggctccggcagagtctcgaagccgctttctgtctcttcccagctagcgactctaccgattctatcattcgaaggagagaaggtcggagagacgtatctagacctcaaagcggcgccggaggataccgcgcgtgccgttgtgcaccgagccatcgtgacggacctgaataacaagcggcgaggtactgcttccacactgactcgcggtgaagttcgtggtggtggaattaaaccttactcacagaagaaaactggccacgcgaggcgtggatctcagagaacaccgttacgtcccggtggaggtgtggtgtttgggccaagacctaaggattggtcaattaaaatcaataggaaggagaagaagctagcgatatctacggcgttatcgagtgcggcatctgcggaaggtggtgcgatagtggtggaggaatttggggagaagtttgagaagcccaagactaaagatttcttagctgcgatgcaaaggtggggattggatcccaaggagaaagctatgttcttgatgattgatgtggatgagaatgtggcgaaatcgagtaggaacattggaaccttgaggatgttgacgcctaggacactgaatctgtttgatattttgaacgctgataagcttgttctgactcctgcggctgtggagttcttgaatgcgaggtacggtgttgatgcggtggaggaagaagatgacgatgaagatgagacggaagggtcagaggaagcttaagaatgagtagcacccgtagttccaattgcttcaagtgtggcttaattatgagtttaatcttgagtacatcttctcactctccttgatgaggtcttctctttcctttttgtgtcacaacaagagaaatgtgtatttacttttagagtttttcttaagagatcatcctcaatttcttgtcatactgattttgtgtccaactctcaatgaaggagtaaggagtgaaattagatatcatgagtaacgttgattgtgtgtgtatcagttaagattgagcaacaaagattgactttagtcatcaagttaacaagaaagagtggctattataagctttaagcg

SEQ ID NO: 1616 - protein, 1242 aa, Arabidopsis thaliana
  misc_feature: GI Number: 34905882; NR Description: P0458E05.17 [Oryza sativa (japonica cultivar-group)] >gi|21902069|dbj|BAC05617.1|
ACTTTCTCAGTCTTTCTTCTTCTTCTTCGTTGTGATAGGTCAGGTCAGGGAACAACAATGGCTTCTTCTGCAACAGCACCAAATTCGCTATCTTTCTTCTCATCTTCTCTCTTTTTATCCTCCTCTCACCAAATCCCTAAAACCTACATTTCCGTTTCAAAACTCGGCTCCGGCAGAGTCTCGAAGCCGCTTTCTGTCTCTTCCCAGCTAGCGACTCTACCGATTCTATCATTCGAAGGAGAGAAGGTCGGAGAGACGTATCTAGACCTCAAAGCGGCGCCGGAGGATACCGCGCGTGCCGTTGTGCACCGAGCCATCGTGACGGACCTGAATAACAAGCGGCGAGGTACTGCTTCCACACTGACTCGCGGTGAAGTTCGTGGTGGTGGAATTAAACCTTACTCACAGAAGAAAACTGGCCACGCGAGGCGTGGATCTCAGAGAACACCGTTACGTCCCGGTGGAGGTGTGGTGTTTGGGCCAAGACCTAAGGATTGGTCAATTAAAATCAATAGGAAGGAGAAGAAGCTAGCGATATCTACGGCGTTATCGAGTGCGGCATCTGCGGAAGGTGGTGCGATAGTGGTGGAGGAATTTGGGGAGAAGTTTGAGAAGCCCAAGACTAAAGATTTCTTAGCTGCGATGCAAAGGTGGGGATTGGATCCCAAGGAGAAAGCTATGTTCTTGATGATTGATGTGGATGAGAATGTGGCGAAATCGAGTAGGAACATTGGAACCTTGAGGATGTTGACGCCTAGGACACTGAATCTGTTTGATATTTTGAACGCTGATAAGCTTGTTCTGACTCCTGCGGCTGTGGAGTTCTTGAATGCGAGGTACGGTGTTGATGCGGTGGAGGAAGAAGATGACGATGAAGATGAGACGGAAGGGTCAGAGGAAGCTTAAGAATGAGTAGCACCCGTAGTTCCAATTGCTTCAAGTGTGGCTTAATTATGAGTTTAATCTTGAGTACATCTTCTCACTCTCCTTGATGAGGTCTTCTCTTTCCTTTTTGTGTCACAACAAGAGAAATGTGTATTTACTTTTAGAGTTTTTCTTAAGAGATCATCCTCAATTTCTTGTCATACTGATTTTGTGTCCAACTCTCAATGAAGGAGTAAGGAGTGAAATTAGATATCATGAGTAACGTTGATTGTGTGTGTATCAGTTAAGATTGAGCAACAAAGATTGACTTTAGTCATCAAGTTAACAAGAAAGAGTGGCTATTATAAGCTTTAAGCG

SEQ ID NO: 1617 - DNA, 2433 bp, Arabidopsis thaliana
  misc_feature (1)..(2433): Ceres cDNA ID no. 12661047
  misc_feature (1)..(2433): Also known as  Ceres CDNA ID no. 23659454
atggctacaaattctacaaaagcttgtcctgctccgatgaaagcaacctctaatggagttttccaaggagataaccctatagactttgcgttacctcttgcgattctgcagatagttattgttatagttctcactcgtgttcttgcttaccttttaagacctttgagacagcctcgtgttattgctgaagttattggtgggattatgcttggaccttctcttcttggtcgttccaaggcttttctagacgctgtgttcccgaagaaaagcttgactgttcttgaaactctggctaatctcggccttctcttcttccttttccttgctggtctagagattgataccaaagcccttcgtcgcaccgggaaaaaggctttgggaattgccttggctggaataaccctcccgtttgctcttggcattggttcttcattcgttttaaaagcaacaatctccaaaggagtgaatagtaccgcgtttctcgtcttcatgggtgtggcactctctatcactgcattccctgtgttggcccgtatcttagcggagctaaagcttctaactactgagataggacgacttgctatgtcggcagctgccgttaacgatgtggcagcttggattctacttgctctagccattgctctctcgggatccaatacctctccccttgtctctctctgggttttcctttccgggtgtgcttttgttatcggtgcgtctttcatcattccaccaatctttagatggatttcccggaggtgccacgagggagaacctatcgaggaaacctacatctgtgccactttggctgtagttcttgtttgtggattcataactgatgccattggaatccactccatgtttggtgcctttgtggtgggtgttttgattccaaaggaaggaccttttgctggtgcactagttgagaaggtggaagatcttgtatccggtctcttcctgccgctttactttgtggcaagtggtctgaaaactaatgtggcaacgatccaaggagctcagtcttggggtcttctggttttagtcaccgccacagcttgtttcggtaagatattgggcactctcggtgtttccctcgccttcaagatacctatgcgagaagcaataacattaggattcctcatgaacactaaaggattggtcgaactcatcgtcctcaacatcggaaaagatcgaaaggttcttaatgatcagacatttgccataatggttctaatggctctcttcacaaccttcatcaccacaccagtcgtaatggcagtctacaaaccagcgagaagagcgaagaaagaaggagaatacaaacacagggcagtagaacgagagaacacaaacacacagcttcgaatcctcacatgtttccacggagcaggaagcattccttcaatgataaacctcctagaagcatcaagaggtatcgaaaaaggcgaagggctctgcgtttacgctctccacttacgggaactatcagagagatcatcagctattctaatggttcataaagttcggaaaaacggaatgccgttttggaacagaagaggagtaaacgcagacgctgatcaagtagtagttgctttccaagcttttcaacagctaagcagagtcaatgtccgaccaatgacagcaatctcttcaatgtctgatattcatgaagatatctgcacaacagctgtaagaaaaaaagcagccattgtgattcttccgtttcacaagcatcaacagcttgatggttcgttagagactacacgtggcgattaccgttgggttaaccggagagttttgcttcaagctccttgttcggttggtatattcgttgaccgtggactcggaggttcaagtcaagtctcagctcaagatgtttcttactctgttgttgttctgttcttcggtggtcctgatgatcgtgaagcgttggcttatggattacgtatggcggagcatcccggaattgttttgactgttttccgatttgtggtatcgccggagagagtcggagagattgttaatgttgaagtgagtaacaataacaacgagaatcagagtgtgaagaatctgaaatcggatgaggagattatgtctgagataaggaagatatcttcggtggacgaatcggttaagttcgtggagaaacagattgaaaacgccgccgtggatgttagatcggcgattgaggaagtgcggcggagcaatttgtttttggttggtagaatgccaggtggagaaattgcattggcgattagggagaatagtgaatgtccggagcttggacctgtaggaagcttgttgatttcgccggaatcttcgacaaaagcatcggttttggtgattcagcagtacaacggcaccggaatagctccggatttgggtgcggctgagacggaggtattgacttctacggataaagactctgattga

SEQ ID NO: 1618 - protein, 2433 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGGCTACAAATTCTACAAAAGCTTGTCCTGCTCCGATGAAAGCAACCTCTAATGGAGTTTTCCAAGGAGATAACCCTATAGACTTTGCGTTACCTCTTGCGATTCTGCAGATAGTTATTGTTATAGTTCTCACTCGTGTTCTTGCTTACCTTTTAAGACCTTTGAGACAGCCTCGTGTTATTGCTGAAGTTATTGGTGGGATTATGCTTGGACCTTCTCTTCTTGGTCGTTCCAAGGCTTTTCTAGACGCTGTGTTCCCGAAGAAAAGCTTGACTGTTCTTGAAACTCTGGCTAATCTCGGCCTTCTCTTCTTCCTTTTCCTTGCTGGTCTAGAGATTGATACCAAAGCCCTTCGTCGCACCGGGAAAAAGGCTTTGGGAATTGCCTTGGCTGGAATAACCCTCCCGTTTGCTCTTGGCATTGGTTCTTCATTCGTTTTAAAAGCAACAATCTCCAAAGGAGTGAATAGTACCGCGTTTCTCGTCTTCATGGGTGTGGCACTCTCTATCACTGCATTCCCTGTGTTGGCCCGTATCTTAGCGGAGCTAAAGCTTCTAACTACTGAGATAGGACGACTTGCTATGTCGGCAGCTGCCGTTAACGATGTGGCAGCTTGGATTCTACTTGCTCTAGCCATTGCTCTCTCGGGATCCAATACCTCTCCCCTTGTCTCTCTCTGGGTTTTCCTTTCCGGGTGTGCTTTTGTTATCGGTGCGTCTTTCATCATTCCACCAATCTTTAGATGGATTTCCCGGAGGTGCCACGAGGGAGAACCTATCGAGGAAACCTACATCTGTGCCACTTTGGCTGTAGTTCTTGTTTGTGGATTCATAACTGATGCCATTGGAATCCACTCCATGTTTGGTGCCTTTGTGGTGGGTGTTTTGATTCCAAAGGAAGGACCTTTTGCTGGTGCACTAGTTGAGAAGGTGGAAGATCTTGTATCCGGTCTCTTCCTGCCGCTTTACTTTGTGGCAAGTGGTCTGAAAACTAATGTGGCAACGATCCAAGGAGCTCAGTCTTGGGGTCTTCTGGTTTTAGTCACCGCCACAGCTTGTTTCGGTAAGATATTGGGCACTCTCGGTGTTTCCCTCGCCTTCAAGATACCTATGCGAGAAGCAATAACATTAGGATTCCTCATGAACACTAAAGGATTGGTCGAACTCATCGTCCTCAACATCGGAAAAGATCGAAAGGTTCTTAATGATCAGACATTTGCCATAATGGTTCTAATGGCTCTCTTCACAACCTTCATCACCACACCAGTCGTAATGGCAGTCTACAAACCAGCGAGAAGAGCGAAGAAAGAAGGAGAATACAAACACAGGGCAGTAGAACGAGAGAACACAAACACACAGCTTCGAATCCTCACATGTTTCCACGGAGCAGGAAGCATTCCTTCAATGATAAACCTCCTAGAAGCATCAAGAGGTATCGAAAAAGGCGAAGGGCTCTGCGTTTACGCTCTCCACTTACGGGAACTATCAGAGAGATCATCAGCTATTCTAATGGTTCATAAAGTTCGGAAAAACGGAATGCCGTTTTGGAACAGAAGAGGAGTAAACGCAGACGCTGATCAAGTAGTAGTTGCTTTCCAAGCTTTTCAACAGCTAAGCAGAGTCAATGTCCGACCAATGACAGCAATCTCTTCAATGTCTGATATTCATGAAGATATCTGCACAACAGCTGTAAGAAAAAAAGCAGCCATTGTGATTCTTCCGTTTCACAAGCATCAACAGCTTGATGGTTCGTTAGAGACTACACGTGGCGATTACCGTTGGGTTAACCGGAGAGTTTTGCTTCAAGCTCCTTGTTCGGTTGGTATATTCGTTGACCGTGGACTCGGAGGTTCAAGTCAAGTCTCAGCTCAAGATGTTTCTTACTCTGTTGTTGTTCTGTTCTTCGGTGGTCCTGATGATCGTGAAGCGTTGGCTTATGGATTACGTATGGCGGAGCATCCCGGAATTGTTTTGACTGTTTTCCGATTTGTGGTATCGCCGGAGAGAGTCGGAGAGATTGTTAATGTTGAAGTGAGTAACAATAACAACGAGAATCAGAGTGTGAAGAATCTGAAATCGGATGAGGAGATTATGTCTGAGATAAGGAAGATATCTTCGGTGGACGAATCGGTTAAGTTCGTGGAGAAACAGATTGAAAACGCCGCCGTGGATGTTAGATCGGCGATTGAGGAAGTGCGGCGGAGCAATTTGTTTTTGGTTGGTAGAATGCCAGGTGGAGAAATTGCATTGGCGATTAGGGAGAATAGTGAATGTCCGGAGCTTGGACCTGTAGGAAGCTTGTTGATTTCGCCGGAATCTTCGACAAAAGCATCGGTTTTGGTGATTCAGCAGTACAACGGCACCGGAATAGCTCCGGATTTGGGTGCGGCTGAGACGGAGGTATTGACTTCTACGGATAAAGACTCTGATTGA

SEQ ID NO: 1619 - DNA, 1008 bp, Arabidopsis thaliana
  misc_feature (1)..(1008): Ceres cDNA ID no. 12661547
  misc_feature (1)..(1008): Also known as  Ceres CDNA ID no. 23659454
atggctccagtgaaaaaatcagataagaaagcaacattagatgctgctgcttggatgttcaatgttgttacttctgttggtatcatcattgttaataaagctttaatggctacttatggctttagctttgctacaacgttaaccggtttacatttcgccactacgacgttgatgacgcttgttttaagatgtttaggatatatacaaccttctcatcttccatttacagagcttcttaagtttattctgtttgctaatttttcgattgttggaatgaatgttagtcttatgtggaactctgttgggttttatcagattgcaaagcttagcatgattcctgtatcatgcttgttggaagtagtatttgataagattcgttactcaagagatacaaaacttagcattggacttgttcttgttggtgttggtgtttgtactgttactgatgttagtgttaacaccaaaggttttgttgctgcttttgttgctgtgtggagtactgctttgcaacaatactatgtacattatctacagcgaaagtactcgcttagctcattcaacctactgggtcatactgctccagctcaggctgcaacgttattgatagtcggtccatttctcgactattggttgacagacaaacgggtagacatgtatgattacaactctgtctctgtgatgtttataaccctctcgtgcacaatagcaatcgggacaaacctgagccagttcatctgcatcgggagattcacagcagtgtcattccaagtcctgggccatatgaagacgatcttggtgcttgtaatgggcttcttcttctttgacagagatggtctaaacctgcatgtgattcttggcatgatcattgcagtactcgggatgatctggtacggtaatgcctcgtccaagccaggcggcaaggagaagaagaattattctcttccaacgacccgacaacagaaacttggggctacttcagattctgatgaacatcgagataaagcgtag

SEQ ID NO: 1620 - protein, 1008 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGGCTCCAGTGAAAAAATCAGATAAGAAAGCAACATTAGATGCTGCTGCTTGGATGTTCAATGTTGTTACTTCTGTTGGTATCATCATTGTTAATAAAGCTTTAATGGCTACTTATGGCTTTAGCTTTGCTACAACGTTAACCGGTTTACATTTCGCCACTACGACGTTGATGACGCTTGTTTTAAGATGTTTAGGATATATACAACCTTCTCATCTTCCATTTACAGAGCTTCTTAAGTTTATTCTGTTTGCTAATTTTTCGATTGTTGGAATGAATGTTAGTCTTATGTGGAACTCTGTTGGGTTTTATCAGATTGCAAAGCTTAGCATGATTCCTGTATCATGCTTGTTGGAAGTAGTATTTGATAAGATTCGTTACTCAAGAGATACAAAACTTAGCATTGGACTTGTTCTTGTTGGTGTTGGTGTTTGTACTGTTACTGATGTTAGTGTTAACACCAAAGGTTTTGTTGCTGCTTTTGTTGCTGTGTGGAGTACTGCTTTGCAACAATACTATGTACATTATCTACAGCGAAAGTACTCGCTTAGCTCATTCAACCTACTGGGTCATACTGCTCCAGCTCAGGCTGCAACGTTATTGATAGTCGGTCCATTTCTCGACTATTGGTTGACAGACAAACGGGTAGACATGTATGATTACAACTCTGTCTCTGTGATGTTTATAACCCTCTCGTGCACAATAGCAATCGGGACAAACCTGAGCCAGTTCATCTGCATCGGGAGATTCACAGCAGTGTCATTCCAAGTCCTGGGCCATATGAAGACGATCTTGGTGCTTGTAATGGGCTTCTTCTTCTTTGACAGAGATGGTCTAAACCTGCATGTGATTCTTGGCATGATCATTGCAGTACTCGGGATGATCTGGTACGGTAATGCCTCGTCCAAGCCAGGCGGCAAGGAGAAGAAGAATTATTCTCTTCCAACGACCCGACAACAGAAACTTGGGGCTACTTCAGATTCTGATGAACATCGAGATAAAGCGTAG

SEQ ID NO: 1621 - DNA, 1505 bp, Arabidopsis thaliana
  misc_feature (1)..(1505): Ceres cDNA ID no. 12662627
  misc_feature (1)..(1505): Also known as  Ceres CDNA ID no. 23659454
aaaacctttccttcttctttctttacaaatccaacaatctcaatgtctccaaatccataactttcttcgatccccttgttcttcctctgtctgctgttacattttttacaaaaccctaatcaaacccattttcttctatcaatcttaaccctagaatcaaataaagactcaatctttctttgctttgctctgttctgctctgtttttgctctgtttttataatggcttgtttcttgaattgtgttagatttgatgtctccaagacgatcaccgacaaacccacaagtcaaggatctggtgtgacttgttataacagctgggatgatgttgaaactctcacttccaatttctctagattgattggttctggtggctatagcagtatctacatggctcgcttctctggctctgataaagcggctctcaaggttcatgttagtagtcaccgtctttatcaagtctttagacttgagcttgatattttgcttcgtcttcaacatcctaacattgtcaagcttcttggctatttcgatgattcagaggaaaatggtgctcttcttcttgagtatcttcctcaaggaaatctacaagagaagctccaaagcaatagcaagcaagtcttgcaatggaggaaccgtgtagcgattgcgttacagttagttcaagctattgaacatattcatgagaaatgtagcccgcagatagtgcacggggacatcaaatcttccaacgttcttctagacaaaaactttgattgcaagctttgcgatttcgggtcagctaaagtcgggttctcttcgatggttcagcctcctacgatgtcgcctagatctagacaagtgaagatggtgggatctccaggttacacagaccctcattatttaagaaccgggattgcttcgaagaagatggatatgtatgggtttggagttgtggttcttgagttggtttcaggaaaagaagcgttttctgctgagagaggtgagatgctggtgcatatagctgctccacttatgaatgagattttggattcgagtgtagacatttcagaggacaaggtcagacagttcttggacccgaggttgttaagggatagtcttgatatcgatgaggtcaagacaatgttgagtgttgctgcggtctgtatcagtagcaagctatctctaagaccttcggctgctcaagtagcggatactcttataaaggaaataccatcattgagtttcctcggttgcggtaaaggagtgtgagttatcggtgtcgatggtttttgttgtagtgtggtaaggctgcgtgaacgacactgtaaagttggtgtgcatttaggagtttcttggaaaaccagcaagaagaataaccatgtaaatactcttgttttgttttgtgaatagaagcaggaaataacattttgtctaattatcattcatcaacatttcctaggaaatgtaattttgattgttgttttgtcttgaaatcttagagagaaagagaagttctgttcatgt

SEQ ID NO: 1622 - protein, 1505 aa, Arabidopsis thaliana
  misc_feature: GI Number: 34905882; NR Description: P0458E05.17 [Oryza sativa (japonica cultivar-group)] >gi|21902069|dbj|BAC05617.1|
AAAACCTTTCCTTCTTCTTTCTTTACAAATCCAACAATCTCAATGTCTCCAAATCCATAACTTTCTTCGATCCCCTTGTTCTTCCTCTGTCTGCTGTTACATTTTTTACAAAACCCTAATCAAACCCATTTTCTTCTATCAATCTTAACCCTAGAATCAAATAAAGACTCAATCTTTCTTTGCTTTGCTCTGTTCTGCTCTGTTTTTGCTCTGTTTTTATAATGGCTTGTTTCTTGAATTGTGTTAGATTTGATGTCTCCAAGACGATCACCGACAAACCCACAAGTCAAGGATCTGGTGTGACTTGTTATAACAGCTGGGATGATGTTGAAACTCTCACTTCCAATTTCTCTAGATTGATTGGTTCTGGTGGCTATAGCAGTATCTACATGGCTCGCTTCTCTGGCTCTGATAAAGCGGCTCTCAAGGTTCATGTTAGTAGTCACCGTCTTTATCAAGTCTTTAGACTTGAGCTTGATATTTTGCTTCGTCTTCAACATCCTAACATTGTCAAGCTTCTTGGCTATTTCGATGATTCAGAGGAAAATGGTGCTCTTCTTCTTGAGTATCTTCCTCAAGGAAATCTACAAGAGAAGCTCCAAAGCAATAGCAAGCAAGTCTTGCAATGGAGGAACCGTGTAGCGATTGCGTTACAGTTAGTTCAAGCTATTGAACATATTCATGAGAAATGTAGCCCGCAGATAGTGCACGGGGACATCAAATCTTCCAACGTTCTTCTAGACAAAAACTTTGATTGCAAGCTTTGCGATTTCGGGTCAGCTAAAGTCGGGTTCTCTTCGATGGTTCAGCCTCCTACGATGTCGCCTAGATCTAGACAAGTGAAGATGGTGGGATCTCCAGGTTACACAGACCCTCATTATTTAAGAACCGGGATTGCTTCGAAGAAGATGGATATGTATGGGTTTGGAGTTGTGGTTCTTGAGTTGGTTTCAGGAAAAGAAGCGTTTTCTGCTGAGAGAGGTGAGATGCTGGTGCATATAGCTGCTCCACTTATGAATGAGATTTTGGATTCGAGTGTAGACATTTCAGAGGACAAGGTCAGACAGTTCTTGGACCCGAGGTTGTTAAGGGATAGTCTTGATATCGATGAGGTCAAGACAATGTTGAGTGTTGCTGCGGTCTGTATCAGTAGCAAGCTATCTCTAAGACCTTCGGCTGCTCAAGTAGCGGATACTCTTATAAAGGAAATACCATCATTGAGTTTCCTCGGTTGCGGTAAAGGAGTGTGAGTTATCGGTGTCGATGGTTTTTGTTGTAGTGTGGTAAGGCTGCGTGAACGACACTGTAAAGTTGGTGTGCATTTAGGAGTTTCTTGGAAAACCAGCAAGAAGAATAACCATGTAAATACTCTTGTTTTGTTTTGTGAATAGAAGCAGGAAATAACATTTTGTCTAATTATCATTCATCAACATTTCCTAGGAAATGTAATTTTGATTGTTGTTTTGTCTTGAAATCTTAGAGAGAAAGAGAAGTTCTGTTCATGT

SEQ ID NO: 1623 - DNA, 1020 bp, Arabidopsis thaliana
  misc_feature (1)..(1020): Ceres cDNA ID no. 12662864
  misc_feature (1)..(1020): Also known as  Ceres CDNA ID no. 23659454
atggatccagttcaatctcatggatcacaaagctctcttcctcctcctttccatgctagagatttccaattacatcttcaacaacaacaacaacatcaacaacaacatcaacaacaacaacaacaacagttctttctccaccatcatcagcaaccacaaagaaaccttgatcaagatcacgagcagcaaggagggtcaatattgaatagatctatcaagatggatcgcgaagagacaagcgataacatggacaacatcgctaataccaacagcggtagcgaaggtaaagagatgagtttacacggaggagaaggaggaagcggtggtggaggaagtggagaacagatgacaagaaggccaagaggaagaccagcaggatccaagaacaaacctaaagctccaataatcataacaagagacagcgcaaacgcgcttcgaactcacgtcatggagataggagacggatgtgacatagttgactgtatggctacgttcgctagacgccgccaaagaggcgtttgcgttatgagcggtacaggaagcgttactaacgtcactatacgtcagcctggatcgccacctggctcggtggttagccttcacggccggtttgaaatcctctctctttcgggatctttcttgcctccgcctgcgccgcctgcagccaccggactaagcgtttacctagccggaggacaagggcaggtcgttggaggtagtgtggtgggacctttgttgtgttcgggtcctgtggtggttatggcggcttcttttagcaatgcggcgtacgaaaggctgcctttggaagaagatgagatgcagacgccagttcaaggaggcggtggaggaggaggaggtggtggtggaatgggatctcccccgatgatgggacagcaacaagctatggcagctatggcggcggctcaaggactaccaccgaatcttcttggttcggttcagttgccaccgccacaacagaatgatcagcagtattggtctacgggtcggccaccgtattga

SEQ ID NO: 1624 - protein, 1020 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGGATCCAGTTCAATCTCATGGATCACAAAGCTCTCTTCCTCCTCCTTTCCATGCTAGAGATTTCCAATTACATCTTCAACAACAACAACAACATCAACAACAACATCAACAACAACAACAACAACAGTTCTTTCTCCACCATCATCAGCAACCACAAAGAAACCTTGATCAAGATCACGAGCAGCAAGGAGGGTCAATATTGAATAGATCTATCAAGATGGATCGCGAAGAGACAAGCGATAACATGGACAACATCGCTAATACCAACAGCGGTAGCGAAGGTAAAGAGATGAGTTTACACGGAGGAGAAGGAGGAAGCGGTGGTGGAGGAAGTGGAGAACAGATGACAAGAAGGCCAAGAGGAAGACCAGCAGGATCCAAGAACAAACCTAAAGCTCCAATAATCATAACAAGAGACAGCGCAAACGCGCTTCGAACTCACGTCATGGAGATAGGAGACGGATGTGACATAGTTGACTGTATGGCTACGTTCGCTAGACGCCGCCAAAGAGGCGTTTGCGTTATGAGCGGTACAGGAAGCGTTACTAACGTCACTATACGTCAGCCTGGATCGCCACCTGGCTCGGTGGTTAGCCTTCACGGCCGGTTTGAAATCCTCTCTCTTTCGGGATCTTTCTTGCCTCCGCCTGCGCCGCCTGCAGCCACCGGACTAAGCGTTTACCTAGCCGGAGGACAAGGGCAGGTCGTTGGAGGTAGTGTGGTGGGACCTTTGTTGTGTTCGGGTCCTGTGGTGGTTATGGCGGCTTCTTTTAGCAATGCGGCGTACGAAAGGCTGCCTTTGGAAGAAGATGAGATGCAGACGCCAGTTCAAGGAGGCGGTGGAGGAGGAGGAGGTGGTGGTGGAATGGGATCTCCCCCGATGATGGGACAGCAACAAGCTATGGCAGCTATGGCGGCGGCTCAAGGACTACCACCGAATCTTCTTGGTTCGGTTCAGTTGCCACCGCCACAACAGAATGATCAGCAGTATTGGTCTACGGGTCGGCCACCGTATTGA

SEQ ID NO: 1625 - DNA, 1278 bp, Arabidopsis thaliana
  misc_feature (1)..(1278): Ceres cDNA ID no. 12663078
  misc_feature (1)..(1278): Also known as  Ceres CDNA ID no. 23659454
atggttaccaatcgcgtagacgtcttctggcacgaaggaatgctccgacacgacgccgtagaaggcgtcttcgacactggatacgaccctggattcctcgacgtattggagaagcacccggagaacgccgatcgcgtcaggaacatgctttcgattctccgacgcggtcccatcgctcctcatgtcaattggtttaccggtcttccagcaatcgtttcggagcttctaatgtttcacacttcagagtacattgagaagctagtggaggcagataaatcaggagaaaggtgtgaaattgccgcaggtactttcatgagcccaggctcgtgggaagctgctcttcttgcagctggaacaactctttcagcaatgcaacatattcttgattgccatgggaaaattgcatatgctctggtacgcccaccaggtcaccactcacagcctactcaggctgatgggtattgcttcctcaacaacgctgctcttgctgtcaagctggcattgaattcgggttcttgttcccgagttgcggttattgacatcgatgtacattatggaaatggcacagctgaagggttttatacatctgataaggttcttacggtgtcactccatatgaaccatggatcatggggatcgtcccacccgcagaaagggtcgattgatgaacttggtgaagacgtgggattgggttacaatctgaatgtccctttaccgaatggcacgggtgaccggggatatgaatatgccatgaatgagctggtggttcctgcagttagaaggtttggacccgatatggttgttctcgttgttggtcaagactctagcgctgtaagttctttctttgcccaaatacgtgtagactatctgactgagcacttactcagggttttgttcgcaattattgttttgtttgtgaggggatttgaatgtcatggactgacggataaccactatttactgtcggatctgcagtttgatccaaacgggagacaaagcctgacaatgaatggatacagaaggattgggcagataatgaggggagttgcagaggagcacagccatggaaggttgcttatggtgcaagaaggcgggtatcatgtaacatatgcagcttactgcctccacgccatgctcgaaggggtgctgaagattccagaaccgcatctatctgatccgatcgcttattatcccgaagaagaagctaatgctgttgctgctgtggagtcaatcaaaacatatcacaccgaatttgttccatttctcagaggaacttga

SEQ ID NO: 1626 - protein, 1278 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGGTTACCAATCGCGTAGACGTCTTCTGGCACGAAGGAATGCTCCGACACGACGCCGTAGAAGGCGTCTTCGACACTGGATACGACCCTGGATTCCTCGACGTATTGGAGAAGCACCCGGAGAACGCCGATCGCGTCAGGAACATGCTTTCGATTCTCCGACGCGGTCCCATCGCTCCTCATGTCAATTGGTTTACCGGTCTTCCAGCAATCGTTTCGGAGCTTCTAATGTTTCACACTTCAGAGTACATTGAGAAGCTAGTGGAGGCAGATAAATCAGGAGAAAGGTGTGAAATTGCCGCAGGTACTTTCATGAGCCCAGGCTCGTGGGAAGCTGCTCTTCTTGCAGCTGGAACAACTCTTTCAGCAATGCAACATATTCTTGATTGCCATGGGAAAATTGCATATGCTCTGGTACGCCCACCAGGTCACCACTCACAGCCTACTCAGGCTGATGGGTATTGCTTCCTCAACAACGCTGCTCTTGCTGTCAAGCTGGCATTGAATTCGGGTTCTTGTTCCCGAGTTGCGGTTATTGACATCGATGTACATTATGGAAATGGCACAGCTGAAGGGTTTTATACATCTGATAAGGTTCTTACGGTGTCACTCCATATGAACCATGGATCATGGGGATCGTCCCACCCGCAGAAAGGGTCGATTGATGAACTTGGTGAAGACGTGGGATTGGGTTACAATCTGAATGTCCCTTTACCGAATGGCACGGGTGACCGGGGATATGAATATGCCATGAATGAGCTGGTGGTTCCTGCAGTTAGAAGGTTTGGACCCGATATGGTTGTTCTCGTTGTTGGTCAAGACTCTAGCGCTGTAAGTTCTTTCTTTGCCCAAATACGTGTAGACTATCTGACTGAGCACTTACTCAGGGTTTTGTTCGCAATTATTGTTTTGTTTGTGAGGGGATTTGAATGTCATGGACTGACGGATAACCACTATTTACTGTCGGATCTGCAGTTTGATCCAAACGGGAGACAAAGCCTGACAATGAATGGATACAGAAGGATTGGGCAGATAATGAGGGGAGTTGCAGAGGAGCACAGCCATGGAAGGTTGCTTATGGTGCAAGAAGGCGGGTATCATGTAACATATGCAGCTTACTGCCTCCACGCCATGCTCGAAGGGGTGCTGAAGATTCCAGAACCGCATCTATCTGATCCGATCGCTTATTATCCCGAAGAAGAAGCTAATGCTGTTGCTGCTGTGGAGTCAATCAAAACATATCACACCGAATTTGTTCCATTTCTCAGAGGAACTTGA

SEQ ID NO: 1627 - DNA, 946 bp, Arabidopsis thaliana
  misc_feature (1)..(946): Ceres cDNA ID no. 12663366
  misc_feature (1)..(946): Also known as  Ceres CDNA ID no. 23659454
atggaaaatgttggtgttgggatgccgttttacgatttagggcaaacaagggtttacccactcttgtctgatttccacgatttatcggcggagaggtatccggtagggttcatggatttactgggtgttcatcgtcatacacccacccatacgccgttgatgcattttccgaccacacctaactcgtcctcgagcgaagctgtgaatggagatgacgaagaagaagaagatggagaagaacagcagcataagacaaagaagcggtttaaattcactaaaatgagtagaaagcagacgaagaagaaggtgccaaaagtgtcattcatcacgaggagtgaggttcttcatctagatgatggttataagtggagaaaatacggtcaaaaacctgtcaaagacagcccttttccaagaaattattaccgttgcacaacaacttggtgtgacgtgaagaagagagtagagagatcattcagtgatccaagcagtgtaatcaccacttacgaaggtcaacatactcatcctcgtccactactcatcatgcccaaagaaggcagctctccatccaatggctcagcttctagggcccacattggcctccctacactccctcctcagcttttagattacaacaaccaacaacaacaagcgccgtcttcttttggaaccgagtacattaacaggcaagaaaaaggaattaatcatgatgatgatgacgatcatgttgtgaagaagagtcgaactcgggatctgctggatggagctggtttagtcaaagatcatggccttcttcaggatgttgttccctctcatatcattaaggaagagtattagttaatcgcataattatgtagctagctagctaggtttattttttctaattgtcaggatccttacctctcatatcattaagggtgatgatgttcaagatgacacatgtatttga

SEQ ID NO: 1628 - protein, 946 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGGAAAATGTTGGTGTTGGGATGCCGTTTTACGATTTAGGGCAAACAAGGGTTTACCCACTCTTGTCTGATTTCCACGATTTATCGGCGGAGAGGTATCCGGTAGGGTTCATGGATTTACTGGGTGTTCATCGTCATACACCCACCCATACGCCGTTGATGCATTTTCCGACCACACCTAACTCGTCCTCGAGCGAAGCTGTGAATGGAGATGACGAAGAAGAAGAAGATGGAGAAGAACAGCAGCATAAGACAAAGAAGCGGTTTAAATTCACTAAAATGAGTAGAAAGCAGACGAAGAAGAAGGTGCCAAAAGTGTCATTCATCACGAGGAGTGAGGTTCTTCATCTAGATGATGGTTATAAGTGGAGAAAATACGGTCAAAAACCTGTCAAAGACAGCCCTTTTCCAAGAAATTATTACCGTTGCACAACAACTTGGTGTGACGTGAAGAAGAGAGTAGAGAGATCATTCAGTGATCCAAGCAGTGTAATCACCACTTACGAAGGTCAACATACTCATCCTCGTCCACTACTCATCATGCCCAAAGAAGGCAGCTCTCCATCCAATGGCTCAGCTTCTAGGGCCCACATTGGCCTCCCTACACTCCCTCCTCAGCTTTTAGATTACAACAACCAACAACAACAAGCGCCGTCTTCTTTTGGAACCGAGTACATTAACAGGCAAGAAAAAGGAATTAATCATGATGATGATGACGATCATGTTGTGAAGAAGAGTCGAACTCGGGATCTGCTGGATGGAGCTGGTTTAGTCAAAGATCATGGCCTTCTTCAGGATGTTGTTCCCTCTCATATCATTAAGGAAGAGTATTAGTTAATCGCATAATTATGTAGCTAGCTAGCTAGGTTTATTTTTTCTAATTGTCAGGATCCTTACCTCTCATATCATTAAGGGTGATGATGTTCAAGATGACACATGTATTTGA

SEQ ID NO: 1629 - DNA, 1077 bp, Arabidopsis thaliana
  misc_feature (1)..(1077): Ceres cDNA ID no. 12663464
  misc_feature (1)..(1077): Also known as  Ceres CDNA ID no. 23659454
atggctggtggtaacgaagtcaaccttaacgaatgcaagagaattgtcccactcaacacatgggtcctcatttccaatttcaagcttgcttacaaagtcctccgtcgccctgacggttctttcaaccgcgacctcgccgagttccttgaccgtaaagttcccgccaactctttccccctcgacggcgttttctccttcgaccacgtcgactcaacaactaaccttctcaccagaatctaccaacctgcgtctctccttcatcagacccgtcacggaaccctcgagctaaccaaacctctcagtactacagagatcgtccctgttctcattttcttccatggaggcagcttcactcattcctccgccaatagtgctatctacgacactttctgccgacgccttgtcaccatttgcggtgttgttgttgtctctgttgattaccggagatcccctgagcatcgctacccttgtgcttacgacgatggatggaacgctctcaactgggtcaagtccagagtctggcttcagagtggtaaagactccaatgtttatgtttatttggctggagatagctctggaggcaacattgctcacaatgtcgctgtcagagctaccaatgaaggagtcaaagtgttggggaacattcttcttcatccaatgtttggtggacaggagaggactcagtctgagaagacccttgatggcaaatactttgtgactatacaagatcgagattggtattggagggcttatctaccggaaggtgaagatagagatcatccagcatgtaatccctttggcccgagaggtcaaagccttaaaggagtcaactttccaaagagtcttgttgttgtcgctggtttagatcttgttcaagattggcaattagcctatgtggatgggcttaagaagactggtcttgaagtcaatcttttgtatttgaaacaagctaccattggcttttacttcttgcctaacaatgatcactttcattgtcttatggaagagttgaataagtttgtgcactccatagaggattctcaaagcaagtcaagtcctgtgcttcttactccttag

SEQ ID NO: 1630 - protein, 1077 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGGCTGGTGGTAACGAAGTCAACCTTAACGAATGCAAGAGAATTGTCCCACTCAACACATGGGTCCTCATTTCCAATTTCAAGCTTGCTTACAAAGTCCTCCGTCGCCCTGACGGTTCTTTCAACCGCGACCTCGCCGAGTTCCTTGACCGTAAAGTTCCCGCCAACTCTTTCCCCCTCGACGGCGTTTTCTCCTTCGACCACGTCGACTCAACAACTAACCTTCTCACCAGAATCTACCAACCTGCGTCTCTCCTTCATCAGACCCGTCACGGAACCCTCGAGCTAACCAAACCTCTCAGTACTACAGAGATCGTCCCTGTTCTCATTTTCTTCCATGGAGGCAGCTTCACTCATTCCTCCGCCAATAGTGCTATCTACGACACTTTCTGCCGACGCCTTGTCACCATTTGCGGTGTTGTTGTTGTCTCTGTTGATTACCGGAGATCCCCTGAGCATCGCTACCCTTGTGCTTACGACGATGGATGGAACGCTCTCAACTGGGTCAAGTCCAGAGTCTGGCTTCAGAGTGGTAAAGACTCCAATGTTTATGTTTATTTGGCTGGAGATAGCTCTGGAGGCAACATTGCTCACAATGTCGCTGTCAGAGCTACCAATGAAGGAGTCAAAGTGTTGGGGAACATTCTTCTTCATCCAATGTTTGGTGGACAGGAGAGGACTCAGTCTGAGAAGACCCTTGATGGCAAATACTTTGTGACTATACAAGATCGAGATTGGTATTGGAGGGCTTATCTACCGGAAGGTGAAGATAGAGATCATCCAGCATGTAATCCCTTTGGCCCGAGAGGTCAAAGCCTTAAAGGAGTCAACTTTCCAAAGAGTCTTGTTGTTGTCGCTGGTTTAGATCTTGTTCAAGATTGGCAATTAGCCTATGTGGATGGGCTTAAGAAGACTGGTCTTGAAGTCAATCTTTTGTATTTGAAACAAGCTACCATTGGCTTTTACTTCTTGCCTAACAATGATCACTTTCATTGTCTTATGGAAGAGTTGAATAAGTTTGTGCACTCCATAGAGGATTCTCAAAGCAAGTCAAGTCCTGTGCTTCTTACTCCTTAG

SEQ ID NO: 1631 - DNA, 1215 bp, Arabidopsis thaliana
  misc_feature (1)..(1215): Ceres cDNA ID no. 12663477
  misc_feature (1)..(1215): Also known as  Ceres CDNA ID no. 23659454
atggtgctcagaaacttaaccatttcttacgaaatcatcaaatctctgaaacatgccaaagaacatagtttagggattcaaatccgatggatctcgagcctgaaagtggtatggaagaaagacacgaggctagacgaagccatcgagcaggacaagcgttacaagctctgtgctcgggttgtgaaagaagtcctgaacgagccaggtcaagtcattcctctcagatacctcgaaaaacggcgcgagaggctacgtctcactttcaaagctaagagctttgttgaaatgaacccttccctgttcgagatctactacgatcggatcaaacccaagtccgatcccgtccaattcctccgccccacgcctcgtctcagagctttcctcgacgaagagcagaggatttactctgagaatgagcctttacttgtttccaagctctgccaattgctgatgatggctaaagataaggttatcagtgcagataaactggttcatgtgaagagagatttcggatttccgaacgattttctgatgaaattggttcagaaataccctaattacttcaggctaaccggtttacctgaagaaggtaagtcctttcttgagctagtctcttggaaccctgatttcgccaaatcgaagattgagctgagagcagaagacgagacccttaaaaccggtgtccggattcgacccaattacaatgtgaaattgccgtctggttttttcctaaggaaggagatgagagagtggactagggattggttagagcaagactacatatcaccatatgaggatgtgtctcatttagaccaagcttctaaggaaatggagaaacgaactgttggtgttgtgcacgaattgctttctctgtcactgttgaaaagagtccctgtgcctacacttggcaagttctgcgatgagttccggttttccaacgcgttctcgagtgttttcactcgtcattcaggtatattctacttgtcgttaaaaggagggatcaagactgcagtgttgagagaagcttataaagacgatgagcttgttgatagagatcctttgcttgctattaaggataagttcctgaggttattagaggaaggatggcaagaaaggaaagatagactgaagctgcagagggaacaagttcagaaagacagggagatgatgttagcagcgaaaagcaatgaaccgatagagcgtctctgtgattaa

SEQ ID NO: 1632 - protein, 1215 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGGTGCTCAGAAACTTAACCATTTCTTACGAAATCATCAAATCTCTGAAACATGCCAAAGAACATAGTTTAGGGATTCAAATCCGATGGATCTCGAGCCTGAAAGTGGTATGGAAGAAAGACACGAGGCTAGACGAAGCCATCGAGCAGGACAAGCGTTACAAGCTCTGTGCTCGGGTTGTGAAAGAAGTCCTGAACGAGCCAGGTCAAGTCATTCCTCTCAGATACCTCGAAAAACGGCGCGAGAGGCTACGTCTCACTTTCAAAGCTAAGAGCTTTGTTGAAATGAACCCTTCCCTGTTCGAGATCTACTACGATCGGATCAAACCCAAGTCCGATCCCGTCCAATTCCTCCGCCCCACGCCTCGTCTCAGAGCTTTCCTCGACGAAGAGCAGAGGATTTACTCTGAGAATGAGCCTTTACTTGTTTCCAAGCTCTGCCAATTGCTGATGATGGCTAAAGATAAGGTTATCAGTGCAGATAAACTGGTTCATGTGAAGAGAGATTTCGGATTTCCGAACGATTTTCTGATGAAATTGGTTCAGAAATACCCTAATTACTTCAGGCTAACCGGTTTACCTGAAGAAGGTAAGTCCTTTCTTGAGCTAGTCTCTTGGAACCCTGATTTCGCCAAATCGAAGATTGAGCTGAGAGCAGAAGACGAGACCCTTAAAACCGGTGTCCGGATTCGACCCAATTACAATGTGAAATTGCCGTCTGGTTTTTTCCTAAGGAAGGAGATGAGAGAGTGGACTAGGGATTGGTTAGAGCAAGACTACATATCACCATATGAGGATGTGTCTCATTTAGACCAAGCTTCTAAGGAAATGGAGAAACGAACTGTTGGTGTTGTGCACGAATTGCTTTCTCTGTCACTGTTGAAAAGAGTCCCTGTGCCTACACTTGGCAAGTTCTGCGATGAGTTCCGGTTTTCCAACGCGTTCTCGAGTGTTTTCACTCGTCATTCAGGTATATTCTACTTGTCGTTAAAAGGAGGGATCAAGACTGCAGTGTTGAGAGAAGCTTATAAAGACGATGAGCTTGTTGATAGAGATCCTTTGCTTGCTATTAAGGATAAGTTCCTGAGGTTATTAGAGGAAGGATGGCAAGAAAGGAAAGATAGACTGAAGCTGCAGAGGGAACAAGTTCAGAAAGACAGGGAGATGATGTTAGCAGCGAAAAGCAATGAACCGATAGAGCGTCTCTGTGATTAA

SEQ ID NO: 1633 - DNA, 1474 bp, Arabidopsis thaliana
  misc_feature (1)..(1474): Ceres cDNA ID no. 12664321
  misc_feature (1)..(1474): Also known as  Ceres CDNA ID no. 23659454
atgtcggtcacagcgggagtgagtgaatctgcaattgctgtaagggagaaactaaaaggtggtattggacagactaaagtaagaaggtattggccaggaaaagctccggagtgggctgaggaagctgaagaagatgatgatgttaggatgcagaagttttctgttttggatagagcttttccaaagaatgatgatttgggtgttgctaggaaggatgatccaaggctgcggcgtttagctcagactaaagttgaaaaccgtgacgaagttagagctgatcatcggcgtattagacaggctgagattatatctacggaagaagaagaatcgaggaatcaagagaatagagacgaggatgatgatgaagatgccttggaagaaagaagaagaagaattaaggagaagaatcttagacgagcacaagaggaggctgctttacttcctttagaagaagaagatgagatacaagaggaagaagaggaggaggaggagtctgagtacgagactgattcggaagatgatatgcctggtattgccttgattaagcctgtttttgtaccgaaagctgagagagatacaattgcagagcgagagaggcttgaggctgaagaagaagctcttgaggaattagcaaagagaaaattggagcaaagaaaaatagagacaaagcaaattgtggttgaggaagttaggaaagatgaagagatacggaagaacatactattggaggaagctaatattggagatgtggaaactgatgacgaactcaatgaagctgaggagtatgaagtttggaagacaagagagattggtaggatcaagagagaaagagatgcaagggaagctatgctgagagagagggaagaaatagagaagttgaggaatatgacagagcaggagaggagagattgggagaggaagaatccgaaaccttcttcagctcaaccgaaaaagaaatggaactttatgcagaaatattaccataagggtgccttcttccaggcagatcctgatgatgaggcaggttctgctggaaccgatggtatatttcagcgcgacttctctgctccaaccggagaagataggttggacaaatcgattctccccaaagttatgcaagtcaagcactttggtcgtagtggaagaactaaatggactcaccttgtcaatgaagacacaacagattggagtaacccgtggacttccaatgatcctctacgtgaaaaatacaacaagaaaatggcaggcatggatgctccaatcgcaaaaccaaaagggagcaagaagatgaaagattgggagacttaaaccgcaccaacatttactttgtttgtttttaaaatccaatgatgcagcagtggtatgtggtagtaaaaaaacatcgtaacatcttactcagttatgtctctgagtcctctaaatcctagtaattaaaaatattgctcaaaagaatgaagacctaacataattcatt

SEQ ID NO: 1634 - protein, 1474 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGTCGGTCACAGCGGGAGTGAGTGAATCTGCAATTGCTGTAAGGGAGAAACTAAAAGGTGGTATTGGACAGACTAAAGTAAGAAGGTATTGGCCAGGAAAAGCTCCGGAGTGGGCTGAGGAAGCTGAAGAAGATGATGATGTTAGGATGCAGAAGTTTTCTGTTTTGGATAGAGCTTTTCCAAAGAATGATGATTTGGGTGTTGCTAGGAAGGATGATCCAAGGCTGCGGCGTTTAGCTCAGACTAAAGTTGAAAACCGTGACGAAGTTAGAGCTGATCATCGGCGTATTAGACAGGCTGAGATTATATCTACGGAAGAAGAAGAATCGAGGAATCAAGAGAATAGAGACGAGGATGATGATGAAGATGCCTTGGAAGAAAGAAGAAGAAGAATTAAGGAGAAGAATCTTAGACGAGCACAAGAGGAGGCTGCTTTACTTCCTTTAGAAGAAGAAGATGAGATACAAGAGGAAGAAGAGGAGGAGGAGGAGTCTGAGTACGAGACTGATTCGGAAGATGATATGCCTGGTATTGCCTTGATTAAGCCTGTTTTTGTACCGAAAGCTGAGAGAGATACAATTGCAGAGCGAGAGAGGCTTGAGGCTGAAGAAGAAGCTCTTGAGGAATTAGCAAAGAGAAAATTGGAGCAAAGAAAAATAGAGACAAAGCAAATTGTGGTTGAGGAAGTTAGGAAAGATGAAGAGATACGGAAGAACATACTATTGGAGGAAGCTAATATTGGAGATGTGGAAACTGATGACGAACTCAATGAAGCTGAGGAGTATGAAGTTTGGAAGACAAGAGAGATTGGTAGGATCAAGAGAGAAAGAGATGCAAGGGAAGCTATGCTGAGAGAGAGGGAAGAAATAGAGAAGTTGAGGAATATGACAGAGCAGGAGAGGAGAGATTGGGAGAGGAAGAATCCGAAACCTTCTTCAGCTCAACCGAAAAAGAAATGGAACTTTATGCAGAAATATTACCATAAGGGTGCCTTCTTCCAGGCAGATCCTGATGATGAGGCAGGTTCTGCTGGAACCGATGGTATATTTCAGCGCGACTTCTCTGCTCCAACCGGAGAAGATAGGTTGGACAAATCGATTCTCCCCAAAGTTATGCAAGTCAAGCACTTTGGTCGTAGTGGAAGAACTAAATGGACTCACCTTGTCAATGAAGACACAACAGATTGGAGTAACCCGTGGACTTCCAATGATCCTCTACGTGAAAAATACAACAAGAAAATGGCAGGCATGGATGCTCCAATCGCAAAACCAAAAGGGAGCAAGAAGATGAAAGATTGGGAGACTTAAACCGCACCAACATTTACTTTGTTTGTTTTTAAAATCCAATGATGCAGCAGTGGTATGTGGTAGTAAAAAAACATCGTAACATCTTACTCAGTTATGTCTCTGAGTCCTCTAAATCCTAGTAATTAAAAATATTGCTCAAAAGAATGAAGACCTAACATAATTCATT

SEQ ID NO: 1635 - DNA, 2604 bp, Arabidopsis thaliana
  misc_feature (1)..(2604): Ceres cDNA ID no. 12664645
  misc_feature (1)..(2604): Also known as  Ceres CDNA ID no. 23659454
atgagagatgcagcggattcgtcatcatactctggatacgagaaagatttcatgaaacatacaatgcttgagcacgaagctgttttcaagaatcaggtgcatgagcttcaccgtttgtatagagtacagaagaatttggttgaggaagtaaaaggaaagaacttgaatgaagttatgaacgtgagtgatcatcatacatctgaaaatgaaagtaagaggaagttacatgggtttcttttaccaaactcaacatgtggagaagggagcagcacacaagcgtccaacggtcgtttgcaaaatggtggtagttcaaatggggacgcgtccgagggtagagatgtgaaggggaggagaagaatgattgatcttcaacttccagccgatgagtatcttgatactgatgaaactactaacaccggtgagaatacaagcttccctccatacaaccagttaaaatcaggaagaggggatgcttctcatcggagctatccttcaggatcttgcttggatgtgaagaactcaaatggcttagctgacttgaatgagccactcaaagggcaagattcagaacctgctgctctgtctagggatatgtattctcattatgggagaaacaatgctcatgttcaaggtcagtggttggagaaaaatcgaactcaaaatggatggatggtccttgaagcagggcaagataggagcactcagagagatcaggtgcatctgccttctcattcaggacaagtactttctaacaatgcatttcaacctcagagctatcctacaactgatcacagcaaggtcaaattttccggggaaagagcacatcgtgagctagaagttcgctcaaagactcctcaagtttcttatgatagctacgttgaatcaagtgtggcatctactgctccaagatcagtcaatgactaccgccctgaatttttcaaaccattgacccattggtcttcatccgggaggactatgaccagctcaaatcagaaatcttatccagttcaaacgaatccctacatgaattttgacacacatgcaagaccagatttgagttttgagaatagaagccatgtctctaatgggctttatcaaggattctcttcagggtcaaagcagtctttctataatttcccatcaaccggctttaaaccaaatgcttccataggcgaggtagcgaacagccacagttttgtaaatcttcaagggccaaaaaggcaggaatgctcagctgggttgccctggctaaaacctcagcccccttacagaagtggaatgtccaatggcttctttgatctgaatgcttcgacaaatcaattcatggatggaactgacgctggggacgacttgacttgtgcttctgttctgaagggtttgcgatctgcttcatactctaataatgcaaacatgggaagagttgaaacgaacaactctcagagtagtactaaaattattgggagcccaatctttgggaagcaatttgtttgcaagcaggagcgtacgccccttatccctcattccttatggattgctaatcaacacaaggaagtaaatcacttggtaaagcgagaccttgatatcaacctgccatgtgatgcctcggtttctgttgaccagcatggtgctaaagcctactatgtagacaagaaagaagggaaaaaagctgccaacttcagacactacattgatctgaattcatgtgctaatgaggatgacgaagattccggcttcctttccagtctgagtgtgaaaacaaaagcaagaacttggatagatttggaagctccccctactctcgagagtgaagaagaaggagataactcacaggacaaaacaaatgaagaaacttggagaatgatgcaaggccaagacggaaactctatgaatgaactcatcaaggtagcagcagaagcaatagttgccatctcaatggctggtcaccaacgccatcctgatgacgcagcttcctcttcaactgatgcggcttcaaaaagcccgctctcttggtttgcagaaataatcacttcttgcggtgatgagttagaaagaaagattgatggttctccagaagccacagactttgaaggtaacagggaagactattcttctggggagattgattactttgaagccatgaccctgaatatacaggagacaaaggaggaagactacatgccagagccattagtcccagagaatctgaaattcgaagatacatgtattaacaagccaagaagaggacaagcaagacgaggaagaccaaagcgggatttccaaagggatactctacctggtctctcttctctgtcgaggcatgaagtcactgaagatatccaaatgtttgggggactgatgaaaaccggagactacacttggagttctggattggctgttcgacggaactcaaaaagaaaacgaaatgtcactaacataaaccaagctccattatgcccgtcaatggcgcagccaatgaatgagagcgtatcagtgggaggacttgaagacagtaagctctcaggatggggacaagcaacaagaagaccgaggagacaaaggtgccctcctgcaggtagtaatcccccaaccgtgatcttaacataa

SEQ ID NO: 1636 - protein, 2604 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGAGAGATGCAGCGGATTCGTCATCATACTCTGGATACGAGAAAGATTTCATGAAACATACAATGCTTGAGCACGAAGCTGTTTTCAAGAATCAGGTGCATGAGCTTCACCGTTTGTATAGAGTACAGAAGAATTTGGTTGAGGAAGTAAAAGGAAAGAACTTGAATGAAGTTATGAACGTGAGTGATCATCATACATCTGAAAATGAAAGTAAGAGGAAGTTACATGGGTTTCTTTTACCAAACTCAACATGTGGAGAAGGGAGCAGCACACAAGCGTCCAACGGTCGTTTGCAAAATGGTGGTAGTTCAAATGGGGACGCGTCCGAGGGTAGAGATGTGAAGGGGAGGAGAAGAATGATTGATCTTCAACTTCCAGCCGATGAGTATCTTGATACTGATGAAACTACTAACACCGGTGAGAATACAAGCTTCCCTCCATACAACCAGTTAAAATCAGGAAGAGGGGATGCTTCTCATCGGAGCTATCCTTCAGGATCTTGCTTGGATGTGAAGAACTCAAATGGCTTAGCTGACTTGAATGAGCCACTCAAAGGGCAAGATTCAGAACCTGCTGCTCTGTCTAGGGATATGTATTCTCATTATGGGAGAAACAATGCTCATGTTCAAGGTCAGTGGTTGGAGAAAAATCGAACTCAAAATGGATGGATGGTCCTTGAAGCAGGGCAAGATAGGAGCACTCAGAGAGATCAGGTGCATCTGCCTTCTCATTCAGGACAAGTACTTTCTAACAATGCATTTCAACCTCAGAGCTATCCTACAACTGATCACAGCAAGGTCAAATTTTCCGGGGAAAGAGCACATCGTGAGCTAGAAGTTCGCTCAAAGACTCCTCAAGTTTCTTATGATAGCTACGTTGAATCAAGTGTGGCATCTACTGCTCCAAGATCAGTCAATGACTACCGCCCTGAATTTTTCAAACCATTGACCCATTGGTCTTCATCCGGGAGGACTATGACCAGCTCAAATCAGAAATCTTATCCAGTTCAAACGAATCCCTACATGAATTTTGACACACATGCAAGACCAGATTTGAGTTTTGAGAATAGAAGCCATGTCTCTAATGGGCTTTATCAAGGATTCTCTTCAGGGTCAAAGCAGTCTTTCTATAATTTCCCATCAACCGGCTTTAAACCAAATGCTTCCATAGGCGAGGTAGCGAACAGCCACAGTTTTGTAAATCTTCAAGGGCCAAAAAGGCAGGAATGCTCAGCTGGGTTGCCCTGGCTAAAACCTCAGCCCCCTTACAGAAGTGGAATGTCCAATGGCTTCTTTGATCTGAATGCTTCGACAAATCAATTCATGGATGGAACTGACGCTGGGGACGACTTGACTTGTGCTTCTGTTCTGAAGGGTTTGCGATCTGCTTCATACTCTAATAATGCAAACATGGGAAGAGTTGAAACGAACAACTCTCAGAGTAGTACTAAAATTATTGGGAGCCCAATCTTTGGGAAGCAATTTGTTTGCAAGCAGGAGCGTACGCCCCTTATCCCTCATTCCTTATGGATTGCTAATCAACACAAGGAAGTAAATCACTTGGTAAAGCGAGACCTTGATATCAACCTGCCATGTGATGCCTCGGTTTCTGTTGACCAGCATGGTGCTAAAGCCTACTATGTAGACAAGAAAGAAGGGAAAAAAGCTGCCAACTTCAGACACTACATTGATCTGAATTCATGTGCTAATGAGGATGACGAAGATTCCGGCTTCCTTTCCAGTCTGAGTGTGAAAACAAAAGCAAGAACTTGGATAGATTTGGAAGCTCCCCCTACTCTCGAGAGTGAAGAAGAAGGAGATAACTCACAGGACAAAACAAATGAAGAAACTTGGAGAATGATGCAAGGCCAAGACGGAAACTCTATGAATGAACTCATCAAGGTAGCAGCAGAAGCAATAGTTGCCATCTCAATGGCTGGTCACCAACGCCATCCTGATGACGCAGCTTCCTCTTCAACTGATGCGGCTTCAAAAAGCCCGCTCTCTTGGTTTGCAGAAATAATCACTTCTTGCGGTGATGAGTTAGAAAGAAAGATTGATGGTTCTCCAGAAGCCACAGACTTTGAAGGTAACAGGGAAGACTATTCTTCTGGGGAGATTGATTACTTTGAAGCCATGACCCTGAATATACAGGAGACAAAGGAGGAAGACTACATGCCAGAGCCATTAGTCCCAGAGAATCTGAAATTCGAAGATACATGTATTAACAAGCCAAGAAGAGGACAAGCAAGACGAGGAAGACCAAAGCGGGATTTCCAAAGGGATACTCTACCTGGTCTCTCTTCTCTGTCGAGGCATGAAGTCACTGAAGATATCCAAATGTTTGGGGGACTGATGAAAACCGGAGACTACACTTGGAGTTCTGGATTGGCTGTTCGACGGAACTCAAAAAGAAAACGAAATGTCACTAACATAAACCAAGCTCCATTATGCCCGTCAATGGCGCAGCCAATGAATGAGAGCGTATCAGTGGGAGGACTTGAAGACAGTAAGCTCTCAGGATGGGGACAAGCAACAAGAAGACCGAGGAGACAAAGGTGCCCTCCTGCAGGTAGTAATCCCCCAACCGTGATCTTAACATAA

SEQ ID NO: 1637 - DNA, 893 bp, Arabidopsis thaliana
  misc_feature (1)..(893): Ceres cDNA ID no. 12664781
  misc_feature (1)..(893): Also known as  Ceres CDNA ID no. 23659454
aatctttcctacaaaacaaaaccaagaatcatacaaaacaagcatcctccaatatgatgaaacaatcaccattctcacttttaacatcaatctttctcatagctgctctttttactgcaactaccgcactcgatcctgcacccgaagacccgatttttgaattgtacatgcacgatatacttgggggaagcagtcccacagcaagacccattacgggtttgcttggaaacatctacaacggtcaagtaccgtttgctaagcagatcggttttgttccaccgcaaaacggtgtagccatacccaacgcaaatggggcaatgccaacggttaacggtatcaacggtattccattaggtactggtttgtctggaacagcgttttctggtcagaatctaaatgggattcagactcagttgggtcctgatggtctgagtcttgggtttggaacaatcacggtgattgacgacataatcacatctggtcctgacttggggtcacaaccacttggtaaggctcaaggtgtttatgttgccagctcagcagatggaagcacgcagatgatggctttcacagctatgcttgaaggtggagagtacaatgataatctaaatttctatggaatctataggataggaagcgccatgtcacatctgtcagtgactggaggaaccggaaggtttaagaacgcttgcggatttgcagaggttaggccgttgattcctgcgggccaacactttgttgatggagctgagatgctgttgaggatcattgtccatctgaaatactgagaattatgtttaaaacttgtgaatgaaatgtgtgtgaaatgtgtgatgccatttgtaattaagaatgtttccttcttgtgaattattccaacaactattctgaga

SEQ ID NO: 1638 - protein, 893 aa, Arabidopsis thaliana
  misc_feature: GI Number: 34905882; NR Description: P0458E05.17 [Oryza sativa (japonica cultivar-group)] >gi|21902069|dbj|BAC05617.1|
AATCTTTCCTACAAAACAAAACCAAGAATCATACAAAACAAGCATCCTCCAATATGATGAAACAATCACCATTCTCACTTTTAACATCAATCTTTCTCATAGCTGCTCTTTTTACTGCAACTACCGCACTCGATCCTGCACCCGAAGACCCGATTTTTGAATTGTACATGCACGATATACTTGGGGGAAGCAGTCCCACAGCAAGACCCATTACGGGTTTGCTTGGAAACATCTACAACGGTCAAGTACCGTTTGCTAAGCAGATCGGTTTTGTTCCACCGCAAAACGGTGTAGCCATACCCAACGCAAATGGGGCAATGCCAACGGTTAACGGTATCAACGGTATTCCATTAGGTACTGGTTTGTCTGGAACAGCGTTTTCTGGTCAGAATCTAAATGGGATTCAGACTCAGTTGGGTCCTGATGGTCTGAGTCTTGGGTTTGGAACAATCACGGTGATTGACGACATAATCACATCTGGTCCTGACTTGGGGTCACAACCACTTGGTAAGGCTCAAGGTGTTTATGTTGCCAGCTCAGCAGATGGAAGCACGCAGATGATGGCTTTCACAGCTATGCTTGAAGGTGGAGAGTACAATGATAATCTAAATTTCTATGGAATCTATAGGATAGGAAGCGCCATGTCACATCTGTCAGTGACTGGAGGAACCGGAAGGTTTAAGAACGCTTGCGGATTTGCAGAGGTTAGGCCGTTGATTCCTGCGGGCCAACACTTTGTTGATGGAGCTGAGATGCTGTTGAGGATCATTGTCCATCTGAAATACTGAGAATTATGTTTAAAACTTGTGAATGAAATGTGTGTGAAATGTGTGATGCCATTTGTAATTAAGAATGTTTCCTTCTTGTGAATTATTCCAACAACTATTCTGAGA

SEQ ID NO: 1639 - DNA, 1299 bp, Arabidopsis thaliana
  misc_feature (1)..(1299): Ceres cDNA ID no. 12664797
  misc_feature (1)..(1299): Also known as  Ceres CDNA ID no. 23659454
atggcttcttcttctctacctctttctcttccgtttccactccgatctcttactagtaccactcgatctctaccatttcaatgttctcctctctttttctctattccttcttcaatcgtttgcttctccactcaaaatcccgaccgcgaagaggtccggtggctccgggaagagcagagatggattcgcgaggagcaacgatggattcgtgaagaacagagatggatacgcgaacgtgaatcgcttctacaagagatttcggatctacagctcagaattcaatccctagagtcacgaaattcgcaattggggaattctattcccgatacgatttcgaatatcgctgctttgcttcaggttttgaaggagaagaatcggatttctgagagtggattgagcgcaacgccgatggtattggagagtacgagagaacaaattgttgaggaggtggaagaagaagagaagcgagtgattattgctgaagagaaagttagggtttcggagccggtgaagaagatcaagaggaggatattgaaagttggaagcgaaggcgacgatgttcaagctttgcaggaagctctgttgaaattaggattctattcgggcgaagaggatatggagttctcgagcttttcaagtgggactgcaagtgctgttaagacttggcaagcatcgcttggggtccgtgaggatggggtaatgacagcagagcttcttcagaggttgttcatggatgaagacgtagagacagataaggatgaagcaagtacaatgaagaaagaggtaaaaactgaaaccactaactacagctcagagaacttggaacatgaatattctgaaatttctcttaatttgcttaatacacctgttaagactggttctttatactggatctttcttttaattccattgattaaggaagctggtaatggggcggtatttacttcagtgacacaagtccctgagaagaagcaatcaatcgtgaaagatcaaagtgacagagaagttgacgttactcaaaatcgggtttttcttcttggagaaaacagatgggaagatccctccaggctcattggcaggaacaaaccggtagacagaagtgaatcaacaaacaccaaaacgaggtgcatcacttgtcgaggggagggtcgattgatgtgcctagagtgcgatggaaccggtgagccaaacattgagccgcagttcatggagtgggttggtgaagatacgaagtgtccgtactgtgaaggtcttggctatacagtttgcgatgtctgcgacggcaaaaaaaacttataa

SEQ ID NO: 1640 - protein, 1299 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGGCTTCTTCTTCTCTACCTCTTTCTCTTCCGTTTCCACTCCGATCTCTTACTAGTACCACTCGATCTCTACCATTTCAATGTTCTCCTCTCTTTTTCTCTATTCCTTCTTCAATCGTTTGCTTCTCCACTCAAAATCCCGACCGCGAAGAGGTCCGGTGGCTCCGGGAAGAGCAGAGATGGATTCGCGAGGAGCAACGATGGATTCGTGAAGAACAGAGATGGATACGCGAACGTGAATCGCTTCTACAAGAGATTTCGGATCTACAGCTCAGAATTCAATCCCTAGAGTCACGAAATTCGCAATTGGGGAATTCTATTCCCGATACGATTTCGAATATCGCTGCTTTGCTTCAGGTTTTGAAGGAGAAGAATCGGATTTCTGAGAGTGGATTGAGCGCAACGCCGATGGTATTGGAGAGTACGAGAGAACAAATTGTTGAGGAGGTGGAAGAAGAAGAGAAGCGAGTGATTATTGCTGAAGAGAAAGTTAGGGTTTCGGAGCCGGTGAAGAAGATCAAGAGGAGGATATTGAAAGTTGGAAGCGAAGGCGACGATGTTCAAGCTTTGCAGGAAGCTCTGTTGAAATTAGGATTCTATTCGGGCGAAGAGGATATGGAGTTCTCGAGCTTTTCAAGTGGGACTGCAAGTGCTGTTAAGACTTGGCAAGCATCGCTTGGGGTCCGTGAGGATGGGGTAATGACAGCAGAGCTTCTTCAGAGGTTGTTCATGGATGAAGACGTAGAGACAGATAAGGATGAAGCAAGTACAATGAAGAAAGAGGTAAAAACTGAAACCACTAACTACAGCTCAGAGAACTTGGAACATGAATATTCTGAAATTTCTCTTAATTTGCTTAATACACCTGTTAAGACTGGTTCTTTATACTGGATCTTTCTTTTAATTCCATTGATTAAGGAAGCTGGTAATGGGGCGGTATTTACTTCAGTGACACAAGTCCCTGAGAAGAAGCAATCAATCGTGAAAGATCAAAGTGACAGAGAAGTTGACGTTACTCAAAATCGGGTTTTTCTTCTTGGAGAAAACAGATGGGAAGATCCCTCCAGGCTCATTGGCAGGAACAAACCGGTAGACAGAAGTGAATCAACAAACACCAAAACGAGGTGCATCACTTGTCGAGGGGAGGGTCGATTGATGTGCCTAGAGTGCGATGGAACCGGTGAGCCAAACATTGAGCCGCAGTTCATGGAGTGGGTTGGTGAAGATACGAAGTGTCCGTACTGTGAAGGTCTTGGCTATACAGTTTGCGATGTCTGCGACGGCAAAAAAAACTTATAA

SEQ ID NO: 1641 - DNA, 2757 bp, Arabidopsis thaliana
  misc_feature (1)..(2757): Ceres cDNA ID no. 12664836
  misc_feature (1)..(2757): Also known as  Ceres CDNA ID no. 23659454
aattcgtttcacagaaaataaataaaaaccaatcacagaaaaaacattctacagcaagatgataacaataatatggagcttgtgtttaatcttctgcctttcaaactcaatacttgttattgctaaagacttgtgtcttccagaccagagggatgctcttttggagttcaagaacgagttctctatcccaagccccgattctgatttgatgctgattcttcagacgacagcgaagtggaggaacaacactgattgctgttcttggggtggtatctcttgtgatcctaagacgggagtggtggttgagttagacctcggaaacagtgatctcaatggccgtctgagatctaatagcagcctgtttagactacaacatcttcagagcctagatctttcctacaatgatctttcgtgtaccctaccagattccagcggcaacttcaaatatttgagagttttgaacctccttggttgcaatctctttggagagattcctacatcacttagaagtctttcttacctcactgatcttgatctttcttataatgatgatctcaccggtgagatactggattcgatgggcaatctcaaacatttgagggttttgagtcttactagttgcaaattcaccggaaagattccttcttcactcggaaatcttacttatctcactgatcttgatctttcttggaattatttcaccggtgagttaccagattcgatgggcaatctcaaatctttgagggttttgaatcttcatcgttgcaatttctttggaaagattcctacttcactcggaagtctttctaatctcactgatcttgatatttctaaaaatgagttcaccagtgaaggaccagattcgatgagcagcctaaaccgactaacagattttcaacttatgctactcaacttgagctcactcaccaatgtcgaccttagttctaaccagttcaaagctatgctcccatctaacatgagtagcctttccaaactggaggcttttgatattagtggaaattcattttctggaaccatcccctcttctctcttcatgctcccttcgttgattaaacttgacctgggaacaaacgacttcagcggtccacttaagattgggaatatctcttcaccatctaaccttcaagaattatacattggagaaaacaatatcaatgggccaattccaagatctatattgaaactagtcgggctttcggctcttagcctctctttctgggacacaggaggcattgttgatttcagcatcttcttgcagctcaagtctcttaggtcacttgatctttcagggattaatttgaatatcagttcatcgcaccatcttccctcacatatgatgcacttgattttatcatcctgcaatatttctcagtttcctaagtttctggaaaaccaaaccagtttgtatcatttagacatctctgccaatcaaattgaaggccaagtaccagaatggttatggagactaccaacgttgaggtatgtaaacattgctcagaatgccttcagtggagaactaactatgttaccaaatcctatctatagctttatagcctctgataataagttttcaggagagattcctagagcagtatgcgaaattgggacacttgttttgtccaacaacaacttcagcggttctattcccccgtgttttgagatttccaataaaactctttcgatcttgcatcttcgaaataacagtctctctggtgttattccagaggaatctctgcatggttacttgagatcactagatgttggtagcaaccggttatcaggacaatttcccaagtcactgatcaactgcagttatctccagtttctgaacgtggaagagaaccgaatcaatgacacatttccatcctggttgaaatcattgcccaatctacagctgcttgtccttcgttctaacgagttccatgggccaatattttctcctggagattctttaagtttctccaaactacgattttttgacatttcagaaaatcgcttcagtggagtcttgccatcagattactttgttggttggagtgtaatgtcatcgtttgtagacattattgataatacgcctggatttacggttgtaggagatgaccaagaatcctttcataaatctgtggttctgacgatcaaaggattgaatatggaactggtagggagtggtttcgaaatctacaagaccatcgatgtctccggaaacagacttgaaggagatattccagaatccatcggtatactcaaggaactgattgtgctcaacatgtcaaacaacgcattcacaggccatattccaccatctctatcaaacttgagcaatctccaatcattggatctatctcaaaacagattatccggcagtatcccaggagagctcggggaactcacatttctagcgcggatgaacttctcttacaacatgcttgaaggtccaataccacaaggcactcagattcaaagccagaacagttcttctttcgcagagaatcccgggctttgcggtgctcctctccaaaaaaaatgcggtggagaagaagaagaagataaagaaaaggaagagaaagataaaggattaagctgggtagcagctgcaataggctatgtacctggtttgttttgtggacttgccatcggccacattctcacttcatataaacgtgactggttcatgagaatcttttcctgcttttcttctccgctgaaaaaatgatcaataataagtgtcttctcttt

SEQ ID NO: 1642 - protein, 2757 aa, Arabidopsis thaliana
  misc_feature: GI Number: 34905882; NR Description: P0458E05.17 [Oryza sativa (japonica cultivar-group)] >gi|21902069|dbj|BAC05617.1|
AATTCGTTTCACAGAAAATAAATAAAAACCAATCACAGAAAAAACATTCTACAGCAAGATGATAACAATAATATGGAGCTTGTGTTTAATCTTCTGCCTTTCAAACTCAATACTTGTTATTGCTAAAGACTTGTGTCTTCCAGACCAGAGGGATGCTCTTTTGGAGTTCAAGAACGAGTTCTCTATCCCAAGCCCCGATTCTGATTTGATGCTGATTCTTCAGACGACAGCGAAGTGGAGGAACAACACTGATTGCTGTTCTTGGGGTGGTATCTCTTGTGATCCTAAGACGGGAGTGGTGGTTGAGTTAGACCTCGGAAACAGTGATCTCAATGGCCGTCTGAGATCTAATAGCAGCCTGTTTAGACTACAACATCTTCAGAGCCTAGATCTTTCCTACAATGATCTTTCGTGTACCCTACCAGATTCCAGCGGCAACTTCAAATATTTGAGAGTTTTGAACCTCCTTGGTTGCAATCTCTTTGGAGAGATTCCTACATCACTTAGAAGTCTTTCTTACCTCACTGATCTTGATCTTTCTTATAATGATGATCTCACCGGTGAGATACTGGATTCGATGGGCAATCTCAAACATTTGAGGGTTTTGAGTCTTACTAGTTGCAAATTCACCGGAAAGATTCCTTCTTCACTCGGAAATCTTACTTATCTCACTGATCTTGATCTTTCTTGGAATTATTTCACCGGTGAGTTACCAGATTCGATGGGCAATCTCAAATCTTTGAGGGTTTTGAATCTTCATCGTTGCAATTTCTTTGGAAAGATTCCTACTTCACTCGGAAGTCTTTCTAATCTCACTGATCTTGATATTTCTAAAAATGAGTTCACCAGTGAAGGACCAGATTCGATGAGCAGCCTAAACCGACTAACAGATTTTCAACTTATGCTACTCAACTTGAGCTCACTCACCAATGTCGACCTTAGTTCTAACCAGTTCAAAGCTATGCTCCCATCTAACATGAGTAGCCTTTCCAAACTGGAGGCTTTTGATATTAGTGGAAATTCATTTTCTGGAACCATCCCCTCTTCTCTCTTCATGCTCCCTTCGTTGATTAAACTTGACCTGGGAACAAACGACTTCAGCGGTCCACTTAAGATTGGGAATATCTCTTCACCATCTAACCTTCAAGAATTATACATTGGAGAAAACAATATCAATGGGCCAATTCCAAGATCTATATTGAAACTAGTCGGGCTTTCGGCTCTTAGCCTCTCTTTCTGGGACACAGGAGGCATTGTTGATTTCAGCATCTTCTTGCAGCTCAAGTCTCTTAGGTCACTTGATCTTTCAGGGATTAATTTGAATATCAGTTCATCGCACCATCTTCCCTCACATATGATGCACTTGATTTTATCATCCTGCAATATTTCTCAGTTTCCTAAGTTTCTGGAAAACCAAACCAGTTTGTATCATTTAGACATCTCTGCCAATCAAATTGAAGGCCAAGTACCAGAATGGTTATGGAGACTACCAACGTTGAGGTATGTAAACATTGCTCAGAATGCCTTCAGTGGAGAACTAACTATGTTACCAAATCCTATCTATAGCTTTATAGCCTCTGATAATAAGTTTTCAGGAGAGATTCCTAGAGCAGTATGCGAAATTGGGACACTTGTTTTGTCCAACAACAACTTCAGCGGTTCTATTCCCCCGTGTTTTGAGATTTCCAATAAAACTCTTTCGATCTTGCATCTTCGAAATAACAGTCTCTCTGGTGTTATTCCAGAGGAATCTCTGCATGGTTACTTGAGATCACTAGATGTTGGTAGCAACCGGTTATCAGGACAATTTCCCAAGTCACTGATCAACTGCAGTTATCTCCAGTTTCTGAACGTGGAAGAGAACCGAATCAATGACACATTTCCATCCTGGTTGAAATCATTGCCCAATCTACAGCTGCTTGTCCTTCGTTCTAACGAGTTCCATGGGCCAATATTTTCTCCTGGAGATTCTTTAAGTTTCTCCAAACTACGATTTTTTGACATTTCAGAAAATCGCTTCAGTGGAGTCTTGCCATCAGATTACTTTGTTGGTTGGAGTGTAATGTCATCGTTTGTAGACATTATTGATAATACGCCTGGATTTACGGTTGTAGGAGATGACCAAGAATCCTTTCATAAATCTGTGGTTCTGACGATCAAAGGATTGAATATGGAACTGGTAGGGAGTGGTTTCGAAATCTACAAGACCATCGATGTCTCCGGAAACAGACTTGAAGGAGATATTCCAGAATCCATCGGTATACTCAAGGAACTGATTGTGCTCAACATGTCAAACAACGCATTCACAGGCCATATTCCACCATCTCTATCAAACTTGAGCAATCTCCAATCATTGGATCTATCTCAAAACAGATTATCCGGCAGTATCCCAGGAGAGCTCGGGGAACTCACATTTCTAGCGCGGATGAACTTCTCTTACAACATGCTTGAAGGTCCAATACCACAAGGCACTCAGATTCAAAGCCAGAACAGTTCTTCTTTCGCAGAGAATCCCGGGCTTTGCGGTGCTCCTCTCCAAAAAAAATGCGGTGGAGAAGAAGAAGAAGATAAAGAAAAGGAAGAGAAAGATAAAGGATTAAGCTGGGTAGCAGCTGCAATAGGCTATGTACCTGGTTTGTTTTGTGGACTTGCCATCGGCCACATTCTCACTTCATATAAACGTGACTGGTTCATGAGAATCTTTTCCTGCTTTTCTTCTCCGCTGAAAAAATGATCAATAATAAGTGTCTTCTCTTT

SEQ ID NO: 1643 - DNA, 945 bp, Arabidopsis thaliana
  misc_feature (1)..(945): Ceres cDNA ID no. 12664957
  misc_feature (1)..(945): Also known as  Ceres CDNA ID no. 23659454
atggggaaaactagcaaatggtttcgaagtctcttaaccggaaagaaagagagaacaaaggaacatatcattcaaagcgagtgtgtattcacttcttccattccaggcactcctaaggagaaacgtcgatggagttttcgacgttcttcagcaactggaccaccgccaccagcttgtgctattacactgaaagattcaccaccaccgccgccaccaccacctccacctccaccgctacaacaaccatttgtggtcgaaatcgtggacaatgaagatgaacaaatcaagaacgtttcagctgaagagattgaagaatttgcagcaataaagattcaagcgtgctatcgttctcatttggagaatgaagaaaacatcaagattgtggaaatggacattcaatcgaaaatgtactctccggctccttcggctttaaccgagatgagtcctcgcgcgtatagtagccatttcgaggattgtaactcattcaacacagctcaaagtagtccacaatgtttcagcagattcaaagagtattacaatggagatactttgtcttcttatgattaccctctcttccctaattacatggctaatactcagtcttctaaagccaaggctcggtctcaaagtgcgccgaagcagagacctcctgagatctatgagaagcagatgagtgggaggagaagatcttcgatggaagcaccgaggaataacggtgtcccgagagctgtaaggatgcagagatcttcatctcaactagggtcaaacacagccaaggaaagtcaacaacatcatcatcatcagtactatccgtggatggcgataaagctcgatagatctaatatttcgcttatggagagcgaatgcggatctacaagtaccgttatgactaataccaactacggtagacatgttgatgttcagggaaacaacaacatgtactga

SEQ ID NO: 1644 - protein, 945 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGGGGAAAACTAGCAAATGGTTTCGAAGTCTCTTAACCGGAAAGAAAGAGAGAACAAAGGAACATATCATTCAAAGCGAGTGTGTATTCACTTCTTCCATTCCAGGCACTCCTAAGGAGAAACGTCGATGGAGTTTTCGACGTTCTTCAGCAACTGGACCACCGCCACCAGCTTGTGCTATTACACTGAAAGATTCACCACCACCGCCGCCACCACCACCTCCACCTCCACCGCTACAACAACCATTTGTGGTCGAAATCGTGGACAATGAAGATGAACAAATCAAGAACGTTTCAGCTGAAGAGATTGAAGAATTTGCAGCAATAAAGATTCAAGCGTGCTATCGTTCTCATTTGGAGAATGAAGAAAACATCAAGATTGTGGAAATGGACATTCAATCGAAAATGTACTCTCCGGCTCCTTCGGCTTTAACCGAGATGAGTCCTCGCGCGTATAGTAGCCATTTCGAGGATTGTAACTCATTCAACACAGCTCAAAGTAGTCCACAATGTTTCAGCAGATTCAAAGAGTATTACAATGGAGATACTTTGTCTTCTTATGATTACCCTCTCTTCCCTAATTACATGGCTAATACTCAGTCTTCTAAAGCCAAGGCTCGGTCTCAAAGTGCGCCGAAGCAGAGACCTCCTGAGATCTATGAGAAGCAGATGAGTGGGAGGAGAAGATCTTCGATGGAAGCACCGAGGAATAACGGTGTCCCGAGAGCTGTAAGGATGCAGAGATCTTCATCTCAACTAGGGTCAAACACAGCCAAGGAAAGTCAACAACATCATCATCATCAGTACTATCCGTGGATGGCGATAAAGCTCGATAGATCTAATATTTCGCTTATGGAGAGCGAATGCGGATCTACAAGTACCGTTATGACTAATACCAACTACGGTAGACATGTTGATGTTCAGGGAAACAACAACATGTACTGA

SEQ ID NO: 1645 - DNA, 873 bp, Arabidopsis thaliana
  misc_feature (1)..(873): Ceres cDNA ID no. 12665169
  misc_feature (1)..(873): Also known as  Ceres CDNA ID no. 23659454
atgcttctacgaagcgcttcaacgccacttctaaactcattggttcatgtctcgagtccaagagattctccaatcgaaaccgttgaatctgttcatcagattcaacgacacagatccataacactctctgcgtcttcttcctcttgctgttatagcccgatgtctgtacactctagcgacgattcttcaaggaggatgaaaagaacggcgtcagatagcgatctacgacatttgacatcgacgaaaccgccggtgagtaagtttttgagcggtggtgctttgatggaggatgtggatgaaggaatcggattcggtcttatacgcacttcgtcttatgatggtataagttgggctttggatgaagatactgaggttgctggcggtggtggtggtgggatgtttcacggtggaggaaaaggaaggagtggtggtagatctgatggtggtgatggaggtgacgataacactgatgttcattatcgtaagatgattgaagctaatcctggaaatgggatttttctcagtaattatgctaaattcctgaaggaggttagaaaagattacttgaaagcagaggaatattgtgggagagctattctggtgagtcctaatgatgggaatgttctggctatgtacgctgagttggtttggaagatccataaggattcatctcgtgctgagaattacttcaatcaagctgttgcagctgctcctgaggactgttatgtacaagcttcgtatgcacggtttctatgggatgctgaagaggaagaagaagaggaaaaggaagagagacatgaagaagaacttgagcatcaaacttctcgaatgaatttcttcaccggaccttctccaatcacggccatgtcttaa

SEQ ID NO: 1646 - protein, 873 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGCTTCTACGAAGCGCTTCAACGCCACTTCTAAACTCATTGGTTCATGTCTCGAGTCCAAGAGATTCTCCAATCGAAACCGTTGAATCTGTTCATCAGATTCAACGACACAGATCCATAACACTCTCTGCGTCTTCTTCCTCTTGCTGTTATAGCCCGATGTCTGTACACTCTAGCGACGATTCTTCAAGGAGGATGAAAAGAACGGCGTCAGATAGCGATCTACGACATTTGACATCGACGAAACCGCCGGTGAGTAAGTTTTTGAGCGGTGGTGCTTTGATGGAGGATGTGGATGAAGGAATCGGATTCGGTCTTATACGCACTTCGTCTTATGATGGTATAAGTTGGGCTTTGGATGAAGATACTGAGGTTGCTGGCGGTGGTGGTGGTGGGATGTTTCACGGTGGAGGAAAAGGAAGGAGTGGTGGTAGATCTGATGGTGGTGATGGAGGTGACGATAACACTGATGTTCATTATCGTAAGATGATTGAAGCTAATCCTGGAAATGGGATTTTTCTCAGTAATTATGCTAAATTCCTGAAGGAGGTTAGAAAAGATTACTTGAAAGCAGAGGAATATTGTGGGAGAGCTATTCTGGTGAGTCCTAATGATGGGAATGTTCTGGCTATGTACGCTGAGTTGGTTTGGAAGATCCATAAGGATTCATCTCGTGCTGAGAATTACTTCAATCAAGCTGTTGCAGCTGCTCCTGAGGACTGTTATGTACAAGCTTCGTATGCACGGTTTCTATGGGATGCTGAAGAGGAAGAAGAAGAGGAAAAGGAAGAGAGACATGAAGAAGAACTTGAGCATCAAACTTCTCGAATGAATTTCTTCACCGGACCTTCTCCAATCACGGCCATGTCTTAA

SEQ ID NO: 1647 - DNA, 1501 bp, Arabidopsis thaliana
  misc_feature (1)..(1501): Ceres cDNA ID no. 12665686
  misc_feature (1)..(1501): Also known as  Ceres CDNA ID no. 23659454
atgaagaagttcacgatagctaggtattatacaagtttaattaatttcgtgtgtgctacttaaagtgctacgaagaaactttgacttttctaatatatatttctctatcttgaatccgattcaagcttgtgaaagtctctctgcaaatcttgttgctctgttgctacaacaatggcgcagaaacaacagacccttcaccaacaacgaccattctcttcttctcctcgttcttattcttcaatctcaaaccgtcccatctttctccttagccgcaacggtctcctccttgtccttctcgctctcttccttctcctcggtgtattcttaccttggcccggatctcctttgttgctatttccgaacaaagtctcttctccttcttatgcttcttctttgtctccgcatgccaaatctgaatggcgtaactatacccttgctcaggcagctaagtttgtcgccacgaacggcactgtgatcgtctgcgccgtgagctcaccattcttgccttttctcaacaactggttgattagtgtttctagacagaagcatcaagaaaaagtccttgtgatcgctgaggattacattactctgtataaagtcaacgaaaagtggcctggccacgccgttcttattcctccagcgctcgattctaaaaccgcatacagtttcggttcccagggtttcttcaacttcacagctcgaaggccacaacatctcttgcaaattttggagctaggttacaatgttatgtacaacgatgttgatatggtttggttgcaagatccatttcagtatttggagggaagccatgacgcgtactttacggatgatatgcctcaaataaagcctttgaatcactctcatgatttaccagcgccggatcaaaacggagagacttatatatgtagctgcatgatttacttgcgacccacgaatggtgcaaagcttctaatgaagaaatggagtgaggaacttcagtcccaagcttggtctgagtccatccgttttaaagcaaatgatcagcctgcttttaacttggcacttaacaaaacagcccatcaagtggatctctacttgctttctcaggtagcttttccaacaggaggattgtatttcaatgatgcggcatgggttaaagagacaaaggggaaacatgtcatagtccacaataactacattatcggttacgataggaaaatgagacggttccaagattatggtctatggctagtcgatgatcatgctctcgagtctccattagggaaattgcagtaaattcgaatggctaaagaaagatagatccattgagtaaattccttagaactttttgggatctttaaaggtatgcgtgagtgttatattacatatgactaattcattatgacttgagttttgttaatccagttgtaatgtttagtagaaacagaggaaaacagggtccagttgtacattttggtcttgagtaaacaaatgagattcaagatgtatgtcttgacgttat

SEQ ID NO: 1648 - protein, 1501 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGAAGAAGTTCACGATAGCTAGGTATTATACAAGTTTAATTAATTTCGTGTGTGCTACTTAAAGTGCTACGAAGAAACTTTGACTTTTCTAATATATATTTCTCTATCTTGAATCCGATTCAAGCTTGTGAAAGTCTCTCTGCAAATCTTGTTGCTCTGTTGCTACAACAATGGCGCAGAAACAACAGACCCTTCACCAACAACGACCATTCTCTTCTTCTCCTCGTTCTTATTCTTCAATCTCAAACCGTCCCATCTTTCTCCTTAGCCGCAACGGTCTCCTCCTTGTCCTTCTCGCTCTCTTCCTTCTCCTCGGTGTATTCTTACCTTGGCCCGGATCTCCTTTGTTGCTATTTCCGAACAAAGTCTCTTCTCCTTCTTATGCTTCTTCTTTGTCTCCGCATGCCAAATCTGAATGGCGTAACTATACCCTTGCTCAGGCAGCTAAGTTTGTCGCCACGAACGGCACTGTGATCGTCTGCGCCGTGAGCTCACCATTCTTGCCTTTTCTCAACAACTGGTTGATTAGTGTTTCTAGACAGAAGCATCAAGAAAAAGTCCTTGTGATCGCTGAGGATTACATTACTCTGTATAAAGTCAACGAAAAGTGGCCTGGCCACGCCGTTCTTATTCCTCCAGCGCTCGATTCTAAAACCGCATACAGTTTCGGTTCCCAGGGTTTCTTCAACTTCACAGCTCGAAGGCCACAACATCTCTTGCAAATTTTGGAGCTAGGTTACAATGTTATGTACAACGATGTTGATATGGTTTGGTTGCAAGATCCATTTCAGTATTTGGAGGGAAGCCATGACGCGTACTTTACGGATGATATGCCTCAAATAAAGCCTTTGAATCACTCTCATGATTTACCAGCGCCGGATCAAAACGGAGAGACTTATATATGTAGCTGCATGATTTACTTGCGACCCACGAATGGTGCAAAGCTTCTAATGAAGAAATGGAGTGAGGAACTTCAGTCCCAAGCTTGGTCTGAGTCCATCCGTTTTAAAGCAAATGATCAGCCTGCTTTTAACTTGGCACTTAACAAAACAGCCCATCAAGTGGATCTCTACTTGCTTTCTCAGGTAGCTTTTCCAACAGGAGGATTGTATTTCAATGATGCGGCATGGGTTAAAGAGACAAAGGGGAAACATGTCATAGTCCACAATAACTACATTATCGGTTACGATAGGAAAATGAGACGGTTCCAAGATTATGGTCTATGGCTAGTCGATGATCATGCTCTCGAGTCTCCATTAGGGAAATTGCAGTAAATTCGAATGGCTAAAGAAAGATAGATCCATTGAGTAAATTCCTTAGAACTTTTTGGGATCTTTAAAGGTATGCGTGAGTGTTATATTACATATGACTAATTCATTATGACTTGAGTTTTGTTAATCCAGTTGTAATGTTTAGTAGAAACAGAGGAAAACAGGGTCCAGTTGTACATTTTGGTCTTGAGTAAACAAATGAGATTCAAGATGTATGTCTTGACGTTAT

SEQ ID NO: 1649 - DNA, 1467 bp, Arabidopsis thaliana
  misc_feature (1)..(1467): Ceres cDNA ID no. 12666749
  misc_feature (1)..(1467): Also known as  Ceres CDNA ID no. 23659454
atgagtaaccgacggaaacagagcaccactgccggcatcttcctctgcatcaccatagtatctttattatccggcgacgtctccgccttgggagtaaactggggaacgatgtcaactcaccagctccctccaaagacggtggtacagatgttaaaagacaacaacgtcaaaaaagtgaagcttttcgatgcggacacaaacaccatggtagctcttgccggctctggtatcgaagttatggttgcaatccctaacgatcagctcaaagccatgggaagttataacagagctaaagattgggttcgaagaaacatcactcgtttcaatgacgatgttaaaatcaaatatgtcgccgttggaaatgagccgtttttgacagcttataatggatcattcataaacttaacttatccagcactcttcaacatccaaaaagcattaaacgaagctggagttggagatttcatcaaagccaccgtacctttaaacgctgacgtctataattctccgctggaaaatccagttccttctgccggaagtttccgtcaagacatctttgaagagatgaaactaatagtcaacttcttagctcataacaaagctcccttcactgtcaacatttaccctttcctaagtctttaccttagcagcgatttcccttttgactatgccttcttcaatggccaaaacactgtcagcgataacggcgttatctatacaaatgttttcgacgccaatttcgataccctcttggcttcacttaaagctttgggtcatggagacatgactgttatagttggagaagttggttggccaacggatggtgacaagaatgctaacatcccaaacgcagaacgcttctacacaggtttgcttccaaagctagcagccaacagaggaacacctatgcgtccgggttacattgaagtttatctctttggattcatcgatgaagatgcaaagagtatagctcctggtaactttgaacgtcactgggggatattcaaatacgatggccaaccgaaatttccagcggatttgtcaggagcaggtcagaagaagatcttaaccggagctcaaaatgttcagtacttgcgaaaccagtggtgtatgttcaaccctaatgccctcactttcagcaacaacactaaccagctcggggataacgtaaactacgcatgtaccttctccgactgcacagctttgggctatggttcctcttgtggtaatcttgatgaggtcgggaatgcctcgtatgcattcaacatgtattttcaggtacagaatcaaaaggcagaggcttgtgactttgagggccttgcaattatcactaccaggaatatttctcgagaacagtgtaattttcctattcaaatcggagatccaacatccggacatagtgatcataaccaccggtttatcagcttctctctggtgagtatgttgctactctttacagcactatga

SEQ ID NO: 1650 - protein, 1467 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGAGTAACCGACGGAAACAGAGCACCACTGCCGGCATCTTCCTCTGCATCACCATAGTATCTTTATTATCCGGCGACGTCTCCGCCTTGGGAGTAAACTGGGGAACGATGTCAACTCACCAGCTCCCTCCAAAGACGGTGGTACAGATGTTAAAAGACAACAACGTCAAAAAAGTGAAGCTTTTCGATGCGGACACAAACACCATGGTAGCTCTTGCCGGCTCTGGTATCGAAGTTATGGTTGCAATCCCTAACGATCAGCTCAAAGCCATGGGAAGTTATAACAGAGCTAAAGATTGGGTTCGAAGAAACATCACTCGTTTCAATGACGATGTTAAAATCAAATATGTCGCCGTTGGAAATGAGCCGTTTTTGACAGCTTATAATGGATCATTCATAAACTTAACTTATCCAGCACTCTTCAACATCCAAAAAGCATTAAACGAAGCTGGAGTTGGAGATTTCATCAAAGCCACCGTACCTTTAAACGCTGACGTCTATAATTCTCCGCTGGAAAATCCAGTTCCTTCTGCCGGAAGTTTCCGTCAAGACATCTTTGAAGAGATGAAACTAATAGTCAACTTCTTAGCTCATAACAAAGCTCCCTTCACTGTCAACATTTACCCTTTCCTAAGTCTTTACCTTAGCAGCGATTTCCCTTTTGACTATGCCTTCTTCAATGGCCAAAACACTGTCAGCGATAACGGCGTTATCTATACAAATGTTTTCGACGCCAATTTCGATACCCTCTTGGCTTCACTTAAAGCTTTGGGTCATGGAGACATGACTGTTATAGTTGGAGAAGTTGGTTGGCCAACGGATGGTGACAAGAATGCTAACATCCCAAACGCAGAACGCTTCTACACAGGTTTGCTTCCAAAGCTAGCAGCCAACAGAGGAACACCTATGCGTCCGGGTTACATTGAAGTTTATCTCTTTGGATTCATCGATGAAGATGCAAAGAGTATAGCTCCTGGTAACTTTGAACGTCACTGGGGGATATTCAAATACGATGGCCAACCGAAATTTCCAGCGGATTTGTCAGGAGCAGGTCAGAAGAAGATCTTAACCGGAGCTCAAAATGTTCAGTACTTGCGAAACCAGTGGTGTATGTTCAACCCTAATGCCCTCACTTTCAGCAACAACACTAACCAGCTCGGGGATAACGTAAACTACGCATGTACCTTCTCCGACTGCACAGCTTTGGGCTATGGTTCCTCTTGTGGTAATCTTGATGAGGTCGGGAATGCCTCGTATGCATTCAACATGTATTTTCAGGTACAGAATCAAAAGGCAGAGGCTTGTGACTTTGAGGGCCTTGCAATTATCACTACCAGGAATATTTCTCGAGAACAGTGTAATTTTCCTATTCAAATCGGAGATCCAACATCCGGACATAGTGATCATAACCACCGGTTTATCAGCTTCTCTCTGGTGAGTATGTTGCTACTCTTTACAGCACTATGA

SEQ ID NO: 1651 - DNA, 1782 bp, Arabidopsis thaliana
  misc_feature (1)..(1782): Ceres cDNA ID no. 12666826
  misc_feature (1)..(1782): Also known as  Ceres CDNA ID no. 23659454
agtaagtaactttggtaattaacagtgttattatcaaattcgaatctcttacattaatggaaactcagatcttctcttaaaaacacataaagcacagatcttttacagagaatcttgtaagaagaaagaagatgattgagaggtgtttaggagcttaccggtgccggagaatccaaagagctttacgccaattaaaggtaacgattctctgtcttcttcttaccgttgttgtcctacgtagcacaatcggcgccggtaaattcggaactccggagcaagatcttgacgagatccgtcaacatttccacgcacgcaaacgaggtgagcctcaccgtgtcctcgaagaaattcagaccggaggagattcttcttccggtgacggtggaggtaattccggtgggagtaataactacgagacgtttgacatcaacaagattttcgttgacgaaggtgaagaagagaaacccgacccgaataaaccttacactctcggacccaagatatcagattgggatgagcagagatctgattggttagctaagaaccctagcttccctaatttcatcggacctaacaagccacgtgttcttttggtgactggttcggcgccaaaaccatgtgagaatcctgtcggtgatcattacctcttgaaatcgatcaagaacaagatcgattactgtaggttacatgggatcgagatcttctacaacatggctcttctcgatgcagagatggctggtttttgggcaaagcttccattgattaggaagcttttgttgtcacatcctgagattgagtttctttggtggatggatagtgatgctatgtttacagatatggcttttgagcttccatgggagaggtataaagattacaatctggtgatgcatggatggaatgagatggtttatgatcagaagaattggattgggttgaatacagggagtttcttgcttaggaacaatcaatgggcacttgatttgcttgatacttgggctcccatgggtcctaaagggaagatccgtgaagaagcgggtaaggttttgacccgtgagctcaaggatagaccggtgttcgaagctgatgatcagtctgctatggtttatctgttggctactcagcgagacgcttggggcaataaggtgtacctagaaagtggatactatcttcacggttactgggggattcttgtggacagatatgaagaaatgatagaaaactaccacccgggtctaggagatcacagatggccattggtgactcactttgtcggttgcaaaccgtgtgggaaatttggtgattacccggtggaacggtgtctaaaacaaatggacagagcctttaactttggagataaccagattctgcaaatctatggtttcactcacaaatctttggctagtcgtaaagtcaagagagtgcggaacgagactagcaatccgttggagatgaaagacgagctcgggttgcttcatccggcgtttaaggcggttaaggtacaaaccaatcaagtttgaatcggttttgcgtttaggatttgtgttatgtttctcgctatatttatgtcttgtgtctttgcttgttgttgtactaagatggatgataaagtattgtgcagagacatcagttaattctttggttttactttgtctctacgtctagagttctattacgaaatcaaaatgttgtttttcttcctttttgttctttgtaatccattagaacttgagattttgtagcttcatggatcaataatctgtgttaattcaagaactttttttt

SEQ ID NO: 1652 - protein, 1782 aa, Arabidopsis thaliana
  misc_feature: GI Number: 34905882; NR Description: P0458E05.17 [Oryza sativa (japonica cultivar-group)] >gi|21902069|dbj|BAC05617.1|
AGTAAGTAACTTTGGTAATTAACAGTGTTATTATCAAATTCGAATCTCTTACATTAATGGAAACTCAGATCTTCTCTTAAAAACACATAAAGCACAGATCTTTTACAGAGAATCTTGTAAGAAGAAAGAAGATGATTGAGAGGTGTTTAGGAGCTTACCGGTGCCGGAGAATCCAAAGAGCTTTACGCCAATTAAAGGTAACGATTCTCTGTCTTCTTCTTACCGTTGTTGTCCTACGTAGCACAATCGGCGCCGGTAAATTCGGAACTCCGGAGCAAGATCTTGACGAGATCCGTCAACATTTCCACGCACGCAAACGAGGTGAGCCTCACCGTGTCCTCGAAGAAATTCAGACCGGAGGAGATTCTTCTTCCGGTGACGGTGGAGGTAATTCCGGTGGGAGTAATAACTACGAGACGTTTGACATCAACAAGATTTTCGTTGACGAAGGTGAAGAAGAGAAACCCGACCCGAATAAACCTTACACTCTCGGACCCAAGATATCAGATTGGGATGAGCAGAGATCTGATTGGTTAGCTAAGAACCCTAGCTTCCCTAATTTCATCGGACCTAACAAGCCACGTGTTCTTTTGGTGACTGGTTCGGCGCCAAAACCATGTGAGAATCCTGTCGGTGATCATTACCTCTTGAAATCGATCAAGAACAAGATCGATTACTGTAGGTTACATGGGATCGAGATCTTCTACAACATGGCTCTTCTCGATGCAGAGATGGCTGGTTTTTGGGCAAAGCTTCCATTGATTAGGAAGCTTTTGTTGTCACATCCTGAGATTGAGTTTCTTTGGTGGATGGATAGTGATGCTATGTTTACAGATATGGCTTTTGAGCTTCCATGGGAGAGGTATAAAGATTACAATCTGGTGATGCATGGATGGAATGAGATGGTTTATGATCAGAAGAATTGGATTGGGTTGAATACAGGGAGTTTCTTGCTTAGGAACAATCAATGGGCACTTGATTTGCTTGATACTTGGGCTCCCATGGGTCCTAAAGGGAAGATCCGTGAAGAAGCGGGTAAGGTTTTGACCCGTGAGCTCAAGGATAGACCGGTGTTCGAAGCTGATGATCAGTCTGCTATGGTTTATCTGTTGGCTACTCAGCGAGACGCTTGGGGCAATAAGGTGTACCTAGAAAGTGGATACTATCTTCACGGTTACTGGGGGATTCTTGTGGACAGATATGAAGAAATGATAGAAAACTACCACCCGGGTCTAGGAGATCACAGATGGCCATTGGTGACTCACTTTGTCGGTTGCAAACCGTGTGGGAAATTTGGTGATTACCCGGTGGAACGGTGTCTAAAACAAATGGACAGAGCCTTTAACTTTGGAGATAACCAGATTCTGCAAATCTATGGTTTCACTCACAAATCTTTGGCTAGTCGTAAAGTCAAGAGAGTGCGGAACGAGACTAGCAATCCGTTGGAGATGAAAGACGAGCTCGGGTTGCTTCATCCGGCGTTTAAGGCGGTTAAGGTACAAACCAATCAAGTTTGAATCGGTTTTGCGTTTAGGATTTGTGTTATGTTTCTCGCTATATTTATGTCTTGTGTCTTTGCTTGTTGTTGTACTAAGATGGATGATAAAGTATTGTGCAGAGACATCAGTTAATTCTTTGGTTTTACTTTGTCTCTACGTCTAGAGTTCTATTACGAAATCAAAATGTTGTTTTTCTTCCTTTTTGTTCTTTGTAATCCATTAGAACTTGAGATTTTGTAGCTTCATGGATCAATAATCTGTGTTAATTCAAGAACTTTTTTTT

SEQ ID NO: 1653 - DNA, 3392 bp, Arabidopsis thaliana
  misc_feature (1)..(3392): Ceres cDNA ID no. 12667101
  misc_feature (1)..(3392): Also known as  Ceres CDNA ID no. 23659454
ctctagctcctactttcattacccaattactctctcaacacttctttagtcggcagaaaagattttttttttgagaagcttagcttcaaagggtctttggaggatgttatgatgttgttaccttgcggtctgagatctgaaaggagtaagtgtttttgttttcgttgcagaagaacagagagacaagaggtccttctttgacttggttgtctgaattttccacttcaagattgtttcctacatctccggagattgtctggctgacgagtcctttgtttcttcgtcactaattcagctctcattgtttgtaatttctattcttttagttattgcatgcccttgattgcagttccacagtttttgtgaacttcgtgtgactcgtttgctatttactaatcaagggtcatactcttagtcactctgtggaatgtctcagaaagtgaagacagtaactaagaagcgtgtgtgttgactttgaaaagaatgagaatgttcgaaacgagagcaagggaatggattctccttgtaaagcttgtgcttttcactagtatatggcagcttgcttcagctcttggttcaatgtcttcaattgcaatttcttatggagaaggtggttctgtattctgtggtctgaagtctgatgggtctcatcttgtggtttgctacggatcgaactcagcaatcctctatgggactcctggtcatctccagttcatcggtttaacgggtggagatgggtttatgtgtgggcttctgatgctatctcatcagccttattgttggggaaacagtgcatttattcaaatgggagttcctcaaccaatgaccaaaggagctgagtatttagaagttagtgctggtgattaccatctttgtggtttgaggaagccaatagtgggaagaagaaagaacagcaacattatttcctcttctcttgttgattgttggggttacaatatgacaagaaactttgtctttgataagcagttacattcgctttcggctggttcggagttcaactgcgcgctgtcctctaaagataagtcggttttctgttggggagatgagaatagtagtcaagtaatcagtttaatccccaaggaaaaaaagtttcagaaaattgcagctggtggataccatgtttgtggcattcttgacgggttggaatcgcgagtgctatgttggggaaagagcttagagttcgaagaggaggttacagggacttctacagaagaaaagattcttgatttaccaccaaaagagccactcttagcagtggtaggtgggaagttttatgcttgtggaatcaaacgctatgatcatagtgcggtctgttggggttttttcgtgaacaggagtacacctgctcctacaggtatcggcttttatgatcttgcagcggggaattacttcacttgcggagttctcacagggacttctatgtcacctgtttgttggggtcttggtttccctgcttctatccctttagctgtctcaccaggactctgtatagacactccttgtccaccaggaactcatgaactcagtaaccaagaaaactcgccttgcaaatttactggctctcacatttgcttgccctgtagcaccagttgccctcctggaatgtatcagaaaagcgtatgcacagagagatctgatcaagtttgtgtttacaactgctccagttgttcctcacatgattgctcctcaaactgctcttcttcggctaccagtggaggcaaggaaaaaggaaagttttggtcactgcagctacctattgcaactgcagagattggatttgctctatttttggtagcggttgtctcgataacagcggctttatacattaggtacagattgaggaattgtaggtgctcagaaaatgatacaaggtcttctaaagattcagcctttacgaaagataatggcaaaatccgtccggatcttgatgagctgcaaaagcgcagaagggctagagttttcacttatgaggaacttgaaaaagccgctgatggattcaaagaagaatcaatagtggggaaagggagtttctcatgtgtgtacaaaggagtactgagagatggaaccactgttgcagtgaagagagcgataatgtcatcagacaaacagaagaattcaaatgagtttcgcacggagcttgatctgttatcaagactcaaccatgctcatcttcttagccttcttggatactgtgaagaatgtggagaaaggcttttagtttatgagtttatggcacacggctcactgcacaaccatcttcatggaaagaacaaggccttgaaagagcaactagattgggtcaaaagagtaacgattgctgtccaagctgctagaggaatcgaatacttgcatggttacgcttgccctcccgtgattcaccgggatattaaatcatcaaacattcttatagatgaagaacacaatgctcgagtagctgattttggtctctccttacttggtcctgtcgatagcggctctcctttggcagaactaccagcaggaactctcggttaccttgatcccgagtactatcgacttcactatctcacaaccaaatccgatgtctacagctttggagtcctgcttctcgagatcctaagcggaagaaaagccattgacatgcactacgaagaagggaacatagtagaatgggcagttcctttgatcaaagcaggagatataaacgcactcttggacccggtcttgaaacatccatctgaaatcgaagctttgaaaagaatcgtgagtgtggcttgcaaatgcgtgagaatgagagggaaagatagaccatcaatggataaagtgacaacagcattggaacgagcgcttgcacagctaatgggaaacccgagcagtgagcagccaatattaccaacagaagtggttcttgggagcagcagaatgcacaagaagtcatggaggatcggttcaaaaaggtctggttccgagaacacggaattcagaggcggatcatggataacattcccgagcgtgacatcatcgcagaggaggaaatcatcggcatctgaaggagatgtcgcagaggaggaggatgaagggaggaagcaacaagaagcattgaggagtcttgaggaagagatagggccagcttctcctggacagagcttgttcttgcatcataatttctgaaaacaagtgtctgttttctcaagtctttagtaactaatgacatatataagatattttactctgatgtataatgtgttccttaaggcaggaaagtaacaaagaggcagagagactcttcaagcaagaatgtatcaagtttttttttcaactaattattacaaagttcttttgtataagtgaacctggttatttattattgtactagtggtttttacctgttg

SEQ ID NO: 1654 - protein, 3392 aa, Arabidopsis thaliana
  misc_feature: GI Number: 34905882; NR Description: P0458E05.17 [Oryza sativa (japonica cultivar-group)] >gi|21902069|dbj|BAC05617.1|
CTCTAGCTCCTACTTTCATTACCCAATTACTCTCTCAACACTTCTTTAGTCGGCAGAAAAGATTTTTTTTTTGAGAAGCTTAGCTTCAAAGGGTCTTTGGAGGATGTTATGATGTTGTTACCTTGCGGTCTGAGATCTGAAAGGAGTAAGTGTTTTTGTTTTCGTTGCAGAAGAACAGAGAGACAAGAGGTCCTTCTTTGACTTGGTTGTCTGAATTTTCCACTTCAAGATTGTTTCCTACATCTCCGGAGATTGTCTGGCTGACGAGTCCTTTGTTTCTTCGTCACTAATTCAGCTCTCATTGTTTGTAATTTCTATTCTTTTAGTTATTGCATGCCCTTGATTGCAGTTCCACAGTTTTTGTGAACTTCGTGTGACTCGTTTGCTATTTACTAATCAAGGGTCATACTCTTAGTCACTCTGTGGAATGTCTCAGAAAGTGAAGACAGTAACTAAGAAGCGTGTGTGTTGACTTTGAAAAGAATGAGAATGTTCGAAACGAGAGCAAGGGAATGGATTCTCCTTGTAAAGCTTGTGCTTTTCACTAGTATATGGCAGCTTGCTTCAGCTCTTGGTTCAATGTCTTCAATTGCAATTTCTTATGGAGAAGGTGGTTCTGTATTCTGTGGTCTGAAGTCTGATGGGTCTCATCTTGTGGTTTGCTACGGATCGAACTCAGCAATCCTCTATGGGACTCCTGGTCATCTCCAGTTCATCGGTTTAACGGGTGGAGATGGGTTTATGTGTGGGCTTCTGATGCTATCTCATCAGCCTTATTGTTGGGGAAACAGTGCATTTATTCAAATGGGAGTTCCTCAACCAATGACCAAAGGAGCTGAGTATTTAGAAGTTAGTGCTGGTGATTACCATCTTTGTGGTTTGAGGAAGCCAATAGTGGGAAGAAGAAAGAACAGCAACATTATTTCCTCTTCTCTTGTTGATTGTTGGGGTTACAATATGACAAGAAACTTTGTCTTTGATAAGCAGTTACATTCGCTTTCGGCTGGTTCGGAGTTCAACTGCGCGCTGTCCTCTAAAGATAAGTCGGTTTTCTGTTGGGGAGATGAGAATAGTAGTCAAGTAATCAGTTTAATCCCCAAGGAAAAAAAGTTTCAGAAAATTGCAGCTGGTGGATACCATGTTTGTGGCATTCTTGACGGGTTGGAATCGCGAGTGCTATGTTGGGGAAAGAGCTTAGAGTTCGAAGAGGAGGTTACAGGGACTTCTACAGAAGAAAAGATTCTTGATTTACCACCAAAAGAGCCACTCTTAGCAGTGGTAGGTGGGAAGTTTTATGCTTGTGGAATCAAACGCTATGATCATAGTGCGGTCTGTTGGGGTTTTTTCGTGAACAGGAGTACACCTGCTCCTACAGGTATCGGCTTTTATGATCTTGCAGCGGGGAATTACTTCACTTGCGGAGTTCTCACAGGGACTTCTATGTCACCTGTTTGTTGGGGTCTTGGTTTCCCTGCTTCTATCCCTTTAGCTGTCTCACCAGGACTCTGTATAGACACTCCTTGTCCACCAGGAACTCATGAACTCAGTAACCAAGAAAACTCGCCTTGCAAATTTACTGGCTCTCACATTTGCTTGCCCTGTAGCACCAGTTGCCCTCCTGGAATGTATCAGAAAAGCGTATGCACAGAGAGATCTGATCAAGTTTGTGTTTACAACTGCTCCAGTTGTTCCTCACATGATTGCTCCTCAAACTGCTCTTCTTCGGCTACCAGTGGAGGCAAGGAAAAAGGAAAGTTTTGGTCACTGCAGCTACCTATTGCAACTGCAGAGATTGGATTTGCTCTATTTTTGGTAGCGGTTGTCTCGATAACAGCGGCTTTATACATTAGGTACAGATTGAGGAATTGTAGGTGCTCAGAAAATGATACAAGGTCTTCTAAAGATTCAGCCTTTACGAAAGATAATGGCAAAATCCGTCCGGATCTTGATGAGCTGCAAAAGCGCAGAAGGGCTAGAGTTTTCACTTATGAGGAACTTGAAAAAGCCGCTGATGGATTCAAAGAAGAATCAATAGTGGGGAAAGGGAGTTTCTCATGTGTGTACAAAGGAGTACTGAGAGATGGAACCACTGTTGCAGTGAAGAGAGCGATAATGTCATCAGACAAACAGAAGAATTCAAATGAGTTTCGCACGGAGCTTGATCTGTTATCAAGACTCAACCATGCTCATCTTCTTAGCCTTCTTGGATACTGTGAAGAATGTGGAGAAAGGCTTTTAGTTTATGAGTTTATGGCACACGGCTCACTGCACAACCATCTTCATGGAAAGAACAAGGCCTTGAAAGAGCAACTAGATTGGGTCAAAAGAGTAACGATTGCTGTCCAAGCTGCTAGAGGAATCGAATACTTGCATGGTTACGCTTGCCCTCCCGTGATTCACCGGGATATTAAATCATCAAACATTCTTATAGATGAAGAACACAATGCTCGAGTAGCTGATTTTGGTCTCTCCTTACTTGGTCCTGTCGATAGCGGCTCTCCTTTGGCAGAACTACCAGCAGGAACTCTCGGTTACCTTGATCCCGAGTACTATCGACTTCACTATCTCACAACCAAATCCGATGTCTACAGCTTTGGAGTCCTGCTTCTCGAGATCCTAAGCGGAAGAAAAGCCATTGACATGCACTACGAAGAAGGGAACATAGTAGAATGGGCAGTTCCTTTGATCAAAGCAGGAGATATAAACGCACTCTTGGACCCGGTCTTGAAACATCCATCTGAAATCGAAGCTTTGAAAAGAATCGTGAGTGTGGCTTGCAAATGCGTGAGAATGAGAGGGAAAGATAGACCATCAATGGATAAAGTGACAACAGCATTGGAACGAGCGCTTGCACAGCTAATGGGAAACCCGAGCAGTGAGCAGCCAATATTACCAACAGAAGTGGTTCTTGGGAGCAGCAGAATGCACAAGAAGTCATGGAGGATCGGTTCAAAAAGGTCTGGTTCCGAGAACACGGAATTCAGAGGCGGATCATGGATAACATTCCCGAGCGTGACATCATCGCAGAGGAGGAAATCATCGGCATCTGAAGGAGATGTCGCAGAGGAGGAGGATGAAGGGAGGAAGCAACAAGAAGCATTGAGGAGTCTTGAGGAAGAGATAGGGCCAGCTTCTCCTGGACAGAGCTTGTTCTTGCATCATAATTTCTGAAAACAAGTGTCTGTTTTCTCAAGTCTTTAGTAACTAATGACATATATAAGATATTTTACTCTGATGTATAATGTGTTCCTTAAGGCAGGAAAGTAACAAAGAGGCAGAGAGACTCTTCAAGCAAGAATGTATCAAGTTTTTTTTTCAACTAATTATTACAAAGTTCTTTTGTATAAGTGAACCTGGTTATTTATTATTGTACTAGTGGTTTTTACCTGTTG

SEQ ID NO: 1655 - DNA, 1495 bp, Arabidopsis thaliana
  misc_feature (1)..(1495): Ceres cDNA ID no. 12667379
  misc_feature (1)..(1495): Also known as  Ceres CDNA ID no. 23659454
tcgattatatcacaaggagatatggggaacagtgaaatgtcagcgagtgaggttgcggcggccaagcagaagaacgtcgacgattggttaccgatcacatcttccagaaacgctaagtggtggtactctgcttttcacaatgtcaccgccatggttggtgctggtgttcttagcttgccctacgctatgtccaatctcggatggggacctggagtgacgattatggtgatgtcatggatcataacgttgtacacactgtggcaaatggtggagatgcatgagattgttccagggaagaggcttgataggtatcacgagctaggtcaacacgcttttggtgaaaagcttggcctatggatcgtcgtgccgcagcagcttatcgtggaggtcggtgttgacatcgtttatatggtcacaggaggagcatccctcaagaaagtccatcaactagtctgtcccgattgcaaagagatcagaactacgttttggatcatgatctttgcttccgtccactttgttatctctcaccttcccaatttcaactctatctccatcatctcacttgccgcggctgttatgtccttaacttactcaactattgcttgggctgcatccgtgcacaaaggggtacatccagatgtggactactctcctagagcatcaaccgatgttggaaaagtattcaacttcttgaatgcgttgggagatgtggcttttgcttatgcaggtcacaacgttgtgttggagattcaggccacaatcccttcgactccggagatgccatccaaggtcccaatgtggagaggagttattgtagcctacattgtagtcgccatctgttacttccctgtagcattcctcggctattatatctttggaaacagcgttgatgacaacatcctcatcactttggagaagcctatctggcttattgctatggctaacatgttcgtggttatccatgtcattggaagctatcagatatttgcaatgccagtttttgacatgctcgaaaccgttttggtcaaaaagatgaatttcaatccttctttcaagctccgcttcattactcgtagtctttacgtcgctttcacgatgattgttgcgatatgcgtcccgtttttcggtggactactcggcttctttggaggattcgcctttgccccaacaacttactaccttccatgcattatgtggctcgttctcaagaaaccaaagaggtttggtctatcttggacagctaactggttctgcatcatagtaggagttcttttgacgatccttgccccaattggaggactcagaaccatcattatcaacgccaagacctacaagttcttctcttagatggatcacttttttttgtaaccgcgcaaccgaaaaataaaatcacggcatgtctaattttatgtgactgtccgtttaagtaaattttatgttttcattgtagttaagacaattatctttggtttcttttgataataaactctttttc

SEQ ID NO: 1656 - protein, 1495 aa, Arabidopsis thaliana
  misc_feature: GI Number: 34905882; NR Description: P0458E05.17 [Oryza sativa (japonica cultivar-group)] >gi|21902069|dbj|BAC05617.1|
TCGATTATATCACAAGGAGATATGGGGAACAGTGAAATGTCAGCGAGTGAGGTTGCGGCGGCCAAGCAGAAGAACGTCGACGATTGGTTACCGATCACATCTTCCAGAAACGCTAAGTGGTGGTACTCTGCTTTTCACAATGTCACCGCCATGGTTGGTGCTGGTGTTCTTAGCTTGCCCTACGCTATGTCCAATCTCGGATGGGGACCTGGAGTGACGATTATGGTGATGTCATGGATCATAACGTTGTACACACTGTGGCAAATGGTGGAGATGCATGAGATTGTTCCAGGGAAGAGGCTTGATAGGTATCACGAGCTAGGTCAACACGCTTTTGGTGAAAAGCTTGGCCTATGGATCGTCGTGCCGCAGCAGCTTATCGTGGAGGTCGGTGTTGACATCGTTTATATGGTCACAGGAGGAGCATCCCTCAAGAAAGTCCATCAACTAGTCTGTCCCGATTGCAAAGAGATCAGAACTACGTTTTGGATCATGATCTTTGCTTCCGTCCACTTTGTTATCTCTCACCTTCCCAATTTCAACTCTATCTCCATCATCTCACTTGCCGCGGCTGTTATGTCCTTAACTTACTCAACTATTGCTTGGGCTGCATCCGTGCACAAAGGGGTACATCCAGATGTGGACTACTCTCCTAGAGCATCAACCGATGTTGGAAAAGTATTCAACTTCTTGAATGCGTTGGGAGATGTGGCTTTTGCTTATGCAGGTCACAACGTTGTGTTGGAGATTCAGGCCACAATCCCTTCGACTCCGGAGATGCCATCCAAGGTCCCAATGTGGAGAGGAGTTATTGTAGCCTACATTGTAGTCGCCATCTGTTACTTCCCTGTAGCATTCCTCGGCTATTATATCTTTGGAAACAGCGTTGATGACAACATCCTCATCACTTTGGAGAAGCCTATCTGGCTTATTGCTATGGCTAACATGTTCGTGGTTATCCATGTCATTGGAAGCTATCAGATATTTGCAATGCCAGTTTTTGACATGCTCGAAACCGTTTTGGTCAAAAAGATGAATTTCAATCCTTCTTTCAAGCTCCGCTTCATTACTCGTAGTCTTTACGTCGCTTTCACGATGATTGTTGCGATATGCGTCCCGTTTTTCGGTGGACTACTCGGCTTCTTTGGAGGATTCGCCTTTGCCCCAACAACTTACTACCTTCCATGCATTATGTGGCTCGTTCTCAAGAAACCAAAGAGGTTTGGTCTATCTTGGACAGCTAACTGGTTCTGCATCATAGTAGGAGTTCTTTTGACGATCCTTGCCCCAATTGGAGGACTCAGAACCATCATTATCAACGCCAAGACCTACAAGTTCTTCTCTTAGATGGATCACTTTTTTTTGTAACCGCGCAACCGAAAAATAAAATCACGGCATGTCTAATTTTATGTGACTGTCCGTTTAAGTAAATTTTATGTTTTCATTGTAGTTAAGACAATTATCTTTGGTTTCTTTTGATAATAAACTCTTTTTC

SEQ ID NO: 1657 - DNA, 2463 bp, Arabidopsis thaliana
  misc_feature (1)..(2463): Ceres cDNA ID no. 12667544
  misc_feature (1)..(2463): Also known as  Ceres CDNA ID no. 23659454
atgggaacaaacggtacaacatgtccaggaccaatgaaagcaacctctaatggagtctttcaaggagagaatcctctggaacacgcgttgcctcttctcatactccagatctgtatcgttcttcttctcactcgtcttcttgcttttctcctccgtcctctccggcagccacgtgtcatcgccgagattgtcggtggaatattacttggaccatcagcacttgggaaaagcactaagtttatcaacacagttttcccaccaaagagtctaacggttttagacacacttgcaaacttaggactcatcttcttcctcttcctcgttggtctcgagctcgatcccaaatctcttaagcgaaccggaaagagagctctctctatcgctctcgccggaatcactcttcctttcgtattaggcattggaacttcttttgctctccgcagttccatagctgatggagccagcaaagctcctttccttgtcttcatgggtgttgctctctccatcacagcgtttcccgtcttggcccgaatactcgctgagattaagcttctaaccactgatatcggaaagattgctttgtccgctgctgcggtcaatgacgtggctgcttggattctccttgctctcgcggtggctctttctggagaggggagctctccgcttacttctctttgggtgtttctctcgggttgcggttttgtcttgttctgtatctttgttgtgcaaccagggattaagttgattgctaaacgttgccctgaaggagaaccggtaaatgaactttacgtgtgttgcacgttaggtattgttcttgcagctagcttcgtcacagactttattgggattcatgcgctgtttggtgcttttgtgatcggggttattttccctaaagaaggcaatttcgcgaatgctttagttgagaaagttgaggatctcgtgtcaggtcttttcttgccgctctacttcgtctcaagtggtttaaagaccaatgttgcgacgatccaaggagctcagtcttggggactcttggttttggttatatttaatgcttgtttcggtaaaatcatcggtacagtcctagtttccctttactgcaaagttccgcttgaccagtctttagcgcttggtttcttgatgaacacgaaaggtcttgttgagctcatcgtcctcaacattggtaaagacagaggggttctgaatgatcaaattttcgctataatggttctaatggcgatattcaccacattcatgacgactcctctagttctggcagtgtacaaaccgggtaaatccttaaccaaagctgattataagaaccgaacggtggaggagacgaaccgttcaaacaaaccgctctgcctcatgttctgtttccagagcataatgaacatccccacgatcgtcaacctcatagaagcatcccgaggcataaaccgtaaagaaaatctatcagtctacgcgatgcatcttatggagctttcagagagatcatcggctatactcatggcacacaaggtcaggagaaacggtcttcccttctggaacaaagacaaatctgagaacaatagttcttcttccgacatggttgtggtcgcattcgaggctttccgaagactcagccgtgtctcagtgcgtcccatgacagcgatctcaccgatggcgactatacatgaggatatttgccaaagcgcggaacgcaaaaaaaccgctatggtgattcttccgtttcataagcacgttaggctggacagaacatgggagacgactaggaatgactaccgttggattaacaagaaggttatggaggaatctccatgttctgttgcgattttggttgatcgtggacttggtggtacgacacgtgtcgcgtctagtgatttctcgttgactataacagttttgttttttggagggaatgatgatcgtgaggcgttagcgtttgcggtgcgaatggctgaacatcccgggataagcttaaccgttgttcggtttatccctagcgatgaattcaaaccggaaaacgtgaggatcgagataaccgaagatcagctctgttcaggggcaactagattgattgatattgaagctataaccgaacttaaagcaaagattaaagaaaaagaaagttctcgttctaattcggattctgaatctcatatcatttacgaagagaaaatcgtgaaatgttacgaggaagttatcgaagttattaaagagtattctaaaagcaaccttttcttggtggggaagtcaccggaaggttctgtagcgtcagggataaacgtaagaagcgacacgcctgagcttggaccgatcgggaatttgttaacggaaagcgaaagtgtttcgacggtggcatcagtgttggtggtgcaacagtatatagcaagccgtccggtcggaatttcgaagaacgtcacgactgaagagtcgctggttgaggattctgagagtccttag

SEQ ID NO: 1658 - protein, 2463 aa, Arabidopsis thaliana
  misc_feature: GI Number: 34905882; NR Description: P0458E05.17 [Oryza sativa (japonica cultivar-group)] >gi|21902069|dbj|BAC05617.1|
ATGGGAACAAACGGTACAACATGTCCAGGACCAATGAAAGCAACCTCTAATGGAGTCTTTCAAGGAGAGAATCCTCTGGAACACGCGTTGCCTCTTCTCATACTCCAGATCTGTATCGTTCTTCTTCTCACTCGTCTTCTTGCTTTTCTCCTCCGTCCTCTCCGGCAGCCACGTGTCATCGCCGAGATTGTCGGTGGAATATTACTTGGACCATCAGCACTTGGGAAAAGCACTAAGTTTATCAACACAGTTTTCCCACCAAAGAGTCTAACGGTTTTAGACACACTTGCAAACTTAGGACTCATCTTCTTCCTCTTCCTCGTTGGTCTCGAGCTCGATCCCAAATCTCTTAAGCGAACCGGAAAGAGAGCTCTCTCTATCGCTCTCGCCGGAATCACTCTTCCTTTCGTATTAGGCATTGGAACTTCTTTTGCTCTCCGCAGTTCCATAGCTGATGGAGCCAGCAAAGCTCCTTTCCTTGTCTTCATGGGTGTTGCTCTCTCCATCACAGCGTTTCCCGTCTTGGCCCGAATACTCGCTGAGATTAAGCTTCTAACCACTGATATCGGAAAGATTGCTTTGTCCGCTGCTGCGGTCAATGACGTGGCTGCTTGGATTCTCCTTGCTCTCGCGGTGGCTCTTTCTGGAGAGGGGAGCTCTCCGCTTACTTCTCTTTGGGTGTTTCTCTCGGGTTGCGGTTTTGTCTTGTTCTGTATCTTTGTTGTGCAACCAGGGATTAAGTTGATTGCTAAACGTTGCCCTGAAGGAGAACCGGTAAATGAACTTTACGTGTGTTGCACGTTAGGTATTGTTCTTGCAGCTAGCTTCGTCACAGACTTTATTGGGATTCATGCGCTGTTTGGTGCTTTTGTGATCGGGGTTATTTTCCCTAAAGAAGGCAATTTCGCGAATGCTTTAGTTGAGAAAGTTGAGGATCTCGTGTCAGGTCTTTTCTTGCCGCTCTACTTCGTCTCAAGTGGTTTAAAGACCAATGTTGCGACGATCCAAGGAGCTCAGTCTTGGGGACTCTTGGTTTTGGTTATATTTAATGCTTGTTTCGGTAAAATCATCGGTACAGTCCTAGTTTCCCTTTACTGCAAAGTTCCGCTTGACCAGTCTTTAGCGCTTGGTTTCTTGATGAACACGAAAGGTCTTGTTGAGCTCATCGTCCTCAACATTGGTAAAGACAGAGGGGTTCTGAATGATCAAATTTTCGCTATAATGGTTCTAATGGCGATATTCACCACATTCATGACGACTCCTCTAGTTCTGGCAGTGTACAAACCGGGTAAATCCTTAACCAAAGCTGATTATAAGAACCGAACGGTGGAGGAGACGAACCGTTCAAACAAACCGCTCTGCCTCATGTTCTGTTTCCAGAGCATAATGAACATCCCCACGATCGTCAACCTCATAGAAGCATCCCGAGGCATAAACCGTAAAGAAAATCTATCAGTCTACGCGATGCATCTTATGGAGCTTTCAGAGAGATCATCGGCTATACTCATGGCACACAAGGTCAGGAGAAACGGTCTTCCCTTCTGGAACAAAGACAAATCTGAGAACAATAGTTCTTCTTCCGACATGGTTGTGGTCGCATTCGAGGCTTTCCGAAGACTCAGCCGTGTCTCAGTGCGTCCCATGACAGCGATCTCACCGATGGCGACTATACATGAGGATATTTGCCAAAGCGCGGAACGCAAAAAAACCGCTATGGTGATTCTTCCGTTTCATAAGCACGTTAGGCTGGACAGAACATGGGAGACGACTAGGAATGACTACCGTTGGATTAACAAGAAGGTTATGGAGGAATCTCCATGTTCTGTTGCGATTTTGGTTGATCGTGGACTTGGTGGTACGACACGTGTCGCGTCTAGTGATTTCTCGTTGACTATAACAGTTTTGTTTTTTGGAGGGAATGATGATCGTGAGGCGTTAGCGTTTGCGGTGCGAATGGCTGAACATCCCGGGATAAGCTTAACCGTTGTTCGGTTTATCCCTAGCGATGAATTCAAACCGGAAAACGTGAGGATCGAGATAACCGAAGATCAGCTCTGTTCAGGGGCAACTAGATTGATTGATATTGAAGCTATAACCGAACTTAAAGCAAAGATTAAAGAAAAAGAAAGTTCTCGTTCTAATTCGGATTCTGAATCTCATATCATTTACGAAGAGAAAATCGTGAAATGTTACGAGGAAGTTATCGAAGTTATTAAAGAGTATTCTAAAAGCAACCTTTTCTTGGTGGGGAAGTCACCGGAAGGTTCTGTAGCGTCAGGGATAAACGTAAGAAGCGACACGCCTGAGCTTGGACCGATCGGGAATTTGTTAACGGAAAGCGAAAGTGTTTCGACGGTGGCATCAGTGTTGGTGGTGCAACAGTATATAGCAAGCCGTCCGGTCGGAATTTCGAAGAACGTCACGACTGAAGAGTCGCTGGTTGAGGATTCTGAGAGTCCTTAG

SEQ ID NO: 1659 - DNA, 2008 bp, Arabidopsis thaliana
  misc_feature (1)..(2008): Ceres cDNA ID no. 12667563
  misc_feature (1)..(2008): Also known as  Ceres CDNA ID no. 23659454
aagatcagagatttcagcgatttggagattggagatggagagtcctttggtgcgtctatgcttaaaggaagcttgtaagagcggagatgcggtggaacgatggcgacttcagcggcgtagtcttgagagtctgcctcctcaccttgctgatgctctcctccgtcgcctcctcaaaaagcggcttcttttcccttcgttactcgaaggattcaaatattctgtagagaatatagatctccgaggcaaaagctcagttaacgcagaatggatggcttacattggaggcttcgttaatctaattactctaaatctttcagattgccagagaatcaacagttccaccctctggcctatcacaggattaacaagtttgacagagttggacctttcaagatgtttcaaggttacggatgctggtatgaagcacctccaatctgttgtaaatctgaaaaagttgtggatttcacagacaggtgtcactgaagttggaatttctcttcttgcttcacttaaaaaattgtctcttttggatttgggcggcttacctgtaactgatcagaacttgatttctctccaggcactgacaaagctagagtaccttgacatctggggaagcaacgtaaccaaccaaggagctgtcagtattctcaaattttctaacttgagcttcctaaacctctcgtggacaagcatcacacagactccaaacattccgcaccttgaatgcttacacatgaacacgtgcaccattgtctccgaaccaaaaactcatagctcattagcttccttgaaaaagctagttttatcgggagctaatttcagtgccgagacagagtccttgtcctttaccaacaaaagctgtataacctacttagacgtttccaagacttccctcaaaaacttcagcttcttagaaactatgtttaacctagaacatcttgatctgagctccacagctttcggggatgattctgttgggtttgtagcatgtgttggtgagaatctaaagaatcttaatgtctcggatacacaaatcactccttctggggtcgggaatcttgctggacatgtgccacaacttgagacattatctatgtcccagacatttgtcgacgatctttccatcttgcttatcagcaccacgatgccttgcattaaagcccttgacttgggcatgaacagcaccctaggattctactatctaatatctccacaagaagaaaaagagaagtcactagcagcactacaatctctaacttcccttgaaaccctgagtctagaacatccgtacctgggtgacaaagctctttccggtctaagtagccttactggattaacacatttgtccctaacaagcacatccctcacagattccacactccaccatctctcctctcttccaaacctagtcagtctcggagtccgagatggagttttgaccagcaatggtcttgagaagtttagaccacctaacaggctaagaacactcgacctccaaggttgttggcttttaaccaaagatgatattgctggtctctgcaaaaggtaccctcacatcaaggtgaggcatgagcatgctgactcttcttctctcgaccagaatcaacttcttcctcggtcatctactccacagagttttggaaaggtagcaaggaggaacaaccagaggccggagagttctgttgctgttcccaggagttttttagatcagagggtgaagtacaatagggaagagttggttgctctacaaaattcgcctttatcacaattgctgccatgggaagaacttgtcagtgtaccggaacttcttgctgattccgtgatttgaagcaaatggggtgaacaagttggattttagtaccacctgaatgaattagtagagatcttagcatgtcttgttgacagatttggcctcattttcttttcctcaaaattgtatgacgtctgaaatagacacagtacacggtatgttttagcagaaaatattgtattctttgcagtgttatcg

SEQ ID NO: 1660 - protein, 2008 aa, Arabidopsis thaliana
  misc_feature: GI Number: 34905882; NR Description: P0458E05.17 [Oryza sativa (japonica cultivar-group)] >gi|21902069|dbj|BAC05617.1|
AAGATCAGAGATTTCAGCGATTTGGAGATTGGAGATGGAGAGTCCTTTGGTGCGTCTATGCTTAAAGGAAGCTTGTAAGAGCGGAGATGCGGTGGAACGATGGCGACTTCAGCGGCGTAGTCTTGAGAGTCTGCCTCCTCACCTTGCTGATGCTCTCCTCCGTCGCCTCCTCAAAAAGCGGCTTCTTTTCCCTTCGTTACTCGAAGGATTCAAATATTCTGTAGAGAATATAGATCTCCGAGGCAAAAGCTCAGTTAACGCAGAATGGATGGCTTACATTGGAGGCTTCGTTAATCTAATTACTCTAAATCTTTCAGATTGCCAGAGAATCAACAGTTCCACCCTCTGGCCTATCACAGGATTAACAAGTTTGACAGAGTTGGACCTTTCAAGATGTTTCAAGGTTACGGATGCTGGTATGAAGCACCTCCAATCTGTTGTAAATCTGAAAAAGTTGTGGATTTCACAGACAGGTGTCACTGAAGTTGGAATTTCTCTTCTTGCTTCACTTAAAAAATTGTCTCTTTTGGATTTGGGCGGCTTACCTGTAACTGATCAGAACTTGATTTCTCTCCAGGCACTGACAAAGCTAGAGTACCTTGACATCTGGGGAAGCAACGTAACCAACCAAGGAGCTGTCAGTATTCTCAAATTTTCTAACTTGAGCTTCCTAAACCTCTCGTGGACAAGCATCACACAGACTCCAAACATTCCGCACCTTGAATGCTTACACATGAACACGTGCACCATTGTCTCCGAACCAAAAACTCATAGCTCATTAGCTTCCTTGAAAAAGCTAGTTTTATCGGGAGCTAATTTCAGTGCCGAGACAGAGTCCTTGTCCTTTACCAACAAAAGCTGTATAACCTACTTAGACGTTTCCAAGACTTCCCTCAAAAACTTCAGCTTCTTAGAAACTATGTTTAACCTAGAACATCTTGATCTGAGCTCCACAGCTTTCGGGGATGATTCTGTTGGGTTTGTAGCATGTGTTGGTGAGAATCTAAAGAATCTTAATGTCTCGGATACACAAATCACTCCTTCTGGGGTCGGGAATCTTGCTGGACATGTGCCACAACTTGAGACATTATCTATGTCCCAGACATTTGTCGACGATCTTTCCATCTTGCTTATCAGCACCACGATGCCTTGCATTAAAGCCCTTGACTTGGGCATGAACAGCACCCTAGGATTCTACTATCTAATATCTCCACAAGAAGAAAAAGAGAAGTCACTAGCAGCACTACAATCTCTAACTTCCCTTGAAACCCTGAGTCTAGAACATCCGTACCTGGGTGACAAAGCTCTTTCCGGTCTAAGTAGCCTTACTGGATTAACACATTTGTCCCTAACAAGCACATCCCTCACAGATTCCACACTCCACCATCTCTCCTCTCTTCCAAACCTAGTCAGTCTCGGAGTCCGAGATGGAGTTTTGACCAGCAATGGTCTTGAGAAGTTTAGACCACCTAACAGGCTAAGAACACTCGACCTCCAAGGTTGTTGGCTTTTAACCAAAGATGATATTGCTGGTCTCTGCAAAAGGTACCCTCACATCAAGGTGAGGCATGAGCATGCTGACTCTTCTTCTCTCGACCAGAATCAACTTCTTCCTCGGTCATCTACTCCACAGAGTTTTGGAAAGGTAGCAAGGAGGAACAACCAGAGGCCGGAGAGTTCTGTTGCTGTTCCCAGGAGTTTTTTAGATCAGAGGGTGAAGTACAATAGGGAAGAGTTGGTTGCTCTACAAAATTCGCCTTTATCACAATTGCTGCCATGGGAAGAACTTGTCAGTGTACCGGAACTTCTTGCTGATTCCGTGATTTGAAGCAAATGGGGTGAACAAGTTGGATTTTAGTACCACCTGAATGAATTAGTAGAGATCTTAGCATGTCTTGTTGACAGATTTGGCCTCATTTTCTTTTCCTCAAAATTGTATGACGTCTGAAATAGACACAGTACACGGTATGTTTTAGCAGAAAATATTGTATTCTTTGCAGTGTTATCG

SEQ ID NO: 1661 - DNA, 1053 bp, Arabidopsis thaliana
  misc_feature (1)..(1053): Ceres cDNA ID no. 12667782
  misc_feature (1)..(1053): Also known as  Ceres CDNA ID no. 23659454
aacaaacctaagctcaaagcccaccaaaaagaaaacaatcacttagcaatggcgatgatcagttactccaccattgtggttgctctgcttgcttcttttatgatttgctctgtttccgccaattttcaacgagacgtagagataacttggggagacggacgtggacagatcacaaacaacggcgatcttcttacactctctctcgacaaagcttcaggctcaggattccaatccaagaacgaatatttgttcggtaaaatcgacatgcagatcaaactcgttgccggaaactccgctggaactgtcaccgcttactatttgaaatcccctggatctacatgggacgagattgactttgagttcttgggaaacctaagtggtgatccttacacacttcatactaatgtctttacgcaaggaaaaggcgatagagaacaacaattcaaactctggttcgatcccactagtgatttccacacttactctatcctctggaacccacaacgcatcatattctccgtggatggaactcccataagagaattcaagaacatggaatctcaaggaactctgtttcctaagaaccagccaatgagaatgtactctagtctatggaacgctgaagaatgggccacaaggggtggtctcgtcaaaaccgactggtctaaagctcccttcactgcttcctaccgcggcttcaacgaagaagcttgcgtcgtgatcaacggccagtcttcatgccctaacgtgtcaggacaagggagtactggttcgtggttgtctcaggagctagactcgacgggtcaagaacagatgagatgggtacagaataactacatgatttacaattactgtacggacgctaaaaggttccctcaaggtcttccacgcgagtgcttagctgcgtaaagcttttaaacaaatgatccaaagccatgaaaagtaatactattctttgattcatcttataaagtatctgatgtttggttacatctgttttttatttattctatgtaagtatatttgtattcgaatattgatcaatcactttac

SEQ ID NO: 1662 - protein, 1053 aa, Arabidopsis thaliana
  misc_feature: GI Number: 34905882; NR Description: P0458E05.17 [Oryza sativa (japonica cultivar-group)] >gi|21902069|dbj|BAC05617.1|
AACAAACCTAAGCTCAAAGCCCACCAAAAAGAAAACAATCACTTAGCAATGGCGATGATCAGTTACTCCACCATTGTGGTTGCTCTGCTTGCTTCTTTTATGATTTGCTCTGTTTCCGCCAATTTTCAACGAGACGTAGAGATAACTTGGGGAGACGGACGTGGACAGATCACAAACAACGGCGATCTTCTTACACTCTCTCTCGACAAAGCTTCAGGCTCAGGATTCCAATCCAAGAACGAATATTTGTTCGGTAAAATCGACATGCAGATCAAACTCGTTGCCGGAAACTCCGCTGGAACTGTCACCGCTTACTATTTGAAATCCCCTGGATCTACATGGGACGAGATTGACTTTGAGTTCTTGGGAAACCTAAGTGGTGATCCTTACACACTTCATACTAATGTCTTTACGCAAGGAAAAGGCGATAGAGAACAACAATTCAAACTCTGGTTCGATCCCACTAGTGATTTCCACACTTACTCTATCCTCTGGAACCCACAACGCATCATATTCTCCGTGGATGGAACTCCCATAAGAGAATTCAAGAACATGGAATCTCAAGGAACTCTGTTTCCTAAGAACCAGCCAATGAGAATGTACTCTAGTCTATGGAACGCTGAAGAATGGGCCACAAGGGGTGGTCTCGTCAAAACCGACTGGTCTAAAGCTCCCTTCACTGCTTCCTACCGCGGCTTCAACGAAGAAGCTTGCGTCGTGATCAACGGCCAGTCTTCATGCCCTAACGTGTCAGGACAAGGGAGTACTGGTTCGTGGTTGTCTCAGGAGCTAGACTCGACGGGTCAAGAACAGATGAGATGGGTACAGAATAACTACATGATTTACAATTACTGTACGGACGCTAAAAGGTTCCCTCAAGGTCTTCCACGCGAGTGCTTAGCTGCGTAAAGCTTTTAAACAAATGATCCAAAGCCATGAAAAGTAATACTATTCTTTGATTCATCTTATAAAGTATCTGATGTTTGGTTACATCTGTTTTTTATTTATTCTATGTAAGTATATTTGTATTCGAATATTGATCAATCACTTTAC

SEQ ID NO: 1663 - DNA, 1872 bp, Arabidopsis thaliana
  misc_feature (1)..(1872): Ceres cDNA ID no. 12668116
  misc_feature (1)..(1872): Also known as  Ceres CDNA ID no. 23659454
aaaaaaaaaagagagagagagagagagaaaaatggctaagggatcgtggttcttcattatcctttttatcatctcaatgttagaaaatatgatcaattctctagaattagatcggcatagttttcctgatgatttcatctttgggacagctgcctcggcgtttcagtacgaaggtgcaacaagtgaaggtggcaagtctccaactatatgggatcacttcagcctcacgtatccagaaaggaccaaaatgcataatgcagatgtagcaattgatttttatcatcgttacaaggatgacataaaattgatgaaggagctaaacatggacgctttccgattttcaatctcgtggtcaagattaatacccagtggaaagctaaaggatggagtaaacaaagaaggtgtacaattctacaaggatctcatagacgaacttcttgctaatgacatacaaccttcgatgacgctctatcattgggaccacccacaatctttggaggacgaatatggtggctttctaagccctaaaatcgtagaagattttcgagattttgcaagaatttgttttgaagagtttggagataaagttaagatgtggacaacaatcaacgaaccttatataatgactgttgcgggttatgatcaaggtaacaaggcggctggacgatgctcaaaatgggtaaacgaaaagtgtcaggctggagattcgagtaccgagccttacattgtttcacatcacactcttcttgcccatgccgctgcagtggaagaatttcgaaaatgtgaaaaaacttcgcatgatggccaaattgggatagtactatcaccaagatggttcgagccttatcattccgattcaactgacgataaagaagcagctgaacgagctcttgcctttgaaattggatggcatcttgatccagtcattcacggagattatccagagattgtaaaaaagtacgcgggaaataaattaccttcatttactgttgaacaatcaaagatgttacaaaattcatcagatttcgttggaattaattactacacggctcgcttcgctgctcatcttcctcacatagaccctgaaaaacctcgtttcaaaactgaccaccatgtggaatggaaactgactaatcacagtggtcacatcatcggacctggggaagaaaggggcttcttattttcacacccggaaggcttacgaaaagttcttaactatattaaagagagatacaataacatgccagtctacatcaaagaaaatggaattaatgacaacgacgacggtacaaaaccaagagaagaaattgtgaaggacacatttaggattgaataccataagacacatttcgaagaacttcacaaagctatagtggaagatgggtgtgacgtaagaggatattacgcatggtcattgatggacaattttgaatgggagcatggatacactgcaagatttggtctatactatgttgattttgtcaatggtctcaaacgttatccaaaagattcggtcaaatggtttaagcggttccttaagaaatcggtcgtcggagagagtaacaaagaggaggtagaggagatgtcacgcgcggaagggaataagacttttaagggtttcgaagaatcggcgggtttctttgcatctttcatggcaatgaaccaatcgaggagagatgaggagaataatcgttgctcctttgattttcctcatactcattttggtgttttgcaaggcatagagaacccatcttcattttattgatttcaaatcccttatgtttttaaattccttatggttggacatgtagttaattagaatttagctcatgttaatatatgaacattttcatggtaatattttcttcttgg

SEQ ID NO: 1664 - protein, 1872 aa, Arabidopsis thaliana
  misc_feature: GI Number: 34905882; NR Description: P0458E05.17 [Oryza sativa (japonica cultivar-group)] >gi|21902069|dbj|BAC05617.1|
AAAAAAAAAAGAGAGAGAGAGAGAGAGAAAAATGGCTAAGGGATCGTGGTTCTTCATTATCCTTTTTATCATCTCAATGTTAGAAAATATGATCAATTCTCTAGAATTAGATCGGCATAGTTTTCCTGATGATTTCATCTTTGGGACAGCTGCCTCGGCGTTTCAGTACGAAGGTGCAACAAGTGAAGGTGGCAAGTCTCCAACTATATGGGATCACTTCAGCCTCACGTATCCAGAAAGGACCAAAATGCATAATGCAGATGTAGCAATTGATTTTTATCATCGTTACAAGGATGACATAAAATTGATGAAGGAGCTAAACATGGACGCTTTCCGATTTTCAATCTCGTGGTCAAGATTAATACCCAGTGGAAAGCTAAAGGATGGAGTAAACAAAGAAGGTGTACAATTCTACAAGGATCTCATAGACGAACTTCTTGCTAATGACATACAACCTTCGATGACGCTCTATCATTGGGACCACCCACAATCTTTGGAGGACGAATATGGTGGCTTTCTAAGCCCTAAAATCGTAGAAGATTTTCGAGATTTTGCAAGAATTTGTTTTGAAGAGTTTGGAGATAAAGTTAAGATGTGGACAACAATCAACGAACCTTATATAATGACTGTTGCGGGTTATGATCAAGGTAACAAGGCGGCTGGACGATGCTCAAAATGGGTAAACGAAAAGTGTCAGGCTGGAGATTCGAGTACCGAGCCTTACATTGTTTCACATCACACTCTTCTTGCCCATGCCGCTGCAGTGGAAGAATTTCGAAAATGTGAAAAAACTTCGCATGATGGCCAAATTGGGATAGTACTATCACCAAGATGGTTCGAGCCTTATCATTCCGATTCAACTGACGATAAAGAAGCAGCTGAACGAGCTCTTGCCTTTGAAATTGGATGGCATCTTGATCCAGTCATTCACGGAGATTATCCAGAGATTGTAAAAAAGTACGCGGGAAATAAATTACCTTCATTTACTGTTGAACAATCAAAGATGTTACAAAATTCATCAGATTTCGTTGGAATTAATTACTACACGGCTCGCTTCGCTGCTCATCTTCCTCACATAGACCCTGAAAAACCTCGTTTCAAAACTGACCACCATGTGGAATGGAAACTGACTAATCACAGTGGTCACATCATCGGACCTGGGGAAGAAAGGGGCTTCTTATTTTCACACCCGGAAGGCTTACGAAAAGTTCTTAACTATATTAAAGAGAGATACAATAACATGCCAGTCTACATCAAAGAAAATGGAATTAATGACAACGACGACGGTACAAAACCAAGAGAAGAAATTGTGAAGGACACATTTAGGATTGAATACCATAAGACACATTTCGAAGAACTTCACAAAGCTATAGTGGAAGATGGGTGTGACGTAAGAGGATATTACGCATGGTCATTGATGGACAATTTTGAATGGGAGCATGGATACACTGCAAGATTTGGTCTATACTATGTTGATTTTGTCAATGGTCTCAAACGTTATCCAAAAGATTCGGTCAAATGGTTTAAGCGGTTCCTTAAGAAATCGGTCGTCGGAGAGAGTAACAAAGAGGAGGTAGAGGAGATGTCACGCGCGGAAGGGAATAAGACTTTTAAGGGTTTCGAAGAATCGGCGGGTTTCTTTGCATCTTTCATGGCAATGAACCAATCGAGGAGAGATGAGGAGAATAATCGTTGCTCCTTTGATTTTCCTCATACTCATTTTGGTGTTTTGCAAGGCATAGAGAACCCATCTTCATTTTATTGATTTCAAATCCCTTATGTTTTTAAATTCCTTATGGTTGGACATGTAGTTAATTAGAATTTAGCTCATGTTAATATATGAACATTTTCATGGTAATATTTTCTTCTTGG

SEQ ID NO: 1665 - DNA, 1159 bp, Arabidopsis thaliana
  misc_feature (1)..(1159): Ceres cDNA ID no. 12668124
  misc_feature (1)..(1159): Ceres CLONE  ID no. 1356778
  misc_feature (1)..(1159): Also known as  Ceres CDNA ID no. 12668124
aaaaaaaaaagcttcctttcgaaaaaaatcaaagctttttcttttatcttcaattctcctccgatgaggtgtaaaagacacaccgtcgatctcagcagcagcaacggcgtttgcgcttcttgcctccgtgaacgtctcctctctctcgccgcttccgccgccgtatcagccgccgtagaagataatcaatcaaagaaatctaataacaataatcatcctccgcttttgattttccctcgctctgtttctccttacgttacccgtagaaaatccgacgccggagccggtggaggagatcctttagtttcttctaatcggagattcattaccacgccacagatagatctcgtcggatattcatgcaaagatttcgaatcgaatcgatcaaataaatcaaaacaaggtaaaaaagtatctagattctcgaatctattcagagctagatctgaagatttcgataccaatcccaaatccaacaatcctagattctcctcatgcgacgcgtctgagatttcatcttcttcttcctcttcacgttcatggatctcgacgattctctccaccggtcgacgtaaaaagcaaccaaccaccgcgtgttacatcgaagacgttatcgctgcgcgtagacctcaacgtatatactgtagaggaatgtcacctgtaagagatacggaaccggagcagtcggcggaatcaatcgaggaattgaggagaactccggcgacgaaaactccgggaaggaggaagattgcgatggggatagggaagagcatgtcggggatggctttttgtttgagtccgttggtgagagctagtcctaactgtccgtttaaacggaaaatgagatttccatcggagtttggtaattctggggaggtaacggcggtgccggaaaagcctcatatatcagcagcggcgtcgttttgtgcaaatagatcgaagaagcttgtggatttaggtagagttgatcgccgccgttgagtttttttattttggtgggattagtctttggtcaacgtgtttgactattggatagtaaactacggctttctgaagatggattttgccaaaatcaagctttttatatggcttgtggtgaataatctctatgggaaatagctcaaacaatacttttgttataaaaaattgtaatgttttc

SEQ ID NO: 1666 - protein, 1159 aa, Arabidopsis thaliana
AAAAAAAAAAGCTTCCTTTCGAAAAAAATCAAAGCTTTTTCTTTTATCTTCAATTCTCCTCCGATGAGGTGTAAAAGACACACCGTCGATCTCAGCAGCAGCAACGGCGTTTGCGCTTCTTGCCTCCGTGAACGTCTCCTCTCTCTCGCCGCTTCCGCCGCCGTATCAGCCGCCGTAGAAGATAATCAATCAAAGAAATCTAATAACAATAATCATCCTCCGCTTTTGATTTTCCCTCGCTCTGTTTCTCCTTACGTTACCCGTAGAAAATCCGACGCCGGAGCCGGTGGAGGAGATCCTTTAGTTTCTTCTAATCGGAGATTCATTACCACGCCACAGATAGATCTCGTCGGATATTCATGCAAAGATTTCGAATCGAATCGATCAAATAAATCAAAACAAGGTAAAAAAGTATCTAGATTCTCGAATCTATTCAGAGCTAGATCTGAAGATTTCGATACCAATCCCAAATCCAACAATCCTAGATTCTCCTCATGCGACGCGTCTGAGATTTCATCTTCTTCTTCCTCTTCACGTTCATGGATCTCGACGATTCTCTCCACCGGTCGACGTAAAAAGCAACCAACCACCGCGTGTTACATCGAAGACGTTATCGCTGCGCGTAGACCTCAACGTATATACTGTAGAGGAATGTCACCTGTAAGAGATACGGAACCGGAGCAGTCGGCGGAATCAATCGAGGAATTGAGGAGAACTCCGGCGACGAAAACTCCGGGAAGGAGGAAGATTGCGATGGGGATAGGGAAGAGCATGTCGGGGATGGCTTTTTGTTTGAGTCCGTTGGTGAGAGCTAGTCCTAACTGTCCGTTTAAACGGAAAATGAGATTTCCATCGGAGTTTGGTAATTCTGGGGAGGTAACGGCGGTGCCGGAAAAGCCTCATATATCAGCAGCGGCGTCGTTTTGTGCAAATAGATCGAAGAAGCTTGTGGATTTAGGTAGAGTTGATCGCCGCCGTTGAGTTTTTTTATTTTGGTGGGATTAGTCTTTGGTCAACGTGTTTGACTATTGGATAGTAAACTACGGCTTTCTGAAGATGGATTTTGCCAAAATCAAGCTTTTTATATGGCTTGTGGTGAATAATCTCTATGGGAAATAGCTCAAACAATACTTTTGTTATAAAAAATTGTAATGTTTTC

SEQ ID NO: 1667 - DNA, 3658 bp, Arabidopsis thaliana
  misc_feature (1)..(3658): Ceres cDNA ID no. 12668300
  misc_feature (1)..(3658): Also known as  Ceres CDNA ID no. 12668124
atgggttttgcagagaagaatctttatgattttcgttttcttttgttcatttccattattttgagctgttccatttcagcttctgcaactatcgcagaagcaaatgctcttctgaaatggaaatccactttcacgaactcatcaaaactgtcttcatgggtccatgatgcaaacaccaatactagcttttcctgcaccagttggtatggtgtttcttgcaactcacgagggagtatcgaagagttaaacctcactaacactggtatagaaggtactttccaagatttccccttcatttctctctcaaaccttgcttacgtagatcttagcatgaaccttttatctggaaccatccctcctcaattcggaaacctctctaaactcatctactttgacctctccacaaatcacttaaccggagaaatctctccttccttaggaaatctcaagaacttgacggtactttatcttcaccaaaactatctaactagtgtcattccctcggaactaggcaacatggaatccatgacagatttagcgctaagtcagaacaaacttaccggttcaattccttcttccttaggaaatctcaagaacttgatggttctttatctttacgagaactatctaactggtgtcattcccccggaactaggtaacatggaatccatgacagatttagctttaagtcagaacaaacttaccggttcaattccttctaccttaggaaatctcaagaacttgatggttctttatctttacgagaactatctaactggtgtcattcccccagaaataggcaacatggaatccatgacaaatttagcgctaagtcagaacaaacttactggttcaattccttcttccttaggtaatctcaagaacttgacgcttctttctcttttccagaactatctaactggtggcattcccccgaaactaggcaacatagaatccatgatcgatttagagttgagtaacaacaaacttaccggttcaattccttcttccttaggaaatctcaagaatttgactattctttatctttacgagaactatttaactggtgtcattcccccggaactaggcaacatggaatcgatgattgatttacagttgaataacaacaaacttaccggttcaattccttcttccttcggaaatctcaagaacttgacgtatctttatctttacctgaattatttaactggtgtcattccccaggagctaggcaacatggaatccatgatcaatttagatttaagtcagaacaaacttacaggttctgttcctgattcctttggtaactttaccaagctggaaagtttgtaccttcgtgttaaccacctctctggtgcgatcccgccaggagtagcaaactcttcacatctaactaccttgatacttgacaccaacaacttcactggtttctttcctgaaactgtttgcaaaggtaggaagcttcaaaatatctcattggattacaatcacctcgaaggtcctatcccgaaaagcttgagagattgcaagagcctgatcagagcaagatttctaggaaacaaattcactggcgatatttttgaagcttttgggatttacccagaccttaacttcattgatttcagccacaacaaattccacggtgagatttctagcaactgggagaagagtccaaagctaggtgccttgatcatgtcaaacaacaacatcacgggtgctatcccaacagagatttggaacatgacacaactagttgagctggatctatctaccaacaacctctttggtgaacttccagaagcaattggaaatctcacgaatttgtcgaggctacgacttaatgggaatcagttatctggaagagttcctgcaggtttaagtttcttaaccaatcttgagtctcttgacttatcctcaaacaatttcagctcagagatcccacaaacctttgactcctttttaaagcttcatgacatgaacctgagcagaaacaaattcgacggaagcattccccgactatcaaagctgactcagttaacgcaacttgatctcagccacaaccagctcgacggagaaatcccatcacaactaagctccctgcaaagcctcgacaagctcgacctctcacacaacaatctctcaggtctcattccaacaactttcgagggcatgatagcgctgacgaacgtcgatatatcaaacaataaactcgaaggtccgcttccagatactccaacgtttcgaaaagcaacagcagatgcattggaggaaaacataggcttatgcagtaatattcctaaacaaagattgaaaccatgccgtgagttgaagaaaccgaagaaaaatggcaaccttgttgtgtggatattagtgccaatcctaggagtactcgtcattctctctatatgtgcaaacacattcacctactgcattcggaaacgaaaactacaaaatggaagaaacacagatcctgaaacaggagagaatatgtccatattcagcgttgatggcaaattcaaataccaagatatcatcgaatcaacaaacgaattcgatccaacacacctcatcggaaccggaggatacagcaaagtctacagagcaaacctccaagatacaatcatagccgttaaacgactacatgacacaatagacgaagagatatcaaagccagttgtgaagcaagagttcctaaacgaggtaaaagcattaacagagatccgtcaccgcaacgttgtgaagctcttcggcttctgctcccaccgccgccacacatttctgatctacgagtacatggaaaaaggaagtttaaacaaactcttagccaacgacgaagaagctaagcgactcacttggaccaaaaggatcaacgtcgtgaaaggtgtggctcacgctttatcgtatatgcaccatgaccgaataacaccgatcgttcaccgtgatattagcagcggaaacatccttctcgataacgattacacagctaagatctccgattttggtacagcaaaacttctaaagacggattcatcaaactggtccgccgttgctggaacctacggctacgttgcaccagagtttgcttacacgatgaaggtgacggagaaatgcgatgtgtatagcttcggggttttgatactcgaattgataattgggaaacatccgggagatttggtatcgagtttgtcttcgtctccaggagaagctctgtcgctaagaagcatttccgatgaacgtgtattagaaccacggggacaaaatagagagaagctcttgaagatggtggaaatggctttattgtgtttacaagcaaatccagaatctcggccaacgatgttgtcaatctccactacattttcttagaaactgaacttctccatcaatttctatgttatcattgtgtttatctatacagcaacagtaatctctgttggcttttgttctctgttcttgcttgtgtttgcaggaaggggtgtcgactctcgtttcagcttttgttgttgttgtttgggcttctcggcctgcttcagcttttgtatgtattgggctgcgcccttgttggtctttgggccttgtttgtttttatctttgcggcttgcgtgccatgttaggccttttggtcttgtaatgtgtttggttaatggaaatctatgaagtt

SEQ ID NO: 1668 - protein, 3658 aa, Arabidopsis thaliana
ATGGGTTTTGCAGAGAAGAATCTTTATGATTTTCGTTTTCTTTTGTTCATTTCCATTATTTTGAGCTGTTCCATTTCAGCTTCTGCAACTATCGCAGAAGCAAATGCTCTTCTGAAATGGAAATCCACTTTCACGAACTCATCAAAACTGTCTTCATGGGTCCATGATGCAAACACCAATACTAGCTTTTCCTGCACCAGTTGGTATGGTGTTTCTTGCAACTCACGAGGGAGTATCGAAGAGTTAAACCTCACTAACACTGGTATAGAAGGTACTTTCCAAGATTTCCCCTTCATTTCTCTCTCAAACCTTGCTTACGTAGATCTTAGCATGAACCTTTTATCTGGAACCATCCCTCCTCAATTCGGAAACCTCTCTAAACTCATCTACTTTGACCTCTCCACAAATCACTTAACCGGAGAAATCTCTCCTTCCTTAGGAAATCTCAAGAACTTGACGGTACTTTATCTTCACCAAAACTATCTAACTAGTGTCATTCCCTCGGAACTAGGCAACATGGAATCCATGACAGATTTAGCGCTAAGTCAGAACAAACTTACCGGTTCAATTCCTTCTTCCTTAGGAAATCTCAAGAACTTGATGGTTCTTTATCTTTACGAGAACTATCTAACTGGTGTCATTCCCCCGGAACTAGGTAACATGGAATCCATGACAGATTTAGCTTTAAGTCAGAACAAACTTACCGGTTCAATTCCTTCTACCTTAGGAAATCTCAAGAACTTGATGGTTCTTTATCTTTACGAGAACTATCTAACTGGTGTCATTCCCCCAGAAATAGGCAACATGGAATCCATGACAAATTTAGCGCTAAGTCAGAACAAACTTACTGGTTCAATTCCTTCTTCCTTAGGTAATCTCAAGAACTTGACGCTTCTTTCTCTTTTCCAGAACTATCTAACTGGTGGCATTCCCCCGAAACTAGGCAACATAGAATCCATGATCGATTTAGAGTTGAGTAACAACAAACTTACCGGTTCAATTCCTTCTTCCTTAGGAAATCTCAAGAATTTGACTATTCTTTATCTTTACGAGAACTATTTAACTGGTGTCATTCCCCCGGAACTAGGCAACATGGAATCGATGATTGATTTACAGTTGAATAACAACAAACTTACCGGTTCAATTCCTTCTTCCTTCGGAAATCTCAAGAACTTGACGTATCTTTATCTTTACCTGAATTATTTAACTGGTGTCATTCCCCAGGAGCTAGGCAACATGGAATCCATGATCAATTTAGATTTAAGTCAGAACAAACTTACAGGTTCTGTTCCTGATTCCTTTGGTAACTTTACCAAGCTGGAAAGTTTGTACCTTCGTGTTAACCACCTCTCTGGTGCGATCCCGCCAGGAGTAGCAAACTCTTCACATCTAACTACCTTGATACTTGACACCAACAACTTCACTGGTTTCTTTCCTGAAACTGTTTGCAAAGGTAGGAAGCTTCAAAATATCTCATTGGATTACAATCACCTCGAAGGTCCTATCCCGAAAAGCTTGAGAGATTGCAAGAGCCTGATCAGAGCAAGATTTCTAGGAAACAAATTCACTGGCGATATTTTTGAAGCTTTTGGGATTTACCCAGACCTTAACTTCATTGATTTCAGCCACAACAAATTCCACGGTGAGATTTCTAGCAACTGGGAGAAGAGTCCAAAGCTAGGTGCCTTGATCATGTCAAACAACAACATCACGGGTGCTATCCCAACAGAGATTTGGAACATGACACAACTAGTTGAGCTGGATCTATCTACCAACAACCTCTTTGGTGAACTTCCAGAAGCAATTGGAAATCTCACGAATTTGTCGAGGCTACGACTTAATGGGAATCAGTTATCTGGAAGAGTTCCTGCAGGTTTAAGTTTCTTAACCAATCTTGAGTCTCTTGACTTATCCTCAAACAATTTCAGCTCAGAGATCCCACAAACCTTTGACTCCTTTTTAAAGCTTCATGACATGAACCTGAGCAGAAACAAATTCGACGGAAGCATTCCCCGACTATCAAAGCTGACTCAGTTAACGCAACTTGATCTCAGCCACAACCAGCTCGACGGAGAAATCCCATCACAACTAAGCTCCCTGCAAAGCCTCGACAAGCTCGACCTCTCACACAACAATCTCTCAGGTCTCATTCCAACAACTTTCGAGGGCATGATAGCGCTGACGAACGTCGATATATCAAACAATAAACTCGAAGGTCCGCTTCCAGATACTCCAACGTTTCGAAAAGCAACAGCAGATGCATTGGAGGAAAACATAGGCTTATGCAGTAATATTCCTAAACAAAGATTGAAACCATGCCGTGAGTTGAAGAAACCGAAGAAAAATGGCAACCTTGTTGTGTGGATATTAGTGCCAATCCTAGGAGTACTCGTCATTCTCTCTATATGTGCAAACACATTCACCTACTGCATTCGGAAACGAAAACTACAAAATGGAAGAAACACAGATCCTGAAACAGGAGAGAATATGTCCATATTCAGCGTTGATGGCAAATTCAAATACCAAGATATCATCGAATCAACAAACGAATTCGATCCAACACACCTCATCGGAACCGGAGGATACAGCAAAGTCTACAGAGCAAACCTCCAAGATACAATCATAGCCGTTAAACGACTACATGACACAATAGACGAAGAGATATCAAAGCCAGTTGTGAAGCAAGAGTTCCTAAACGAGGTAAAAGCATTAACAGAGATCCGTCACCGCAACGTTGTGAAGCTCTTCGGCTTCTGCTCCCACCGCCGCCACACATTTCTGATCTACGAGTACATGGAAAAAGGAAGTTTAAACAAACTCTTAGCCAACGACGAAGAAGCTAAGCGACTCACTTGGACCAAAAGGATCAACGTCGTGAAAGGTGTGGCTCACGCTTTATCGTATATGCACCATGACCGAATAACACCGATCGTTCACCGTGATATTAGCAGCGGAAACATCCTTCTCGATAACGATTACACAGCTAAGATCTCCGATTTTGGTACAGCAAAACTTCTAAAGACGGATTCATCAAACTGGTCCGCCGTTGCTGGAACCTACGGCTACGTTGCACCAGAGTTTGCTTACACGATGAAGGTGACGGAGAAATGCGATGTGTATAGCTTCGGGGTTTTGATACTCGAATTGATAATTGGGAAACATCCGGGAGATTTGGTATCGAGTTTGTCTTCGTCTCCAGGAGAAGCTCTGTCGCTAAGAAGCATTTCCGATGAACGTGTATTAGAACCACGGGGACAAAATAGAGAGAAGCTCTTGAAGATGGTGGAAATGGCTTTATTGTGTTTACAAGCAAATCCAGAATCTCGGCCAACGATGTTGTCAATCTCCACTACATTTTCTTAGAAACTGAACTTCTCCATCAATTTCTATGTTATCATTGTGTTTATCTATACAGCAACAGTAATCTCTGTTGGCTTTTGTTCTCTGTTCTTGCTTGTGTTTGCAGGAAGGGGTGTCGACTCTCGTTTCAGCTTTTGTTGTTGTTGTTTGGGCTTCTCGGCCTGCTTCAGCTTTTGTATGTATTGGGCTGCGCCCTTGTTGGTCTTTGGGCCTTGTTTGTTTTTATCTTTGCGGCTTGCGTGCCATGTTAGGCCTTTTGGTCTTGTAATGTGTTTGGTTAATGGAAATCTATGAAGTT

SEQ ID NO: 1669 - DNA, 2238 bp, Arabidopsis thaliana
  misc_feature (1)..(2238): Ceres cDNA ID no. 12668342
  misc_feature (1)..(2238): Also known as  Ceres CDNA ID no. 12668124
atgggcgatattgtggctgtcaaacctctggagaacgtccctagttctactcaatgtccgatgctcacatcaactaactacaccgtatgggctattcgtatgcaaattgcacgtagtgttaacaaaatgtgggagaccattgaaccagggatcgacgatggatataagaatactatggctcggggtctcatctttcaatccataccggaatcgttaaccctacaagtcggaactcttgcaacagcaaagttggtgtgggattcgataaaaactcgatatgtaggagcggatagagtcaaagaagctaggttacaaaccttgatggcagaatttgagaagatgaagatgaaagaaagtgagaaaattgatgtttttgcgggaagacttgcagaattagcaacaaggtctgatgcgttgggaagcaatattgagacatctaagctcgtgaagaagtttcttaatgctttaccactgagaaagtatattcatatcattgcttcactagagcaagttcttgatctcaacaacacaagcttcgaagacattgttggacgtatcaaggtatacgaagaaagagtttgggatggagaagaacaagaagatgatcaagggaagctaatgtatgcaaatactgacacacaagatagctggtatgcaagtagaggaagaggtcaaggaggaggttttaatggacgtggaagaggccggggaagaggatcccgagatacatcgaaagtaacttgttatcgatgtgacaaactcggacactatgcgtcaaactgcccggatagcgttaaaccaagtgtgttcgaaacagaactagatggtgacaatgtttggtatcttgataatggggctagtaatcacatgacgggtaatcgagcatatttctctaagattgatgagagtatcacagggaaagttagatttggtgatgattcttgcatagatatcaaaggaaaaggttcgatactttttatgagtaagaacggcgagaagaaagtcttagcagaggtctatttcataccagatgtaaagagtaacatcattagtctcggacaagcaactgaggcgggatgtaatattagaatgaaagaaaattatttaactctgtatgatcgagatggaaagctattggtaaaggcaatgaggtcaaagaatcgcttgtacaaggtcataatggaagtcaaagcttctaagtgcttctccgattgtgataactctggaacatttgtggttagcttcgaggaatttggaaataatggtatacgtgacgatgatcatgtcgaggaaacagagaatgtgggagaagaaacagagaaaccagggggagatggtttcgatgaaaataatgatatacatgtcgaagatgatcatgtttcatctaacatgggtagtggtgaactaacgcctccatctacaccaagaagatcggagaggcagaagaacaagccgtgttatcttaatgactacatcatgctagctgaactcgaaattgaaaggctcttaatgacaataaatgaagaaccgtgggactacattgaagctaaagagttaagagaatggagagaagcttttgagcttcctgctggagttaagccaatcggactaaagtgggtattcaagacaaaacaaaattctgatggtagtatcaacaagtacaaggcaaggcttgtggctaaagggtatgtgcaacgacacgggatagattttgatgaagtgtttgctccggtagcacgaatcgagacagttcgtctcatcattgctttggctgcctcaaacggatgggagatacaccaccttgacgtgaagactgcgttccttcatggagagcttaaagaagtagtctatgttactcaacctgaaggatatgtgacaaaagggaatgaagaaaaagtttacaagttaaacaaggcactttatggcttaaaacaagcacctagggcttggaacaacaaactaaactcaattcttaaagagttaagcctttgtgtccctccaatgacgatgttaactcaattaacccatcatatgctttccaagctaacaggtgaagaaaggatttatcgaagttctgattctattgatccttctgacacacgtggagataataacctcgtatatacacctgattttctcaataaaattaagttttctggagtacctaaccatatactttggttaaaagttggttgcccgttatgttgttgcgtaatcttgatccacatggaggtttga

SEQ ID NO: 1670 - protein, 2238 aa, Arabidopsis thaliana
ATGGGCGATATTGTGGCTGTCAAACCTCTGGAGAACGTCCCTAGTTCTACTCAATGTCCGATGCTCACATCAACTAACTACACCGTATGGGCTATTCGTATGCAAATTGCACGTAGTGTTAACAAAATGTGGGAGACCATTGAACCAGGGATCGACGATGGATATAAGAATACTATGGCTCGGGGTCTCATCTTTCAATCCATACCGGAATCGTTAACCCTACAAGTCGGAACTCTTGCAACAGCAAAGTTGGTGTGGGATTCGATAAAAACTCGATATGTAGGAGCGGATAGAGTCAAAGAAGCTAGGTTACAAACCTTGATGGCAGAATTTGAGAAGATGAAGATGAAAGAAAGTGAGAAAATTGATGTTTTTGCGGGAAGACTTGCAGAATTAGCAACAAGGTCTGATGCGTTGGGAAGCAATATTGAGACATCTAAGCTCGTGAAGAAGTTTCTTAATGCTTTACCACTGAGAAAGTATATTCATATCATTGCTTCACTAGAGCAAGTTCTTGATCTCAACAACACAAGCTTCGAAGACATTGTTGGACGTATCAAGGTATACGAAGAAAGAGTTTGGGATGGAGAAGAACAAGAAGATGATCAAGGGAAGCTAATGTATGCAAATACTGACACACAAGATAGCTGGTATGCAAGTAGAGGAAGAGGTCAAGGAGGAGGTTTTAATGGACGTGGAAGAGGCCGGGGAAGAGGATCCCGAGATACATCGAAAGTAACTTGTTATCGATGTGACAAACTCGGACACTATGCGTCAAACTGCCCGGATAGCGTTAAACCAAGTGTGTTCGAAACAGAACTAGATGGTGACAATGTTTGGTATCTTGATAATGGGGCTAGTAATCACATGACGGGTAATCGAGCATATTTCTCTAAGATTGATGAGAGTATCACAGGGAAAGTTAGATTTGGTGATGATTCTTGCATAGATATCAAAGGAAAAGGTTCGATACTTTTTATGAGTAAGAACGGCGAGAAGAAAGTCTTAGCAGAGGTCTATTTCATACCAGATGTAAAGAGTAACATCATTAGTCTCGGACAAGCAACTGAGGCGGGATGTAATATTAGAATGAAAGAAAATTATTTAACTCTGTATGATCGAGATGGAAAGCTATTGGTAAAGGCAATGAGGTCAAAGAATCGCTTGTACAAGGTCATAATGGAAGTCAAAGCTTCTAAGTGCTTCTCCGATTGTGATAACTCTGGAACATTTGTGGTTAGCTTCGAGGAATTTGGAAATAATGGTATACGTGACGATGATCATGTCGAGGAAACAGAGAATGTGGGAGAAGAAACAGAGAAACCAGGGGGAGATGGTTTCGATGAAAATAATGATATACATGTCGAAGATGATCATGTTTCATCTAACATGGGTAGTGGTGAACTAACGCCTCCATCTACACCAAGAAGATCGGAGAGGCAGAAGAACAAGCCGTGTTATCTTAATGACTACATCATGCTAGCTGAACTCGAAATTGAAAGGCTCTTAATGACAATAAATGAAGAACCGTGGGACTACATTGAAGCTAAAGAGTTAAGAGAATGGAGAGAAGCTTTTGAGCTTCCTGCTGGAGTTAAGCCAATCGGACTAAAGTGGGTATTCAAGACAAAACAAAATTCTGATGGTAGTATCAACAAGTACAAGGCAAGGCTTGTGGCTAAAGGGTATGTGCAACGACACGGGATAGATTTTGATGAAGTGTTTGCTCCGGTAGCACGAATCGAGACAGTTCGTCTCATCATTGCTTTGGCTGCCTCAAACGGATGGGAGATACACCACCTTGACGTGAAGACTGCGTTCCTTCATGGAGAGCTTAAAGAAGTAGTCTATGTTACTCAACCTGAAGGATATGTGACAAAAGGGAATGAAGAAAAAGTTTACAAGTTAAACAAGGCACTTTATGGCTTAAAACAAGCACCTAGGGCTTGGAACAACAAACTAAACTCAATTCTTAAAGAGTTAAGCCTTTGTGTCCCTCCAATGACGATGTTAACTCAATTAACCCATCATATGCTTTCCAAGCTAACAGGTGAAGAAAGGATTTATCGAAGTTCTGATTCTATTGATCCTTCTGACACACGTGGAGATAATAACCTCGTATATACACCTGATTTTCTCAATAAAATTAAGTTTTCTGGAGTACCTAACCATATACTTTGGTTAAAAGTTGGTTGCCCGTTATGTTGTTGCGTAATCTTGATCCACATGGAGGTTTGA

SEQ ID NO: 1671 - DNA, 1221 bp, Arabidopsis thaliana
  misc_feature (1)..(1221): Ceres cDNA ID no. 12668495
  misc_feature (1)..(1221): Also known as  Ceres CDNA ID no. 12668124
atgtcgtcgaagaaatatcgatattcttcatcttcttctttttcttcttcatcttcttctcagctaagtactccaagagcattgcaaaatgggtattctcaagccattgcttggaacgaagaacttattggagagatcgcggaacttgacaccgagatcttacagttagagcggtatcttctctcgctatacagatcatcttttggagatcatttgcctgataattcttcactccctccatgcacgaccaaatttcacaatgaccaggcctcttctgtttctgataagtctgtcttgtccaggctcaaacagttctctaaaacggacaagataaaaggatctgactctggtcacccgagtttggctgatcttcttggtcttaacactctcagccctaataaactctctgaagagattctgagaagtatttgtgtgatacactacaaactctcagacaatggacataacagattggtcaagaactcaaagaatgaagagtatgggcaggaacttggagttggtatccataagctatacctagacgattacaatttaaagtccgtagagagcatgcttcagaattttagatcattagttcaaaagctcgagaaagttgatccggcaaggctcggtcgggaagagaagcttgcgttctggatcaacatacataatgctttggtgatgcacgcagcatttaacataggtggggagtgggtaaatgcatacgatatccagagttcgatattgggcattcgtccatgccattcaccatcacgtttacggacgctgttttcaccggctaagagttcaaagacaagtagtggtagacacacttacgcgttggactatgccgagccacttcttcattttgccctctcgaccggagcatcaaccgatccaatggtcagagtgtatacatcagaaggaatctttcaagaacttaggcaagcaagagacagttacatccaaacaagtgttggatttgagaaagagacaaagattttattgccaaagatcatttacaactatgcgaaggatacttctcttgacatgggtgaactctttagtaccgtgtctgagtgtttaatggagtcacaaagaacggcaatgagaagaattgtgaacaaaaagcaagagagatgcattcgttgggttcacgatgaatccaagttccgttatgtcatccattcggaacttgtgagaggcagtcttgaaatttga

SEQ ID NO: 1672 - protein, 1221 aa, Arabidopsis thaliana
ATGTCGTCGAAGAAATATCGATATTCTTCATCTTCTTCTTTTTCTTCTTCATCTTCTTCTCAGCTAAGTACTCCAAGAGCATTGCAAAATGGGTATTCTCAAGCCATTGCTTGGAACGAAGAACTTATTGGAGAGATCGCGGAACTTGACACCGAGATCTTACAGTTAGAGCGGTATCTTCTCTCGCTATACAGATCATCTTTTGGAGATCATTTGCCTGATAATTCTTCACTCCCTCCATGCACGACCAAATTTCACAATGACCAGGCCTCTTCTGTTTCTGATAAGTCTGTCTTGTCCAGGCTCAAACAGTTCTCTAAAACGGACAAGATAAAAGGATCTGACTCTGGTCACCCGAGTTTGGCTGATCTTCTTGGTCTTAACACTCTCAGCCCTAATAAACTCTCTGAAGAGATTCTGAGAAGTATTTGTGTGATACACTACAAACTCTCAGACAATGGACATAACAGATTGGTCAAGAACTCAAAGAATGAAGAGTATGGGCAGGAACTTGGAGTTGGTATCCATAAGCTATACCTAGACGATTACAATTTAAAGTCCGTAGAGAGCATGCTTCAGAATTTTAGATCATTAGTTCAAAAGCTCGAGAAAGTTGATCCGGCAAGGCTCGGTCGGGAAGAGAAGCTTGCGTTCTGGATCAACATACATAATGCTTTGGTGATGCACGCAGCATTTAACATAGGTGGGGAGTGGGTAAATGCATACGATATCCAGAGTTCGATATTGGGCATTCGTCCATGCCATTCACCATCACGTTTACGGACGCTGTTTTCACCGGCTAAGAGTTCAAAGACAAGTAGTGGTAGACACACTTACGCGTTGGACTATGCCGAGCCACTTCTTCATTTTGCCCTCTCGACCGGAGCATCAACCGATCCAATGGTCAGAGTGTATACATCAGAAGGAATCTTTCAAGAACTTAGGCAAGCAAGAGACAGTTACATCCAAACAAGTGTTGGATTTGAGAAAGAGACAAAGATTTTATTGCCAAAGATCATTTACAACTATGCGAAGGATACTTCTCTTGACATGGGTGAACTCTTTAGTACCGTGTCTGAGTGTTTAATGGAGTCACAAAGAACGGCAATGAGAAGAATTGTGAACAAAAAGCAAGAGAGATGCATTCGTTGGGTTCACGATGAATCCAAGTTCCGTTATGTCATCCATTCGGAACTTGTGAGAGGCAGTCTTGAAATTTGA

SEQ ID NO: 1673 - DNA, 864 bp, Arabidopsis thaliana
  misc_feature (1)..(864): Ceres cDNA ID no. 12668530
  misc_feature (1)..(864): Also known as  Ceres CDNA ID no. 12668124
atgggagaggaagaagaaaagaaagagaaaggcgatgaaatcatcacggccgtttacaaggttcaccttcactgccggaaatgtgcatgcgacatcaaaaagcctctccttcgattccaaggggttcaaaatgtggactttgatttggagaagaacgagatcaaagtaaaagggaaaatagaagtcgtgaagattcacaaacaaatcgagaaatggagcaagaaaaaagttgagctcatctctcccaaaccttctgaggttaagaaaaccaccactacaacaacaactacttctgtggtagaaaagaagaccaccgagattaaaaaggacgttattcgtacgacagtactaaaggtacacattcattgcgcacagtgtgacaaagatcttcagcacaaactcttgaaacataaagctatccacattgtcaaaaccgatacaaaggcgcaaactctaacggtacaagggacgatagaatccgcaaaactcttagcctatataaagaagaaagttcacaaacatgcagagatcataagctcaaagaccgaagaagagaagaagaaggaagaagaggataagaagaagaaggaagaagaggataagaagaagaaggaagatgagaagaagaaagaggaagagaagaagaaagaagaggagaataagaagaaggaaggagaaaaaaagaaagaagaagtaaaagtagaagtaacaaccaaaacgattactcaagttgtggagtataaagagatagtaaaagttgagggccaaaaagataaagatggaaacataccttactttgtccactacgtatacgctccacaattgttcagtgatgaaaaccctaatgcttgtcgcattgtctag

SEQ ID NO: 1674 - protein, 864 aa, Arabidopsis thaliana
ATGGGAGAGGAAGAAGAAAAGAAAGAGAAAGGCGATGAAATCATCACGGCCGTTTACAAGGTTCACCTTCACTGCCGGAAATGTGCATGCGACATCAAAAAGCCTCTCCTTCGATTCCAAGGGGTTCAAAATGTGGACTTTGATTTGGAGAAGAACGAGATCAAAGTAAAAGGGAAAATAGAAGTCGTGAAGATTCACAAACAAATCGAGAAATGGAGCAAGAAAAAAGTTGAGCTCATCTCTCCCAAACCTTCTGAGGTTAAGAAAACCACCACTACAACAACAACTACTTCTGTGGTAGAAAAGAAGACCACCGAGATTAAAAAGGACGTTATTCGTACGACAGTACTAAAGGTACACATTCATTGCGCACAGTGTGACAAAGATCTTCAGCACAAACTCTTGAAACATAAAGCTATCCACATTGTCAAAACCGATACAAAGGCGCAAACTCTAACGGTACAAGGGACGATAGAATCCGCAAAACTCTTAGCCTATATAAAGAAGAAAGTTCACAAACATGCAGAGATCATAAGCTCAAAGACCGAAGAAGAGAAGAAGAAGGAAGAAGAGGATAAGAAGAAGAAGGAAGAAGAGGATAAGAAGAAGAAGGAAGATGAGAAGAAGAAAGAGGAAGAGAAGAAGAAAGAAGAGGAGAATAAGAAGAAGGAAGGAGAAAAAAAGAAAGAAGAAGTAAAAGTAGAAGTAACAACCAAAACGATTACTCAAGTTGTGGAGTATAAAGAGATAGTAAAAGTTGAGGGCCAAAAAGATAAAGATGGAAACATACCTTACTTTGTCCACTACGTATACGCTCCACAATTGTTCAGTGATGAAAACCCTAATGCTTGTCGCATTGTCTAG

SEQ ID NO: 1675 - DNA, 1180 bp, Arabidopsis thaliana
  misc_feature (1)..(1180): Ceres cDNA ID no. 12668576
  misc_feature (1)..(1180): Also known as  Ceres CDNA ID no. 12668124
  misc_feature (1124)..(1124): n is a, c, t, g, unknown, or other
atggcggagggtgaagagaagaacggaattattgattcgattcctttattcgctaaggagcttattgccggcggcgtcacgggtggtatagctaaaaccgccgttgctccactcgagcgaattaagattcttttccagaccagaagggatgagtttaaaaggataggacttgttggatcaatcaacaagattggcaaaactgaaggtttgatgggtttctacagagggaatggtgcaagtgttgctcggatagttccctatgcagctcttcattacatggcttatgaggaatacaggagatggattatctttggtttcccagacactactcgaggcccattgcttgatctcgtagctggatcatttgctggtggtactgcggttctcttcacctatcctcttgacctggtccggactaagctcgcttatcagacgcaagtaaaagctattcccgtggaacaaatcatatacagaggaattgtagattgtttctcgaggacatacagagaatctggagcccgaggcctatatcgtggtgtagctccttctctctatgggatcttcccttatgctggtttgaagttctacttctacgaggagatgaaacgtcatgtccctccggaacataagcaagacatttccctgaaactcgtttgtgggtcagtcgctggattgcttggtcagactttaacataccctctcgatgttgtccggagacaaatgcaggttgagagactatattcagccgttaaggaagaaacaagaagaggaacaatgcaaacccttttcaagattgcaagagaagaaggttggaagcaactcttctcagggcttagcatcaattaccttaaggttgtaccgtctgtggcaatcggattcacagtgtatgatattatgaagctgcacttaagagtcccgcctcgagaggaacctgaggcagaagctgtgacgacacgaaaaaggaaagttttcacctaatactaagatcaaccatatgatctgattctttgtggtgtttaaaaccacatattattatactagattgtacattccattttttggtagaggaaactgaagctaacactcctccatataaacagtgtcagaatcccaattgaaaactntaggacctctctatgtaaacacataattgcttatacgtttttgttgaatactttcc

SEQ ID NO: 1676 - protein, 1180 aa, Arabidopsis thaliana
ATGGCGGAGGGTGAAGAGAAGAACGGAATTATTGATTCGATTCCTTTATTCGCTAAGGAGCTTATTGCCGGCGGCGTCACGGGTGGTATAGCTAAAACCGCCGTTGCTCCACTCGAGCGAATTAAGATTCTTTTCCAGACCAGAAGGGATGAGTTTAAAAGGATAGGACTTGTTGGATCAATCAACAAGATTGGCAAAACTGAAGGTTTGATGGGTTTCTACAGAGGGAATGGTGCAAGTGTTGCTCGGATAGTTCCCTATGCAGCTCTTCATTACATGGCTTATGAGGAATACAGGAGATGGATTATCTTTGGTTTCCCAGACACTACTCGAGGCCCATTGCTTGATCTCGTAGCTGGATCATTTGCTGGTGGTACTGCGGTTCTCTTCACCTATCCTCTTGACCTGGTCCGGACTAAGCTCGCTTATCAGACGCAAGTAAAAGCTATTCCCGTGGAACAAATCATATACAGAGGAATTGTAGATTGTTTCTCGAGGACATACAGAGAATCTGGAGCCCGAGGCCTATATCGTGGTGTAGCTCCTTCTCTCTATGGGATCTTCCCTTATGCTGGTTTGAAGTTCTACTTCTACGAGGAGATGAAACGTCATGTCCCTCCGGAACATAAGCAAGACATTTCCCTGAAACTCGTTTGTGGGTCAGTCGCTGGATTGCTTGGTCAGACTTTAACATACCCTCTCGATGTTGTCCGGAGACAAATGCAGGTTGAGAGACTATATTCAGCCGTTAAGGAAGAAACAAGAAGAGGAACAATGCAAACCCTTTTCAAGATTGCAAGAGAAGAAGGTTGGAAGCAACTCTTCTCAGGGCTTAGCATCAATTACCTTAAGGTTGTACCGTCTGTGGCAATCGGATTCACAGTGTATGATATTATGAAGCTGCACTTAAGAGTCCCGCCTCGAGAGGAACCTGAGGCAGAAGCTGTGACGACACGAAAAAGGAAAGTTTTCACCTAATACTAAGATCAACCATATGATCTGATTCTTTGTGGTGTTTAAAACCACATATTATTATACTAGATTGTACATTCCATTTTTTGGTAGAGGAAACTGAAGCTAACACTCCTCCATATAAACAGTGTCAGAATCCCAATTGAAAACTNTAGGACCTCTCTATGTAAACACATAATTGCTTATACGTTTTTGTTGAATACTTTCC

SEQ ID NO: 1677 - DNA, 1242 bp, Arabidopsis thaliana
  misc_feature (1)..(1242): Ceres cDNA ID no. 12668677
  misc_feature (1)..(1242): Also known as  Ceres CDNA ID no. 12668124
aaagtccaagcaccaatctagacctcttaggaaaaaaacctaaaaacctaatccccaaacctaaaaggcttatctcatctcttcttctttgtcttctttactctttttttacctctctcttcattgttcttcaccatgtctaatgaaaccagagatctctacaactaccaatacccttcatcgttttcgttgcacgaaatgatgaatctgcctacttcaaatccatcttcttatggaaacctcccatcacaaaacggttttaatccatctacttattccttcaccgattgtctccaaagttctccagcagcgtatgaatctctacttcagaaaacttttggtctttctccctcttcctcagaggttttcaattcttcgatcgatcaagaaccgaaccgtgatgttactaatgacgtaatcaatggtggtgcatgcaacgagactgaaactagggtttctccttctaattcttcctctagtgaggctgatcaccccggtgaagattccggtaagagccggaggaaacgagagttagtcggtgaagaagatcaaatttccaaaaaagttgggaaaacgaaaaagactgaggtgaagaaacaaagagagccacgagtctcgtttatgactaaaagtgaagttgatcatcttgaagatggttatagatggagaaaatacggccaaaaggctgtaaaaaatagcccttatccaaggagttactatagatgtacaacacaaaagtgcaacgtgaagaaacgagtggagagatcgttccaagatccaacggttgtgattacaacttacgagggtcaacacaaccacccgattccgactaatcttcgaggaagttctgccgcggctgctatgttctccgcagacctcatgactccaagaagctttgcacatgatatgtttaggacggcagcttatactaacggcggttctgtggcggcggctttggattatggatatggacaaagtggttatggtagtgtgaattcaaaccctagttctcaccaagtgtatcatcaagggggtgagtatgagctcttgagggagatttttccttcaattttctttaagcaagagccttgatcgatcattgttataactacatatattatatatattgagagagagaggtagagaaaaaaaaaacttatatgtaacttaagatcttattttgtctctcttatttgcatgtacatattttttcatgaaagaatgagacagttgggcttgctt

SEQ ID NO: 1678 - protein, 1242 aa, Arabidopsis thaliana
AAAGTCCAAGCACCAATCTAGACCTCTTAGGAAAAAAACCTAAAAACCTAATCCCCAAACCTAAAAGGCTTATCTCATCTCTTCTTCTTTGTCTTCTTTACTCTTTTTTTACCTCTCTCTTCATTGTTCTTCACCATGTCTAATGAAACCAGAGATCTCTACAACTACCAATACCCTTCATCGTTTTCGTTGCACGAAATGATGAATCTGCCTACTTCAAATCCATCTTCTTATGGAAACCTCCCATCACAAAACGGTTTTAATCCATCTACTTATTCCTTCACCGATTGTCTCCAAAGTTCTCCAGCAGCGTATGAATCTCTACTTCAGAAAACTTTTGGTCTTTCTCCCTCTTCCTCAGAGGTTTTCAATTCTTCGATCGATCAAGAACCGAACCGTGATGTTACTAATGACGTAATCAATGGTGGTGCATGCAACGAGACTGAAACTAGGGTTTCTCCTTCTAATTCTTCCTCTAGTGAGGCTGATCACCCCGGTGAAGATTCCGGTAAGAGCCGGAGGAAACGAGAGTTAGTCGGTGAAGAAGATCAAATTTCCAAAAAAGTTGGGAAAACGAAAAAGACTGAGGTGAAGAAACAAAGAGAGCCACGAGTCTCGTTTATGACTAAAAGTGAAGTTGATCATCTTGAAGATGGTTATAGATGGAGAAAATACGGCCAAAAGGCTGTAAAAAATAGCCCTTATCCAAGGAGTTACTATAGATGTACAACACAAAAGTGCAACGTGAAGAAACGAGTGGAGAGATCGTTCCAAGATCCAACGGTTGTGATTACAACTTACGAGGGTCAACACAACCACCCGATTCCGACTAATCTTCGAGGAAGTTCTGCCGCGGCTGCTATGTTCTCCGCAGACCTCATGACTCCAAGAAGCTTTGCACATGATATGTTTAGGACGGCAGCTTATACTAACGGCGGTTCTGTGGCGGCGGCTTTGGATTATGGATATGGACAAAGTGGTTATGGTAGTGTGAATTCAAACCCTAGTTCTCACCAAGTGTATCATCAAGGGGGTGAGTATGAGCTCTTGAGGGAGATTTTTCCTTCAATTTTCTTTAAGCAAGAGCCTTGATCGATCATTGTTATAACTACATATATTATATATATTGAGAGAGAGAGGTAGAGAAAAAAAAAACTTATATGTAACTTAAGATCTTATTTTGTCTCTCTTATTTGCATGTACATATTTTTTCATGAAAGAATGAGACAGTTGGGCTTGCTT

SEQ ID NO: 1679 - DNA, 2616 bp, Arabidopsis thaliana
  misc_feature (1)..(2616): Ceres cDNA ID no. 12668760
  misc_feature (1)..(2616): Also known as  Ceres CDNA ID no. 12668124
atggcgatgttggtgacgaatttatcttcttcaagcttctgttttttttcctctcctcatttacaaaaccagaaggagatcagaagcggcgttagagttcgaaaatatgtgattttcaatagagcctcgttgagaacagtatcagattgtgttgattcgattacaacttttgatcgaagcgtaacagatgcgaacactcaattacggagattctgcgaatcagggaatctagagaacgccgtgaaacttctttgcgtatctggaaaatgggatattgatccgagaactttatgctctgttcttcagctctgtgctgattcgaaatctctcaaagatggtaaagaagttgataactttattcgtggtaatgggtttgtgatagattcgaatttgggatcaaaactctctcttatgtatacaaattgtggagatttgaaagaagcaagtagagtgttcgatgaggttaagatcgagaaagcattgttctggaatattttgatgaatgagcttgcaaaatctggtgactttagtgggagtattggattgtttaagaagatgatgagttctggtgttgaaatggatagctatactttttcttgtgtttcaaagagtttttcgtctttacgaagtgttcatggaggagagcagcttcatggatttattcttaaatcaggttttggagaaaggaactctgtggggaattctttggttgcattttatttgaagaatcagagagttgatagtgcacgtaaggtgtttgatgaaatgactgagagagatgttatatcttggaattctattattaatgggtatgtatcaaacggattagctgagaaagggctatctgttttcgtgcagatgttggtttcagggatagagattgatttggctactatagttagtgtttttgctggttgtgctgattctcgtttgatatcgttaggtagagctgttcatagtattggagtgaaagcttgttttagtagagaagatcggttttgtaatacattgcttgatatgtattcgaagtgtggtgatcttgattctgctaaagctgtgtttagggagatgagtgatcgaagtgttgtgtcgtatacttccatgattgctggttatgctagggaaggtttggctggtgaagctgtaaagttgtttgaagaaatggaggaagaaggtattagtcctgatgtttataccgtcactgctgttttaaattgttgtgctcgttatcggttgttagatgaaggcaagcgtgtgcatgagtggataaaggaaaacgatttgggatttgatatctttgtatcaaatgctctgatggatatgtatgcaaaatgtggaagcatgcaagaggcggagctagtcttctctgagatgcgtgtgaaagatatcatctcgtggaacaccattattggtgggtactcaaagaactgttacgccaatgaagctctaagcctgtttaatttgctgttggaagaaaagaggtttagtcctgatgagagaacagtggcgtgtgttcttccggcttgtgcaagtctttctgctttcgataaaggcagagaaatccacggttacatcatgagaaacgggtatttctcagatcggcatgttgctaattcgcttgtagacatgtacgcgaaatgtggtgcgttgttactcgctcatatgctctttgatgatattgcttccaaggatcttgtttcttggacagtgatgatagctggatatgggatgcacgggtttggaaaagaggcgattgctcttttcaatcaaatgagacaagcgggtattgaggctgatgaaatatcctttgtatctttgttgtatgcttgtagccattcaggactagttgatgaaggatggagattctttaacatcatgagacatgaatgcaagatcgagccaacggtggaacattatgcttgtatagttgacatgcttgcaagaactggagatttaatcaaagcttataggttcatcgagaacatgccaattccgccagatgctacaatctggggagctttgctgtgtggatgcaggatacatcatgatgttaagttagctgagaaagttgcagagaaagtctttgagcttgaaccagagaacacaggatattatgtactcatggcaaatatctacgcagaagctgagaaatgggaacaagtgaaaaggctaagaaagaggatagggcagcgcggattgaggaagaatccgggatgtagctggatagagataaagggtagagttaacatctttgtagctggagatagttcaaacccggaaactgaaaacattgaagcttttttgagaaaggtaagagctagaatgatagaagaaggatattcaccactgacgaaatacgctttgatcgatgcggaagagatggaaaaggaagaagctttatgtggtcatagtgagaaattagcaatggctttgggaatcataagctctggacatggaaagatcataagagttacaaagaatctaagagtttgtggagattgtcatgaaatggccaagttcatgtctaagttaaccagaagagagattgtcctaagagattcaaaccggtttcaccaatttaaagatggacattgttcttgcagaggtttctggtga

SEQ ID NO: 1680 - protein, 2616 aa, Arabidopsis thaliana
ATGGCGATGTTGGTGACGAATTTATCTTCTTCAAGCTTCTGTTTTTTTTCCTCTCCTCATTTACAAAACCAGAAGGAGATCAGAAGCGGCGTTAGAGTTCGAAAATATGTGATTTTCAATAGAGCCTCGTTGAGAACAGTATCAGATTGTGTTGATTCGATTACAACTTTTGATCGAAGCGTAACAGATGCGAACACTCAATTACGGAGATTCTGCGAATCAGGGAATCTAGAGAACGCCGTGAAACTTCTTTGCGTATCTGGAAAATGGGATATTGATCCGAGAACTTTATGCTCTGTTCTTCAGCTCTGTGCTGATTCGAAATCTCTCAAAGATGGTAAAGAAGTTGATAACTTTATTCGTGGTAATGGGTTTGTGATAGATTCGAATTTGGGATCAAAACTCTCTCTTATGTATACAAATTGTGGAGATTTGAAAGAAGCAAGTAGAGTGTTCGATGAGGTTAAGATCGAGAAAGCATTGTTCTGGAATATTTTGATGAATGAGCTTGCAAAATCTGGTGACTTTAGTGGGAGTATTGGATTGTTTAAGAAGATGATGAGTTCTGGTGTTGAAATGGATAGCTATACTTTTTCTTGTGTTTCAAAGAGTTTTTCGTCTTTACGAAGTGTTCATGGAGGAGAGCAGCTTCATGGATTTATTCTTAAATCAGGTTTTGGAGAAAGGAACTCTGTGGGGAATTCTTTGGTTGCATTTTATTTGAAGAATCAGAGAGTTGATAGTGCACGTAAGGTGTTTGATGAAATGACTGAGAGAGATGTTATATCTTGGAATTCTATTATTAATGGGTATGTATCAAACGGATTAGCTGAGAAAGGGCTATCTGTTTTCGTGCAGATGTTGGTTTCAGGGATAGAGATTGATTTGGCTACTATAGTTAGTGTTTTTGCTGGTTGTGCTGATTCTCGTTTGATATCGTTAGGTAGAGCTGTTCATAGTATTGGAGTGAAAGCTTGTTTTAGTAGAGAAGATCGGTTTTGTAATACATTGCTTGATATGTATTCGAAGTGTGGTGATCTTGATTCTGCTAAAGCTGTGTTTAGGGAGATGAGTGATCGAAGTGTTGTGTCGTATACTTCCATGATTGCTGGTTATGCTAGGGAAGGTTTGGCTGGTGAAGCTGTAAAGTTGTTTGAAGAAATGGAGGAAGAAGGTATTAGTCCTGATGTTTATACCGTCACTGCTGTTTTAAATTGTTGTGCTCGTTATCGGTTGTTAGATGAAGGCAAGCGTGTGCATGAGTGGATAAAGGAAAACGATTTGGGATTTGATATCTTTGTATCAAATGCTCTGATGGATATGTATGCAAAATGTGGAAGCATGCAAGAGGCGGAGCTAGTCTTCTCTGAGATGCGTGTGAAAGATATCATCTCGTGGAACACCATTATTGGTGGGTACTCAAAGAACTGTTACGCCAATGAAGCTCTAAGCCTGTTTAATTTGCTGTTGGAAGAAAAGAGGTTTAGTCCTGATGAGAGAACAGTGGCGTGTGTTCTTCCGGCTTGTGCAAGTCTTTCTGCTTTCGATAAAGGCAGAGAAATCCACGGTTACATCATGAGAAACGGGTATTTCTCAGATCGGCATGTTGCTAATTCGCTTGTAGACATGTACGCGAAATGTGGTGCGTTGTTACTCGCTCATATGCTCTTTGATGATATTGCTTCCAAGGATCTTGTTTCTTGGACAGTGATGATAGCTGGATATGGGATGCACGGGTTTGGAAAAGAGGCGATTGCTCTTTTCAATCAAATGAGACAAGCGGGTATTGAGGCTGATGAAATATCCTTTGTATCTTTGTTGTATGCTTGTAGCCATTCAGGACTAGTTGATGAAGGATGGAGATTCTTTAACATCATGAGACATGAATGCAAGATCGAGCCAACGGTGGAACATTATGCTTGTATAGTTGACATGCTTGCAAGAACTGGAGATTTAATCAAAGCTTATAGGTTCATCGAGAACATGCCAATTCCGCCAGATGCTACAATCTGGGGAGCTTTGCTGTGTGGATGCAGGATACATCATGATGTTAAGTTAGCTGAGAAAGTTGCAGAGAAAGTCTTTGAGCTTGAACCAGAGAACACAGGATATTATGTACTCATGGCAAATATCTACGCAGAAGCTGAGAAATGGGAACAAGTGAAAAGGCTAAGAAAGAGGATAGGGCAGCGCGGATTGAGGAAGAATCCGGGATGTAGCTGGATAGAGATAAAGGGTAGAGTTAACATCTTTGTAGCTGGAGATAGTTCAAACCCGGAAACTGAAAACATTGAAGCTTTTTTGAGAAAGGTAAGAGCTAGAATGATAGAAGAAGGATATTCACCACTGACGAAATACGCTTTGATCGATGCGGAAGAGATGGAAAAGGAAGAAGCTTTATGTGGTCATAGTGAGAAATTAGCAATGGCTTTGGGAATCATAAGCTCTGGACATGGAAAGATCATAAGAGTTACAAAGAATCTAAGAGTTTGTGGAGATTGTCATGAAATGGCCAAGTTCATGTCTAAGTTAACCAGAAGAGAGATTGTCCTAAGAGATTCAAACCGGTTTCACCAATTTAAAGATGGACATTGTTCTTGCAGAGGTTTCTGGTGA

SEQ ID NO: 1681 - DNA, 1105 bp, Arabidopsis thaliana
  misc_feature (1)..(1105): Ceres cDNA ID no. 12668798
  misc_feature (1)..(1105): Also known as  Ceres CDNA ID no. 12668124
atgagagattcaatctatcttttatggattgataatcgattagtggtaataattatgatggtgatgatggtatcatgtagatgcgttttgggattggagaacataaatccgatattcttcgatgaaggtctttctcatttgtttggtgaaggtaatctcatccgatctcctgatgatcgtagcgttcgattactcctcgacaaatacactgggtccggatttatctcttcaagcatgtatcaacatgggtttttcagttcgttgataaagttgccaggagcgtacacggctggtatcgtcgtcgctttctatacatcaaatggtgatgtgtttgtgaaggaccatgacgaactagacatagagtttttagggaacctagaaggaaagccttggcgatttcaaacgaatatgtatggaaacggtagcacaaaccgcggccgcgaagaacgctaccgtctttggtttgatccttccaaggagtttcaccgttatagcatcctttggacccctaccaaaataatattttgggtagatgatgtaccaataagagaaatcctaagaaaagaggaaatgaatggagactatccacaaaagccaatgtctctctatgcaaccatttgggacgcctcaagttgggctacttccggtggaaaattcggcgtcgactacacattttcaccttttgtttccgaattcaaagatatagccctcgacggttgtaatgtctctgactcattccccggagaaaacaacaacaacaacatcggtaattacaataacataaattgttctgtctccgaccaatttctcatgagcaatgactactcaaccattagtcctaaacaagcaactgctatgcgacggttccgagaacgttatatgtattattcgtattgttatgacaccattcgatactcggtgcctccaccggagtgtgttattgtgacggctgagaagaaccggtttagagatactggacggttaaagtttggtggtagtcatcctaaagtgcataaagcacgtaagaaacggcgacggaatcggtctacgccggttgtatcggctgacctatagcattaagttagttgaatttattaccgagtat

SEQ ID NO: 1682 - protein, 1105 aa, Arabidopsis thaliana
ATGAGAGATTCAATCTATCTTTTATGGATTGATAATCGATTAGTGGTAATAATTATGATGGTGATGATGGTATCATGTAGATGCGTTTTGGGATTGGAGAACATAAATCCGATATTCTTCGATGAAGGTCTTTCTCATTTGTTTGGTGAAGGTAATCTCATCCGATCTCCTGATGATCGTAGCGTTCGATTACTCCTCGACAAATACACTGGGTCCGGATTTATCTCTTCAAGCATGTATCAACATGGGTTTTTCAGTTCGTTGATAAAGTTGCCAGGAGCGTACACGGCTGGTATCGTCGTCGCTTTCTATACATCAAATGGTGATGTGTTTGTGAAGGACCATGACGAACTAGACATAGAGTTTTTAGGGAACCTAGAAGGAAAGCCTTGGCGATTTCAAACGAATATGTATGGAAACGGTAGCACAAACCGCGGCCGCGAAGAACGCTACCGTCTTTGGTTTGATCCTTCCAAGGAGTTTCACCGTTATAGCATCCTTTGGACCCCTACCAAAATAATATTTTGGGTAGATGATGTACCAATAAGAGAAATCCTAAGAAAAGAGGAAATGAATGGAGACTATCCACAAAAGCCAATGTCTCTCTATGCAACCATTTGGGACGCCTCAAGTTGGGCTACTTCCGGTGGAAAATTCGGCGTCGACTACACATTTTCACCTTTTGTTTCCGAATTCAAAGATATAGCCCTCGACGGTTGTAATGTCTCTGACTCATTCCCCGGAGAAAACAACAACAACAACATCGGTAATTACAATAACATAAATTGTTCTGTCTCCGACCAATTTCTCATGAGCAATGACTACTCAACCATTAGTCCTAAACAAGCAACTGCTATGCGACGGTTCCGAGAACGTTATATGTATTATTCGTATTGTTATGACACCATTCGATACTCGGTGCCTCCACCGGAGTGTGTTATTGTGACGGCTGAGAAGAACCGGTTTAGAGATACTGGACGGTTAAAGTTTGGTGGTAGTCATCCTAAAGTGCATAAAGCACGTAAGAAACGGCGACGGAATCGGTCTACGCCGGTTGTATCGGCTGACCTATAGCATTAAGTTAGTTGAATTTATTACCGAGTAT

SEQ ID NO: 1683 - DNA, 1416 bp, Arabidopsis thaliana
  misc_feature (1)..(1416): Ceres cDNA ID no. 12669185
  misc_feature (1)..(1416): Also known as  Ceres CDNA ID no. 12668124
gatcaaactgttttatccaagttacaacaaaaatgggaaaggaggacggtttcaggactcagaagcgcgtatcaacagcttcctccgccgccgccggcgttcttccgacgacgatggcgagtggtggagtaaggagaccaccaccacgtggtagacagatccaaaagacgttcaacaacgtgaaaatgacaatcctttgtggcttcgtcaccatcctcgtcctacgtggcactatcggcattaacttcggaacttccgacgccgacgtcgtaaaccagaacattatcgaagagactaaccgacttctagctgagatccgatccgattcggatcctaccgactcaaacgagccacctgattcggatcttgacctcaacatgacgtacactctcggacccaagatcactaactgggatcaaaaacggaaactttggttaacgcaaaacccagatttccccagtttcatcaatggtaaagctaaggttttgcttttaacaggttcgcctccaaaaccttgtgacaaccctattggtgatcattacctgctgaaatcggtgaagaacaagattgattattgtaggattcatgggattgagattgtgtataacatggctcatttagacaaggagcttgctgggtattgggcaaagcttccaatgatcaggagattgatgttgtctcatcctgaaattgaatggatttggtggatggacagtgatgctttgttcactgacatggtgtttgagattcctttgtctagatatgagaaccataacttggttattcatggatatcctgatttgttgtttgatcagaagtcttggattgctttgaatactggtagcttcttgtttaggaactgtcaatggtctttggatttgttggatgcttgggctccaatgggacctaaaggacctattcgggaagaagctgggaagattctcaccgcgaatcttaaaggaagaccggctttcgaagcggatgatcagtctgcattgatctatctgctgctttcgcagaaggagacgtggatggagaaagtgtttgtggagaatcagtactatcttcatgggttttgggaaggtttagtggataagtatgaggagatgatggagaagtaccatcccggtttgggagatgaaagatggccttttattactcactttgttggatgcaaaccgtgtgggagttatgctgattacgcggttgaacgttgcttgaagagtatggagcgagcattcaactttgcggataatcaagtgctcaaactgtatgggtttggtcacaggggattgttaagtcctaagatcaagaggatcagaaacgagacaacatttccattgaaattcgtagacaggtttgatattcggagaacaacaccgctcaagattgaagcacgaagctagcagctgatga

SEQ ID NO: 1684 - protein, 1416 aa, Arabidopsis thaliana
GATCAAACTGTTTTATCCAAGTTACAACAAAAATGGGAAAGGAGGACGGTTTCAGGACTCAGAAGCGCGTATCAACAGCTTCCTCCGCCGCCGCCGGCGTTCTTCCGACGACGATGGCGAGTGGTGGAGTAAGGAGACCACCACCACGTGGTAGACAGATCCAAAAGACGTTCAACAACGTGAAAATGACAATCCTTTGTGGCTTCGTCACCATCCTCGTCCTACGTGGCACTATCGGCATTAACTTCGGAACTTCCGACGCCGACGTCGTAAACCAGAACATTATCGAAGAGACTAACCGACTTCTAGCTGAGATCCGATCCGATTCGGATCCTACCGACTCAAACGAGCCACCTGATTCGGATCTTGACCTCAACATGACGTACACTCTCGGACCCAAGATCACTAACTGGGATCAAAAACGGAAACTTTGGTTAACGCAAAACCCAGATTTCCCCAGTTTCATCAATGGTAAAGCTAAGGTTTTGCTTTTAACAGGTTCGCCTCCAAAACCTTGTGACAACCCTATTGGTGATCATTACCTGCTGAAATCGGTGAAGAACAAGATTGATTATTGTAGGATTCATGGGATTGAGATTGTGTATAACATGGCTCATTTAGACAAGGAGCTTGCTGGGTATTGGGCAAAGCTTCCAATGATCAGGAGATTGATGTTGTCTCATCCTGAAATTGAATGGATTTGGTGGATGGACAGTGATGCTTTGTTCACTGACATGGTGTTTGAGATTCCTTTGTCTAGATATGAGAACCATAACTTGGTTATTCATGGATATCCTGATTTGTTGTTTGATCAGAAGTCTTGGATTGCTTTGAATACTGGTAGCTTCTTGTTTAGGAACTGTCAATGGTCTTTGGATTTGTTGGATGCTTGGGCTCCAATGGGACCTAAAGGACCTATTCGGGAAGAAGCTGGGAAGATTCTCACCGCGAATCTTAAAGGAAGACCGGCTTTCGAAGCGGATGATCAGTCTGCATTGATCTATCTGCTGCTTTCGCAGAAGGAGACGTGGATGGAGAAAGTGTTTGTGGAGAATCAGTACTATCTTCATGGGTTTTGGGAAGGTTTAGTGGATAAGTATGAGGAGATGATGGAGAAGTACCATCCCGGTTTGGGAGATGAAAGATGGCCTTTTATTACTCACTTTGTTGGATGCAAACCGTGTGGGAGTTATGCTGATTACGCGGTTGAACGTTGCTTGAAGAGTATGGAGCGAGCATTCAACTTTGCGGATAATCAAGTGCTCAAACTGTATGGGTTTGGTCACAGGGGATTGTTAAGTCCTAAGATCAAGAGGATCAGAAACGAGACAACATTTCCATTGAAATTCGTAGACAGGTTTGATATTCGGAGAACAACACCGCTCAAGATTGAAGCACGAAGCTAGCAGCTGATGA

SEQ ID NO: 1685 - DNA, 849 bp, Arabidopsis thaliana
  misc_feature (1)..(849): Ceres cDNA ID no. 12669484
  misc_feature (1)..(849): Also known as  Ceres CDNA ID no. 12668124
atggatgatcatgttgagcacaattataacacatctttagaagaagtacacttcaagagcttaagtgattgcttacaaagctcattagtaatggattataactcactagagaaggtcttcaaattctcaccttatagttccccttttcaatcggtttcaccgtcagtaaacaacccttacttaaatctcacttcgaattctccggtggtctcatcttcctccaatgaaggcgagcctaaagagaacaccaacgataagagtgaccaaatggaggataacgaaggcgacctacatggtgttggtgaaagctccaagcaactgacaaaacaaggtaaaaagaaaggagagaagaaagagagagaagttagggttgcatttatgaccaaaagcgagattgatcatcttgaagatggttatagatggcgaaaatatggacaaaaagcagtgaagaacagcccttatccaaggagttactataggtgcacaacacagaagtgtaacgtgaagaaacgtgtagagagatcgtttcaagatccgtcgatcgtaattacaacctacgaaggaaaacacaaccatccgatcccatcgacgttgagaggaaccgtggcagctgaacatctactagtccaccgtggtggtggaggcagtttactccatagcttccctcgtcaccatcaagattttctcatgatgaaacattctccggccaattatcaatcggtgggatctctgtcgtacgaacatggccatgggacctctagttacaattttaataataatcaaccagttgttgactatggtcttcttcaggacattgttccttcaatgttctccaagaacgagtcttga

SEQ ID NO: 1686 - protein, 849 aa, Arabidopsis thaliana
ATGGATGATCATGTTGAGCACAATTATAACACATCTTTAGAAGAAGTACACTTCAAGAGCTTAAGTGATTGCTTACAAAGCTCATTAGTAATGGATTATAACTCACTAGAGAAGGTCTTCAAATTCTCACCTTATAGTTCCCCTTTTCAATCGGTTTCACCGTCAGTAAACAACCCTTACTTAAATCTCACTTCGAATTCTCCGGTGGTCTCATCTTCCTCCAATGAAGGCGAGCCTAAAGAGAACACCAACGATAAGAGTGACCAAATGGAGGATAACGAAGGCGACCTACATGGTGTTGGTGAAAGCTCCAAGCAACTGACAAAACAAGGTAAAAAGAAAGGAGAGAAGAAAGAGAGAGAAGTTAGGGTTGCATTTATGACCAAAAGCGAGATTGATCATCTTGAAGATGGTTATAGATGGCGAAAATATGGACAAAAAGCAGTGAAGAACAGCCCTTATCCAAGGAGTTACTATAGGTGCACAACACAGAAGTGTAACGTGAAGAAACGTGTAGAGAGATCGTTTCAAGATCCGTCGATCGTAATTACAACCTACGAAGGAAAACACAACCATCCGATCCCATCGACGTTGAGAGGAACCGTGGCAGCTGAACATCTACTAGTCCACCGTGGTGGTGGAGGCAGTTTACTCCATAGCTTCCCTCGTCACCATCAAGATTTTCTCATGATGAAACATTCTCCGGCCAATTATCAATCGGTGGGATCTCTGTCGTACGAACATGGCCATGGGACCTCTAGTTACAATTTTAATAATAATCAACCAGTTGTTGACTATGGTCTTCTTCAGGACATTGTTCCTTCAATGTTCTCCAAGAACGAGTCTTGA

SEQ ID NO: 1687 - DNA, 1610 bp, Arabidopsis thaliana
  misc_feature (1)..(1610): Ceres cDNA ID no. 12669537
  misc_feature (1)..(1610): Also known as  Ceres CDNA ID no. 12668124
aatttacaacaaaacaaaaaaaaatgaggaagagctgaaagattcgcgacgaagcaaaacgacagtgttatctatcgccgccttgttgttctgtttaacaagtgtagaggaaccaaagttgaaaactttgaacttcccattgattttaatgttaattactgatcattcgaatctgaaattgaagcatatgagtgcttaatctgtgagtgttagaagaagtagaagaagatgcagagggttagggtttcatctcaaagagcagttgtgcataagcttggtgattctcagatgacattatctcccaaatttagagtagctgcatcgatacaatcgacattgttcgatagatcatcggaattagaactgtctcttagaggagagcccttgattcccggtttaccagacgatgttgcgcttaactgtcttttacgggttccagttcaaagccatgtatcgagtaaatccgtgtgcaagagatggcatcttttgtttggtactaaagagacgtttttcgctaagcgtaaggagttcgggtttaaagacccgtggctgttcgttgtcgggtttagtagatgcactgggaagatccagtggaaggttttggatttgaggaatctcacttggcatgaaatccctgctatgccttgcagagataaagtttgtcctcacggttttagatcggtttcgatgcctcgcgaaggtactatgtttgtatgtggtggaatggtttcggattctgattgtcctcttgatttggtgttgaagtatgatatggtgaagaatcattggactgtcactaacaagatgataaccgcgaggtcgtttttcgctagcggtgtgatcgatgggatgatatacgcggcaggtggaaatgctgcggatttatatgagcttgattgtgccgaggttttgaaccctttggatgggaattggcggccagtttcgaacatggtagctcatatggcgtcttacgacacagcggttttaaacgggaagcttttggtaacggaaggatggttatggccgttctttgtatccccgagaggtcaagtttatgacccgaggacggatcaatgggaaacaatgtcaatggggctaagagaaggatggaccgggacgagtgtcgtgatttatgatcggttgtttatagtttcggagttagagagaatgaagatgaaggtttatgatccggttacagattcgtgggagacgattaacggaccggaattgcctgagcagatttgtagaccgtttgcggttaactgttatgggaacagagtatatgtggttggtaggaatcttcatctcgcggttgggaatatttggcagtcggagaataagtttgctgtgaggtgggaggttgttgagtcgccggagcgttatgcagatataactccatcgaattctcagattctttttgcttaaaagagatttgatcagtctgtttggtatggtttccaaatgtctgtgaaccatattgtatgaataagtaaaaacttgtcttagtaacatcatcatgatgtttgaactcttgtatcatatatactcatgtgcgtgtataactttaagtccgaaactgttaaatattacatggactggattgttgttct

SEQ ID NO: 1688 - protein, 1610 aa, Arabidopsis thaliana
AATTTACAACAAAACAAAAAAAAATGAGGAAGAGCTGAAAGATTCGCGACGAAGCAAAACGACAGTGTTATCTATCGCCGCCTTGTTGTTCTGTTTAACAAGTGTAGAGGAACCAAAGTTGAAAACTTTGAACTTCCCATTGATTTTAATGTTAATTACTGATCATTCGAATCTGAAATTGAAGCATATGAGTGCTTAATCTGTGAGTGTTAGAAGAAGTAGAAGAAGATGCAGAGGGTTAGGGTTTCATCTCAAAGAGCAGTTGTGCATAAGCTTGGTGATTCTCAGATGACATTATCTCCCAAATTTAGAGTAGCTGCATCGATACAATCGACATTGTTCGATAGATCATCGGAATTAGAACTGTCTCTTAGAGGAGAGCCCTTGATTCCCGGTTTACCAGACGATGTTGCGCTTAACTGTCTTTTACGGGTTCCAGTTCAAAGCCATGTATCGAGTAAATCCGTGTGCAAGAGATGGCATCTTTTGTTTGGTACTAAAGAGACGTTTTTCGCTAAGCGTAAGGAGTTCGGGTTTAAAGACCCGTGGCTGTTCGTTGTCGGGTTTAGTAGATGCACTGGGAAGATCCAGTGGAAGGTTTTGGATTTGAGGAATCTCACTTGGCATGAAATCCCTGCTATGCCTTGCAGAGATAAAGTTTGTCCTCACGGTTTTAGATCGGTTTCGATGCCTCGCGAAGGTACTATGTTTGTATGTGGTGGAATGGTTTCGGATTCTGATTGTCCTCTTGATTTGGTGTTGAAGTATGATATGGTGAAGAATCATTGGACTGTCACTAACAAGATGATAACCGCGAGGTCGTTTTTCGCTAGCGGTGTGATCGATGGGATGATATACGCGGCAGGTGGAAATGCTGCGGATTTATATGAGCTTGATTGTGCCGAGGTTTTGAACCCTTTGGATGGGAATTGGCGGCCAGTTTCGAACATGGTAGCTCATATGGCGTCTTACGACACAGCGGTTTTAAACGGGAAGCTTTTGGTAACGGAAGGATGGTTATGGCCGTTCTTTGTATCCCCGAGAGGTCAAGTTTATGACCCGAGGACGGATCAATGGGAAACAATGTCAATGGGGCTAAGAGAAGGATGGACCGGGACGAGTGTCGTGATTTATGATCGGTTGTTTATAGTTTCGGAGTTAGAGAGAATGAAGATGAAGGTTTATGATCCGGTTACAGATTCGTGGGAGACGATTAACGGACCGGAATTGCCTGAGCAGATTTGTAGACCGTTTGCGGTTAACTGTTATGGGAACAGAGTATATGTGGTTGGTAGGAATCTTCATCTCGCGGTTGGGAATATTTGGCAGTCGGAGAATAAGTTTGCTGTGAGGTGGGAGGTTGTTGAGTCGCCGGAGCGTTATGCAGATATAACTCCATCGAATTCTCAGATTCTTTTTGCTTAAAAGAGATTTGATCAGTCTGTTTGGTATGGTTTCCAAATGTCTGTGAACCATATTGTATGAATAAGTAAAAACTTGTCTTAGTAACATCATCATGATGTTTGAACTCTTGTATCATATATACTCATGTGCGTGTATAACTTTAAGTCCGAAACTGTTAAATATTACATGGACTGGATTGTTGTTCT

SEQ ID NO: 1689 - DNA, 1908 bp, Arabidopsis thaliana
  misc_feature (1)..(1908): Ceres cDNA ID no. 12669552
  misc_feature (1)..(1908): Also known as  Ceres CDNA ID no. 12668124
acacacttctaactcttttaacccaaaaaaaaatggagggaggaataatacatggaggagcagatgaatcagctttcaaagaatgtttctctctaacatggaagaatccttatgttcttcgtcttgctttctctgccggaatcggtggtcttctctttggttacgacaccggagtgatatcaggtgctctgctttatatcagagatgatttcaagtctgttgacagaaatacttggttacaggagatgatagtgagcatggcagttgcaggagccatcgttggagccgccataggaggttgggcgaacgacaaattagggaggagaagcgcgattctcatggcggatttcctctttttattaggagctatcattatggcggctgctcctaacccgtccctccttgtcgttggccgtgtttttgtgggcctcggggtcgggatggcctcgatgaccgctcctctatacatctcagaagcttcgcctgctaagatcagaggagctttggtcagtactaatgggtttctcattaccggaggacagttcttgtcttacctcataaacttagcctttactgatgtgaccggaacgtggagatggatgctcggaatcgccggaattccagctcttttacagtttgtcttaatgtttacactcccggagtcacctcgatggttataccgcaagggaagagaagaagaggctaaagcgattctaagaagaatatactcagcagaagatgtagaacaagagatacgtgcacttaaagactcagttgaaacagagatacttgaagaagggtcttccgagaaaatcaacatgatcaaactatgcaaagctaaaaccgttagacgaggactaatagctggtgttggtctccaagtgtttcaacagttcgttgggatcaacacagttatgtattacagtccaaccattgttcagcttgccggtttcgcttcaaacagaacagctcttctcttgtctctagttaccgcaggacttaatgcatttggttctataattagcatttacttcattgatagaatcggaaggaaaaagcttttgatcattagccttttcggagtcattatctcgctaggaatactaaccggtgttttttatgaagcggctactcacgctcctgcgattagctcactcgagacacaaaggttcaataatattagttgtccggattataagtcagctatgaataccaatgcttgggattgtatgacttgtttgaaagcttcttctccatcttgtggctattgttcctctcccattggaaaggaacatcccggggcatgttggatctctgatgattcggttaaggacttatgtcataacgaaaaccggctttggtacacgagaggatgtcctagcaattttggttggtttgctcttcttggattgggactttatatcatcttcttctctcctggaatggggactgttccatggatagttaactcagagatttatccattgagattcagaggaatatgtggaggaatagctgcaactgcaaattggatatcaaatttgattgtggctcaatcttttttgtcattgaccgaagctattgggacttcttggacttttctcatctttggagtgatctcagtcattgctcttctctttgttatggtttgtgttccggagacaaaaggaatgccaatggaggagattgagaagatgcttgaacgaagatcgatggagtttaagttttggaagaaaaaatcaaaacttgttgagaaacaaaaccagagtgcatgagagaaactcttaaaggaagcataatcaatgagaaagcacatgagacttgtaacttggtattgaaacttaatagtgacaaagtgatctattttaagaaccagtaaaaaagtgttgttatgaatctacttattgg

SEQ ID NO: 1690 - protein, 1908 aa, Arabidopsis thaliana
ACACACTTCTAACTCTTTTAACCCAAAAAAAAATGGAGGGAGGAATAATACATGGAGGAGCAGATGAATCAGCTTTCAAAGAATGTTTCTCTCTAACATGGAAGAATCCTTATGTTCTTCGTCTTGCTTTCTCTGCCGGAATCGGTGGTCTTCTCTTTGGTTACGACACCGGAGTGATATCAGGTGCTCTGCTTTATATCAGAGATGATTTCAAGTCTGTTGACAGAAATACTTGGTTACAGGAGATGATAGTGAGCATGGCAGTTGCAGGAGCCATCGTTGGAGCCGCCATAGGAGGTTGGGCGAACGACAAATTAGGGAGGAGAAGCGCGATTCTCATGGCGGATTTCCTCTTTTTATTAGGAGCTATCATTATGGCGGCTGCTCCTAACCCGTCCCTCCTTGTCGTTGGCCGTGTTTTTGTGGGCCTCGGGGTCGGGATGGCCTCGATGACCGCTCCTCTATACATCTCAGAAGCTTCGCCTGCTAAGATCAGAGGAGCTTTGGTCAGTACTAATGGGTTTCTCATTACCGGAGGACAGTTCTTGTCTTACCTCATAAACTTAGCCTTTACTGATGTGACCGGAACGTGGAGATGGATGCTCGGAATCGCCGGAATTCCAGCTCTTTTACAGTTTGTCTTAATGTTTACACTCCCGGAGTCACCTCGATGGTTATACCGCAAGGGAAGAGAAGAAGAGGCTAAAGCGATTCTAAGAAGAATATACTCAGCAGAAGATGTAGAACAAGAGATACGTGCACTTAAAGACTCAGTTGAAACAGAGATACTTGAAGAAGGGTCTTCCGAGAAAATCAACATGATCAAACTATGCAAAGCTAAAACCGTTAGACGAGGACTAATAGCTGGTGTTGGTCTCCAAGTGTTTCAACAGTTCGTTGGGATCAACACAGTTATGTATTACAGTCCAACCATTGTTCAGCTTGCCGGTTTCGCTTCAAACAGAACAGCTCTTCTCTTGTCTCTAGTTACCGCAGGACTTAATGCATTTGGTTCTATAATTAGCATTTACTTCATTGATAGAATCGGAAGGAAAAAGCTTTTGATCATTAGCCTTTTCGGAGTCATTATCTCGCTAGGAATACTAACCGGTGTTTTTTATGAAGCGGCTACTCACGCTCCTGCGATTAGCTCACTCGAGACACAAAGGTTCAATAATATTAGTTGTCCGGATTATAAGTCAGCTATGAATACCAATGCTTGGGATTGTATGACTTGTTTGAAAGCTTCTTCTCCATCTTGTGGCTATTGTTCCTCTCCCATTGGAAAGGAACATCCCGGGGCATGTTGGATCTCTGATGATTCGGTTAAGGACTTATGTCATAACGAAAACCGGCTTTGGTACACGAGAGGATGTCCTAGCAATTTTGGTTGGTTTGCTCTTCTTGGATTGGGACTTTATATCATCTTCTTCTCTCCTGGAATGGGGACTGTTCCATGGATAGTTAACTCAGAGATTTATCCATTGAGATTCAGAGGAATATGTGGAGGAATAGCTGCAACTGCAAATTGGATATCAAATTTGATTGTGGCTCAATCTTTTTTGTCATTGACCGAAGCTATTGGGACTTCTTGGACTTTTCTCATCTTTGGAGTGATCTCAGTCATTGCTCTTCTCTTTGTTATGGTTTGTGTTCCGGAGACAAAAGGAATGCCAATGGAGGAGATTGAGAAGATGCTTGAACGAAGATCGATGGAGTTTAAGTTTTGGAAGAAAAAATCAAAACTTGTTGAGAAACAAAACCAGAGTGCATGAGAGAAACTCTTAAAGGAAGCATAATCAATGAGAAAGCACATGAGACTTGTAACTTGGTATTGAAACTTAATAGTGACAAAGTGATCTATTTTAAGAACCAGTAAAAAAGTGTTGTTATGAATCTACTTATTGG

SEQ ID NO: 1691 - DNA, 978 bp, Arabidopsis thaliana
  misc_feature (1)..(978): Ceres cDNA ID no. 12669876
  misc_feature (1)..(978): Also known as  Ceres CDNA ID no. 12668124
atggaagaaagtaaaaggaatttattagatgaagaagcgaaagcttctttagacatatggagatatgtttttgggtttgcagatattgcagctgcaaagtgtgccattgatctcaaaataccagaagccattgaaaaccatccttcgtcacagcccgtgacactatccgaactctcctctgccgtctctgcttctccttcacatctccgccgtataatgcggtttcttgtgcaccaaggactcttcaaagaagtccccacaaaagatggtttagccactggctacactaacacgccactctctcgccgtatgatgatcacaaaactgcatggtaaggacttgtgggcgttcgcacaggataatctgtgccacagccagctgatcaacgaggccatggcttgtgatgcaaggcgcgtggtgccacgtgtagctggagcttgtcaaggcttgtttgacggcgtggctacggtggttgacgtaggaggaggtaccggagagacgatgggaatacttgtaaaggagtttccttggatcaaaggatttaactttgaccttcctcatgttattgaagttgctcaagtcttggacggtgttgagaatgttgagggcgatatgtttgattctattccggcaagcgacgctgttatcatcaagtgggtgttacacgattggggagacaaagattgcataaagatattgaagaattgcaaagaagctgttctaccaaatatcggcaaagtgttgatagtggagtgtgttatcggagagaagaaaaacacgatgatagcggaagaaagagatgacaagttagagcacgtgagattgcagcttgacatggtgatgatggttcacacaagcacaggcaaagaacgaactttgaaagaatgggactttgttcttacagaagctggctttgctcgatatgaggttagagactttgatgatgttcagtctcttatcatcgcatatcgatcttaa

SEQ ID NO: 1692 - protein, 978 aa, Arabidopsis thaliana
ATGGAAGAAAGTAAAAGGAATTTATTAGATGAAGAAGCGAAAGCTTCTTTAGACATATGGAGATATGTTTTTGGGTTTGCAGATATTGCAGCTGCAAAGTGTGCCATTGATCTCAAAATACCAGAAGCCATTGAAAACCATCCTTCGTCACAGCCCGTGACACTATCCGAACTCTCCTCTGCCGTCTCTGCTTCTCCTTCACATCTCCGCCGTATAATGCGGTTTCTTGTGCACCAAGGACTCTTCAAAGAAGTCCCCACAAAAGATGGTTTAGCCACTGGCTACACTAACACGCCACTCTCTCGCCGTATGATGATCACAAAACTGCATGGTAAGGACTTGTGGGCGTTCGCACAGGATAATCTGTGCCACAGCCAGCTGATCAACGAGGCCATGGCTTGTGATGCAAGGCGCGTGGTGCCACGTGTAGCTGGAGCTTGTCAAGGCTTGTTTGACGGCGTGGCTACGGTGGTTGACGTAGGAGGAGGTACCGGAGAGACGATGGGAATACTTGTAAAGGAGTTTCCTTGGATCAAAGGATTTAACTTTGACCTTCCTCATGTTATTGAAGTTGCTCAAGTCTTGGACGGTGTTGAGAATGTTGAGGGCGATATGTTTGATTCTATTCCGGCAAGCGACGCTGTTATCATCAAGTGGGTGTTACACGATTGGGGAGACAAAGATTGCATAAAGATATTGAAGAATTGCAAAGAAGCTGTTCTACCAAATATCGGCAAAGTGTTGATAGTGGAGTGTGTTATCGGAGAGAAGAAAAACACGATGATAGCGGAAGAAAGAGATGACAAGTTAGAGCACGTGAGATTGCAGCTTGACATGGTGATGATGGTTCACACAAGCACAGGCAAAGAACGAACTTTGAAAGAATGGGACTTTGTTCTTACAGAAGCTGGCTTTGCTCGATATGAGGTTAGAGACTTTGATGATGTTCAGTCTCTTATCATCGCATATCGATCTTAA

SEQ ID NO: 1693 - DNA, 855 bp, Arabidopsis thaliana
  misc_feature (1)..(855): Ceres cDNA ID no. 12669949
  misc_feature (1)..(855): Also known as  Ceres CDNA ID no. 12668124
atgtcgaatatgctcgtcaagaatcaactaagatctataagcttaccttcaagctcgcatccaagcacgaccggtatcgaggaatctcttaacaaggtcaaaacgattaacaccatgacgggttcgtccgaatcagtcttgatgggcttggagggtttggaggagctctacaattgtacggaagattttctgaaaatgggctcaacgcaacgggttatgtcatcatctgatggatccgagtttatggaggagatgcttgacggttcgttgaggctaatggatatatgcagtgtctcgagggatctcatggtggagactcaagagcatgttcgtggtgttcaatcatgtgtcaggagaaagaaagtagtcggaggagaagaccaactcgatgtcgccgtcgcggggtatgtcggatttagaaagaacatgagaaaagaagctaagaggcttcttggatctttgaagaacattgatggaggtttaagttcatcatcatcagtaaataatggtgagcaagaagaacatcttgtggtggttgtagacgccatgagacaagtagtttccgttagcgtcgcggtgttgaggtcgtttttggaattcttatccggacgacgacaaagtaacattaagagcaagctggcttcggtactaaagaaaaagaaggttcaccatgttgaggagaccaagaacgagttggagaatttggatctcgagatattctgttctcgtaatgatctacaaaagaagcttgaggaagttgagatgagcattgatggattcgagaagaaactagaaggactatttcgaaggttgataagaacacgagcctcgcttctcaacataatatctcattag

SEQ ID NO: 1694 - protein, 855 aa, Arabidopsis thaliana
ATGTCGAATATGCTCGTCAAGAATCAACTAAGATCTATAAGCTTACCTTCAAGCTCGCATCCAAGCACGACCGGTATCGAGGAATCTCTTAACAAGGTCAAAACGATTAACACCATGACGGGTTCGTCCGAATCAGTCTTGATGGGCTTGGAGGGTTTGGAGGAGCTCTACAATTGTACGGAAGATTTTCTGAAAATGGGCTCAACGCAACGGGTTATGTCATCATCTGATGGATCCGAGTTTATGGAGGAGATGCTTGACGGTTCGTTGAGGCTAATGGATATATGCAGTGTCTCGAGGGATCTCATGGTGGAGACTCAAGAGCATGTTCGTGGTGTTCAATCATGTGTCAGGAGAAAGAAAGTAGTCGGAGGAGAAGACCAACTCGATGTCGCCGTCGCGGGGTATGTCGGATTTAGAAAGAACATGAGAAAAGAAGCTAAGAGGCTTCTTGGATCTTTGAAGAACATTGATGGAGGTTTAAGTTCATCATCATCAGTAAATAATGGTGAGCAAGAAGAACATCTTGTGGTGGTTGTAGACGCCATGAGACAAGTAGTTTCCGTTAGCGTCGCGGTGTTGAGGTCGTTTTTGGAATTCTTATCCGGACGACGACAAAGTAACATTAAGAGCAAGCTGGCTTCGGTACTAAAGAAAAAGAAGGTTCACCATGTTGAGGAGACCAAGAACGAGTTGGAGAATTTGGATCTCGAGATATTCTGTTCTCGTAATGATCTACAAAAGAAGCTTGAGGAAGTTGAGATGAGCATTGATGGATTCGAGAAGAAACTAGAAGGACTATTTCGAAGGTTGATAAGAACACGAGCCTCGCTTCTCAACATAATATCTCATTAG

SEQ ID NO: 1695 - DNA, 1212 bp, Arabidopsis thaliana
  misc_feature (1)..(1212): Ceres cDNA ID no. 12670076
  misc_feature (1)..(1212): Ceres CLONE  ID no. 1368341
  misc_feature (1)..(1212): Also known as  Ceres CDNA ID no. 23481756
atcactcaccacaaagtcttctcatttcctcatcttcttgttgaaagtaatggcaagactcacgagctttctccttcttctttctctcatctgctttgtccctctctgtctctgcgacaagagctatggaggcaaacttttcccgggttattacgcccattcatgcccacaagtcaatgagatcgtgagatcagttgtagctaaagctgttgctagagagacacgtatggctgcttccttgttgagacttcatttccacgactgtttcgttcagggttgtgatggctctttgcttctagacagcagtggaagggtagcgactgagaaaaactcaaaccctaacagcaaatcagctcgtgggtttgacgtagttgaccaaatcaaagctgaactggagaaacaatgccctggaactgtttcttgcgctgatgttcttaccctagccgctagagactcctctgttcttaccggtggaccaagttgggttgttccattgggaagaagagattcaagaagtgcaagcttgagtcaatcgaacaacaacatccctgcaccaaacaacactttccagaccattctatctaagtttaaccgtcaaggacttgatatcactgaccttgtcgctctctccggtagtcacacaatcggattctcgagatgcacgagtttcagacagaggttgtacaaccagtccggaaacggcagtccagacatgacattggaacaatccttcgctgctaacttgcgccaacggtgtccaaaatccggtggggaccagattctctcggtgctagacatcatcagcgccgcgagcttcgacaacagctacttcaagaacttgatagagaacaaggggttgttgaactcggaccaagttctgttcagcagtaacgagaaatcgagagagcttgtgaagaagtatgcagaagatcaaggagagttttttgagcaatttgcggaatcgatgatcaagatgggaaatatctctcccttgacaggttctagtggcgaaatcaggaagaattgcaggaagattaactcttgattgaaacaagaaaactcttcttatatcttgtggaacaaatgtgagacatttacttttactttggagtgtgttttgtttgtttttttcaattctgtcatttggaagttttatttcgtgttatttgcgttgtgttaagacataagtttgaaatttataaaacttgtacg

SEQ ID NO: 1696 - protein, 1212 aa, Arabidopsis thaliana
  misc_feature: PFam Name: peroxidase; PFam Description: Peroxidase
  misc_feature: GI Number: 21537275; NR Description: putative peroxidase
  misc_feature: GI Number: 21436133; NR Description: putative peroxidase [Arabidopsis thaliana] >gi|18377686|gb|AAL66993.1| putative peroxidase [Arabidopsis thaliana] >gi|4006918|emb|CAB16848.1| peroxidase like protein [Arabidopsis thaliana]
  misc_feature: GI Number: 4874288; NR Description: putative peroxidase [Arabidopsis thaliana] >gi|27311903|gb|AAO00917.1| putative peroxidase [Arabidopsis thaliana] >gi|19698903|gb|AAL91187.1| putative peroxidase [Arabidopsis thaliana]
  misc_feature: GI Number: 30725302; NR Description: At5g66390 [Arabidopsis thaliana] >gi|10177520|dbj|BAB10915.1| peroxidase [Arabidopsis thaliana] >gi|26397792|sp|Q9FJZ9|PE72_ARATH Peroxidase 72 precursor
ATCACTCACCACAAAGTCTTCTCATTTCCTCATCTTCTTGTTGAAAGTAATGGCAAGACTCACGAGCTTTCTCCTTCTTCTTTCTCTCATCTGCTTTGTCCCTCTCTGTCTCTGCGACAAGAGCTATGGAGGCAAACTTTTCCCGGGTTATTACGCCCATTCATGCCCACAAGTCAATGAGATCGTGAGATCAGTTGTAGCTAAAGCTGTTGCTAGAGAGACACGTATGGCTGCTTCCTTGTTGAGACTTCATTTCCACGACTGTTTCGTTCAGGGTTGTGATGGCTCTTTGCTTCTAGACAGCAGTGGAAGGGTAGCGACTGAGAAAAACTCAAACCCTAACAGCAAATCAGCTCGTGGGTTTGACGTAGTTGACCAAATCAAAGCTGAACTGGAGAAACAATGCCCTGGAACTGTTTCTTGCGCTGATGTTCTTACCCTAGCCGCTAGAGACTCCTCTGTTCTTACCGGTGGACCAAGTTGGGTTGTTCCATTGGGAAGAAGAGATTCAAGAAGTGCAAGCTTGAGTCAATCGAACAACAACATCCCTGCACCAAACAACACTTTCCAGACCATTCTATCTAAGTTTAACCGTCAAGGACTTGATATCACTGACCTTGTCGCTCTCTCCGGTAGTCACACAATCGGATTCTCGAGATGCACGAGTTTCAGACAGAGGTTGTACAACCAGTCCGGAAACGGCAGTCCAGACATGACATTGGAACAATCCTTCGCTGCTAACTTGCGCCAACGGTGTCCAAAATCCGGTGGGGACCAGATTCTCTCGGTGCTAGACATCATCAGCGCCGCGAGCTTCGACAACAGCTACTTCAAGAACTTGATAGAGAACAAGGGGTTGTTGAACTCGGACCAAGTTCTGTTCAGCAGTAACGAGAAATCGAGAGAGCTTGTGAAGAAGTATGCAGAAGATCAAGGAGAGTTTTTTGAGCAATTTGCGGAATCGATGATCAAGATGGGAAATATCTCTCCCTTGACAGGTTCTAGTGGCGAAATCAGGAAGAATTGCAGGAAGATTAACTCTTGATTGAAACAAGAAAACTCTTCTTATATCTTGTGGAACAAATGTGAGACATTTACTTTTACTTTGGAGTGTGTTTTGTTTGTTTTTTTCAATTCTGTCATTTGGAAGTTTTATTTCGTGTTATTTGCGTTGTGTTAAGACATAAGTTTGAAATTTATAAAACTTGTACG

SEQ ID NO: 1697 - DNA, 2380 bp, Arabidopsis thaliana
  misc_feature (1)..(2380): Ceres cDNA ID no. 12670719
  misc_feature (1)..(2380): Also known as  Ceres CDNA ID no. 23481756
acacgccatgagaactcttcttcaatggcacttaccatctcaatctcttgtttctcctcttactttgtgtctctccttcttcttgttctatcttccttctcctttgtttgcttctccctctccaccgtctccatctcccacatctctaatcagactcttgtatgtgctctcaacaaccactcttatcttcaatgttccagtttccctttaaattcgattccattttctttaaccggtaaccttcgaaatcgaaggttttcgggggttgtttcagggaatgggtttgtgtgcggattgatatcgcggctggattccaacacttccacacttctttgttggagattctctgttgatggaactaatatgttgcacaaaagaatctaccacggtcctgagctcgaagagctagaagccgggaatttccgcatttgtggagttgaaagagtctcaaggcgcctccgttgctggcaaccgtactatctgccacggccggataattaccgttccattgccttgggagataattttttctgtgggctatctcagccacctggtatgatcagttgtgaaggtatagccaaagtgccgagtggagaccactacatcgcgatagcggctggatcacgacaagcgtgtgcgatcactgttgacaatgatgtcgagtgttggggacaaacacagtcgctgccacgtgaaaagttcttagcactagcggttggggaagaccgtggttgcggtgttagatggtctaatggaactgtggtgtgttggggcaacaacaacaactttagtttgcctcaaacgcttaaggacattcattttacatcaatatatgctaaagggccaatgttttgcggtgttgccacaagaaattacactctaatttgttgggggaatgagaattttaaatccggtgttttcactccattccaaggcctaatttctcaagtggtaatgccaggaccgtgtagaagagaatgcccttaccgtccattgtcaggatcacagtccttatgcggcaatgagttgatgatttgcgatttgaaaagaaatgatggagagtttcctgatactagggctcaaaactctaagaacaaaacttggagcagaagaaacattgcgtttctagtggtcggatgcgttggaacgttttccttgctccttgtcatcagtttcttgatctttaaaagccactgtcgatgccgtgtccatgactctggacgtcttgatgatactaggacaatagacatacccaagctcgagaagaggctgtgcactctagcaagtttaggtaatcctgggcagctaatggagttctcaattgacgagctagctctagccacggatggtttctctgtccggtttcatcttggtataggcagcttcggctctgtttatcaaggtgttttgtcggatggacgtcatgtcgcaatcaaacgagctgagctaacaaatcctacattgtctgggacaacgatgagacaccgacgagcagataaggattcagcgttcgtgaacgagctagagtctatgtcgcggcttaaccacaaaaatcttgttcgacttctgggtttctatgaggacacagaagagaggattttggtgtacgagtacatgaaaaatggatctctagccgatcaccttcacaatcctcaatttgaccctctttcgtggcaaacacgcttgatgatcgcgcttgacgctgctcgtgggatccaataccttcatgagtttatcgtgcctccggtgatccaccgtgacataaagtcatcaaacatacttttggacgccacatggacagccaaagtttcagatttcggcctatctcaaatgggtccaacggaagaagatgacgtctcacatctctctttacacgctgccggtacattgggatatatcgacccggagtactacaagtttcaacagctcacaaccaagagcgatgtttacagctttggcgtggtgttgctggagttgctgtctggtcacaaagcgatacacaataacgaagacgaaaaccctagaaacttagtggaatatgttgtaccatacattttgctggatgaggctcatagaatacttgaccagaggattccaccgccgaccccttacgaaatcgaggcggtggctcatgtcggatacttggcagcggagtgtttgatgccgtgtagtcggaaaaggccgtcaatggtggaggtagtcagtaaactagagagtgctttggccgcttgtttgacggctccaaagacggagaccgtatctcgatcaaacacttattagccacgtttagcttaattaaatcttgtggtcaactgtaattgtatttatttttctagggattaggaatttaattaattggtacagaattttaatattttct

SEQ ID NO: 1698 - protein, 2380 aa, Arabidopsis thaliana
  misc_feature: PFam Name: peroxidase; PFam Description: Peroxidase
  misc_feature: GI Number: 21537275; NR Description: putative peroxidase
  misc_feature: GI Number: 21436133; NR Description: putative peroxidase [Arabidopsis thaliana] >gi|18377686|gb|AAL66993.1| putative peroxidase [Arabidopsis thaliana] >gi|4006918|emb|CAB16848.1| peroxidase like protein [Arabidopsis thaliana]
  misc_feature: GI Number: 4874288; NR Description: putative peroxidase [Arabidopsis thaliana] >gi|27311903|gb|AAO00917.1| putative peroxidase [Arabidopsis thaliana] >gi|19698903|gb|AAL91187.1| putative peroxidase [Arabidopsis thaliana]
  misc_feature: GI Number: 30725302; NR Description: At5g66390 [Arabidopsis thaliana] >gi|10177520|dbj|BAB10915.1| peroxidase [Arabidopsis thaliana] >gi|26397792|sp|Q9FJZ9|PE72_ARATH Peroxidase 72 precursor
ACACGCCATGAGAACTCTTCTTCAATGGCACTTACCATCTCAATCTCTTGTTTCTCCTCTTACTTTGTGTCTCTCCTTCTTCTTGTTCTATCTTCCTTCTCCTTTGTTTGCTTCTCCCTCTCCACCGTCTCCATCTCCCACATCTCTAATCAGACTCTTGTATGTGCTCTCAACAACCACTCTTATCTTCAATGTTCCAGTTTCCCTTTAAATTCGATTCCATTTTCTTTAACCGGTAACCTTCGAAATCGAAGGTTTTCGGGGGTTGTTTCAGGGAATGGGTTTGTGTGCGGATTGATATCGCGGCTGGATTCCAACACTTCCACACTTCTTTGTTGGAGATTCTCTGTTGATGGAACTAATATGTTGCACAAAAGAATCTACCACGGTCCTGAGCTCGAAGAGCTAGAAGCCGGGAATTTCCGCATTTGTGGAGTTGAAAGAGTCTCAAGGCGCCTCCGTTGCTGGCAACCGTACTATCTGCCACGGCCGGATAATTACCGTTCCATTGCCTTGGGAGATAATTTTTTCTGTGGGCTATCTCAGCCACCTGGTATGATCAGTTGTGAAGGTATAGCCAAAGTGCCGAGTGGAGACCACTACATCGCGATAGCGGCTGGATCACGACAAGCGTGTGCGATCACTGTTGACAATGATGTCGAGTGTTGGGGACAAACACAGTCGCTGCCACGTGAAAAGTTCTTAGCACTAGCGGTTGGGGAAGACCGTGGTTGCGGTGTTAGATGGTCTAATGGAACTGTGGTGTGTTGGGGCAACAACAACAACTTTAGTTTGCCTCAAACGCTTAAGGACATTCATTTTACATCAATATATGCTAAAGGGCCAATGTTTTGCGGTGTTGCCACAAGAAATTACACTCTAATTTGTTGGGGGAATGAGAATTTTAAATCCGGTGTTTTCACTCCATTCCAAGGCCTAATTTCTCAAGTGGTAATGCCAGGACCGTGTAGAAGAGAATGCCCTTACCGTCCATTGTCAGGATCACAGTCCTTATGCGGCAATGAGTTGATGATTTGCGATTTGAAAAGAAATGATGGAGAGTTTCCTGATACTAGGGCTCAAAACTCTAAGAACAAAACTTGGAGCAGAAGAAACATTGCGTTTCTAGTGGTCGGATGCGTTGGAACGTTTTCCTTGCTCCTTGTCATCAGTTTCTTGATCTTTAAAAGCCACTGTCGATGCCGTGTCCATGACTCTGGACGTCTTGATGATACTAGGACAATAGACATACCCAAGCTCGAGAAGAGGCTGTGCACTCTAGCAAGTTTAGGTAATCCTGGGCAGCTAATGGAGTTCTCAATTGACGAGCTAGCTCTAGCCACGGATGGTTTCTCTGTCCGGTTTCATCTTGGTATAGGCAGCTTCGGCTCTGTTTATCAAGGTGTTTTGTCGGATGGACGTCATGTCGCAATCAAACGAGCTGAGCTAACAAATCCTACATTGTCTGGGACAACGATGAGACACCGACGAGCAGATAAGGATTCAGCGTTCGTGAACGAGCTAGAGTCTATGTCGCGGCTTAACCACAAAAATCTTGTTCGACTTCTGGGTTTCTATGAGGACACAGAAGAGAGGATTTTGGTGTACGAGTACATGAAAAATGGATCTCTAGCCGATCACCTTCACAATCCTCAATTTGACCCTCTTTCGTGGCAAACACGCTTGATGATCGCGCTTGACGCTGCTCGTGGGATCCAATACCTTCATGAGTTTATCGTGCCTCCGGTGATCCACCGTGACATAAAGTCATCAAACATACTTTTGGACGCCACATGGACAGCCAAAGTTTCAGATTTCGGCCTATCTCAAATGGGTCCAACGGAAGAAGATGACGTCTCACATCTCTCTTTACACGCTGCCGGTACATTGGGATATATCGACCCGGAGTACTACAAGTTTCAACAGCTCACAACCAAGAGCGATGTTTACAGCTTTGGCGTGGTGTTGCTGGAGTTGCTGTCTGGTCACAAAGCGATACACAATAACGAAGACGAAAACCCTAGAAACTTAGTGGAATATGTTGTACCATACATTTTGCTGGATGAGGCTCATAGAATACTTGACCAGAGGATTCCACCGCCGACCCCTTACGAAATCGAGGCGGTGGCTCATGTCGGATACTTGGCAGCGGAGTGTTTGATGCCGTGTAGTCGGAAAAGGCCGTCAATGGTGGAGGTAGTCAGTAAACTAGAGAGTGCTTTGGCCGCTTGTTTGACGGCTCCAAAGACGGAGACCGTATCTCGATCAAACACTTATTAGCCACGTTTAGCTTAATTAAATCTTGTGGTCAACTGTAATTGTATTTATTTTTCTAGGGATTAGGAATTTAATTAATTGGTACAGAATTTTAATATTTTCT

SEQ ID NO: 1699 - DNA, 945 bp, Arabidopsis thaliana
  misc_feature (1)..(945): Ceres cDNA ID no. 12671144
  misc_feature (1)..(945): Also known as  Ceres CDNA ID no. 23481756
atggctgcgatcactgagatggccactgattcaaatgacgtaatcaacgatggtggaactggagacggaattgagaagagcacggattctaaaccggaaatcgaatcggatgacctcaaacccaaatccaaaccggaatatgatcaaatgaagaagcttgttgccatgttcaagaaactcaatcctgaagctaaggagtttttcccttcttacaagaggaatactaatcagtctgacgattttgtgattgctataaagccatctggtgaagacaacaaaaaggttgccattaaccggaggagaagaaacaactataaccaagggaggagagtgaggttacctggaagagcttctaaggctcaaagagaagatagtattagaagaacagtgtatgtctctgacattgatcagagtgtgactgaggaaggccttgctggcttgttcagcagctgtggacaagttgttgattgtcgaatctgcggggatccgaattcagttcttcgctttgcgtttgttgagttttctgatgaccaaggtgcacgatcggctttaagtcttggtggaacaatgatcggatattacccagttagagtcttaccttcaaaaactgctattcttccagtgaatcccacatttctccccaggtcagaagatgaaagagagatgtgttcaaggaccatctactgcacaaatgttgacaagaatgccactgaagatgatgtcaataccttctttcagtctgcctgcggtgaggttactcgcttaaggcttcttggtgaccaagtgcattctactcgcatagcttttgttgaatttgccatggcagagagtgcagttgcagcgctaaactgcagcggaatagtcttaggatctcagccgataagggtaagcccttcaaagacaccagtgagatcgcgaatcactcgatcaccatcgccaaactag

SEQ ID NO: 1700 - protein, 945 aa, Arabidopsis thaliana
  misc_feature: PFam Name: peroxidase; PFam Description: Peroxidase
  misc_feature: GI Number: 21537275; NR Description: putative peroxidase
  misc_feature: GI Number: 21436133; NR Description: putative peroxidase [Arabidopsis thaliana] >gi|18377686|gb|AAL66993.1| putative peroxidase [Arabidopsis thaliana] >gi|4006918|emb|CAB16848.1| peroxidase like protein [Arabidopsis thaliana]
  misc_feature: GI Number: 4874288; NR Description: putative peroxidase [Arabidopsis thaliana] >gi|27311903|gb|AAO00917.1| putative peroxidase [Arabidopsis thaliana] >gi|19698903|gb|AAL91187.1| putative peroxidase [Arabidopsis thaliana]
  misc_feature: GI Number: 30725302; NR Description: At5g66390 [Arabidopsis thaliana] >gi|10177520|dbj|BAB10915.1| peroxidase [Arabidopsis thaliana] >gi|26397792|sp|Q9FJZ9|PE72_ARATH Peroxidase 72 precursor
ATGGCTGCGATCACTGAGATGGCCACTGATTCAAATGACGTAATCAACGATGGTGGAACTGGAGACGGAATTGAGAAGAGCACGGATTCTAAACCGGAAATCGAATCGGATGACCTCAAACCCAAATCCAAACCGGAATATGATCAAATGAAGAAGCTTGTTGCCATGTTCAAGAAACTCAATCCTGAAGCTAAGGAGTTTTTCCCTTCTTACAAGAGGAATACTAATCAGTCTGACGATTTTGTGATTGCTATAAAGCCATCTGGTGAAGACAACAAAAAGGTTGCCATTAACCGGAGGAGAAGAAACAACTATAACCAAGGGAGGAGAGTGAGGTTACCTGGAAGAGCTTCTAAGGCTCAAAGAGAAGATAGTATTAGAAGAACAGTGTATGTCTCTGACATTGATCAGAGTGTGACTGAGGAAGGCCTTGCTGGCTTGTTCAGCAGCTGTGGACAAGTTGTTGATTGTCGAATCTGCGGGGATCCGAATTCAGTTCTTCGCTTTGCGTTTGTTGAGTTTTCTGATGACCAAGGTGCACGATCGGCTTTAAGTCTTGGTGGAACAATGATCGGATATTACCCAGTTAGAGTCTTACCTTCAAAAACTGCTATTCTTCCAGTGAATCCCACATTTCTCCCCAGGTCAGAAGATGAAAGAGAGATGTGTTCAAGGACCATCTACTGCACAAATGTTGACAAGAATGCCACTGAAGATGATGTCAATACCTTCTTTCAGTCTGCCTGCGGTGAGGTTACTCGCTTAAGGCTTCTTGGTGACCAAGTGCATTCTACTCGCATAGCTTTTGTTGAATTTGCCATGGCAGAGAGTGCAGTTGCAGCGCTAAACTGCAGCGGAATAGTCTTAGGATCTCAGCCGATAAGGGTAAGCCCTTCAAAGACACCAGTGAGATCGCGAATCACTCGATCACCATCGCCAAACTAG

SEQ ID NO: 1701 - DNA, 1915 bp, Arabidopsis thaliana
  misc_feature (1)..(1915): Ceres cDNA ID no. 12671165
  misc_feature (1)..(1915): Also known as  Ceres CDNA ID no. 23481756
caaaagaaacagaacaacaatggcgaaattaaatcgttccaacattggtctctcactgttactatctatgttcctcgcaaactttatcaccgatcttgaagcttcttctcatcaagatctcaaccaaccgtaccggaccggttatcactttcaacctctcaaaaattggatgaacgatcctaatggaccaatgatatacaaaggaatataccatcttttttaccaatataacccatacggtgccgtttgggatgtgagaatcgtgtggggacactccacgtcagttgacttagtcaactggatttcacaacctccagcttttaatccatctcagccgtcagatatcaacggttgttggtcaggctccgtcacgattctaccaaacggcaaacctgtgatcctctacaccggcattgaccaaaacaaaggtcaagtccaaaacgtcgccgttccggttaacatctctgatccttatctccgagaatggtcaaaaccgccgcaaaatcctctaatgacaactaacgcggttaacggaattaacccggaccggtttcgtgatccgaccaccgcgtggcttggacgtgacggagaatggcgagtaatcgtcggaagctcgacggacgatcgacgaggattagcgattctttacaaaagcagagatttcttcaactggacgcaatcaatgaagcctttacattacgaagacttaaccggaatgtgggaatgtcctgattttttcccggtttcgataaccggatcggacggtgtagaaacgtcgtcggttggtgagaatgggattaagcatgtgcttaaagtgagtttgattgagacattgcatgattattacacgattgggagttatgatcgtgagaaagatgtttacgtaccggatcttgggtttgtgcaaaacgaatcagctccgaggttagattacgggaaatattacgcgtcgaaaacgttttacgatgatgttaaaaaacgaaggatcttgtggggttgggttaatgaatcgtctccagctaaagatgatattgagaagggttggtctggtcttcagtcatttccgaggaaaatatggctcgatgaatcaggaaaggaattgctacagtggccgattgaagagattgagacattgcgtgggcaacaagtcaactggcaaaagaaagttctcaaagcaggatctactctccaagttcatggtgtcactgctgcgcaggcagatgttgaggtatcgttcaaggtgaaggaattggaaaaggcggatgtgattgaaccgagttggaccgatccacaaaagatatgtagtcagggagatttatcggttatgtcgggtttaggaccatttggtttgatggttttggcatccaatgacatggaagagtacacgtccgtttacttcagaattttcaagtcaaatgacgatactaacaagaagactaaatacgtggtgttgatgtgcagtgaccaaagcagatcatcgttaaatgatgaaaatgataaatcaacctttggtgcttttgttgcgatagacccttctcaccaaacaatttctcttaggactttgattgatcactcgatagtggagagttatggtggaggaggcagaacatgtataacctcaagagtgtatccaaaattggcaatcggagaaaatgcaaatctgtttgtcttcaacaaaggcactcaaagtgttgatatcttgaccctaagtgcttggagtttaaagtctgctcaaatcaatggcgacttaatgtcaccatttattgagcgtgaagagtcacgctcacctaatcatcagttttgaatgaaaaatattttacattgtacgggtaaaacgaaatatataagagattattacatattaagagatattaacattcttattttaccattcacttccaaatttgaagatttt

SEQ ID NO: 1702 - protein, 1915 aa, Arabidopsis thaliana
  misc_feature: PFam Name: peroxidase; PFam Description: Peroxidase
  misc_feature: GI Number: 21537275; NR Description: putative peroxidase
  misc_feature: GI Number: 21436133; NR Description: putative peroxidase [Arabidopsis thaliana] >gi|18377686|gb|AAL66993.1| putative peroxidase [Arabidopsis thaliana] >gi|4006918|emb|CAB16848.1| peroxidase like protein [Arabidopsis thaliana]
  misc_feature: GI Number: 4874288; NR Description: putative peroxidase [Arabidopsis thaliana] >gi|27311903|gb|AAO00917.1| putative peroxidase [Arabidopsis thaliana] >gi|19698903|gb|AAL91187.1| putative peroxidase [Arabidopsis thaliana]
  misc_feature: GI Number: 30725302; NR Description: At5g66390 [Arabidopsis thaliana] >gi|10177520|dbj|BAB10915.1| peroxidase [Arabidopsis thaliana] >gi|26397792|sp|Q9FJZ9|PE72_ARATH Peroxidase 72 precursor
CAAAAGAAACAGAACAACAATGGCGAAATTAAATCGTTCCAACATTGGTCTCTCACTGTTACTATCTATGTTCCTCGCAAACTTTATCACCGATCTTGAAGCTTCTTCTCATCAAGATCTCAACCAACCGTACCGGACCGGTTATCACTTTCAACCTCTCAAAAATTGGATGAACGATCCTAATGGACCAATGATATACAAAGGAATATACCATCTTTTTTACCAATATAACCCATACGGTGCCGTTTGGGATGTGAGAATCGTGTGGGGACACTCCACGTCAGTTGACTTAGTCAACTGGATTTCACAACCTCCAGCTTTTAATCCATCTCAGCCGTCAGATATCAACGGTTGTTGGTCAGGCTCCGTCACGATTCTACCAAACGGCAAACCTGTGATCCTCTACACCGGCATTGACCAAAACAAAGGTCAAGTCCAAAACGTCGCCGTTCCGGTTAACATCTCTGATCCTTATCTCCGAGAATGGTCAAAACCGCCGCAAAATCCTCTAATGACAACTAACGCGGTTAACGGAATTAACCCGGACCGGTTTCGTGATCCGACCACCGCGTGGCTTGGACGTGACGGAGAATGGCGAGTAATCGTCGGAAGCTCGACGGACGATCGACGAGGATTAGCGATTCTTTACAAAAGCAGAGATTTCTTCAACTGGACGCAATCAATGAAGCCTTTACATTACGAAGACTTAACCGGAATGTGGGAATGTCCTGATTTTTTCCCGGTTTCGATAACCGGATCGGACGGTGTAGAAACGTCGTCGGTTGGTGAGAATGGGATTAAGCATGTGCTTAAAGTGAGTTTGATTGAGACATTGCATGATTATTACACGATTGGGAGTTATGATCGTGAGAAAGATGTTTACGTACCGGATCTTGGGTTTGTGCAAAACGAATCAGCTCCGAGGTTAGATTACGGGAAATATTACGCGTCGAAAACGTTTTACGATGATGTTAAAAAACGAAGGATCTTGTGGGGTTGGGTTAATGAATCGTCTCCAGCTAAAGATGATATTGAGAAGGGTTGGTCTGGTCTTCAGTCATTTCCGAGGAAAATATGGCTCGATGAATCAGGAAAGGAATTGCTACAGTGGCCGATTGAAGAGATTGAGACATTGCGTGGGCAACAAGTCAACTGGCAAAAGAAAGTTCTCAAAGCAGGATCTACTCTCCAAGTTCATGGTGTCACTGCTGCGCAGGCAGATGTTGAGGTATCGTTCAAGGTGAAGGAATTGGAAAAGGCGGATGTGATTGAACCGAGTTGGACCGATCCACAAAAGATATGTAGTCAGGGAGATTTATCGGTTATGTCGGGTTTAGGACCATTTGGTTTGATGGTTTTGGCATCCAATGACATGGAAGAGTACACGTCCGTTTACTTCAGAATTTTCAAGTCAAATGACGATACTAACAAGAAGACTAAATACGTGGTGTTGATGTGCAGTGACCAAAGCAGATCATCGTTAAATGATGAAAATGATAAATCAACCTTTGGTGCTTTTGTTGCGATAGACCCTTCTCACCAAACAATTTCTCTTAGGACTTTGATTGATCACTCGATAGTGGAGAGTTATGGTGGAGGAGGCAGAACATGTATAACCTCAAGAGTGTATCCAAAATTGGCAATCGGAGAAAATGCAAATCTGTTTGTCTTCAACAAAGGCACTCAAAGTGTTGATATCTTGACCCTAAGTGCTTGGAGTTTAAAGTCTGCTCAAATCAATGGCGACTTAATGTCACCATTTATTGAGCGTGAAGAGTCACGCTCACCTAATCATCAGTTTTGAATGAAAAATATTTTACATTGTACGGGTAAAACGAAATATATAAGAGATTATTACATATTAAGAGATATTAACATTCTTATTTTACCATTCACTTCCAAATTTGAAGATTTT

SEQ ID NO: 1703 - DNA, 1035 bp, Arabidopsis thaliana
  misc_feature (1)..(1035): Ceres cDNA ID no. 12671497
  misc_feature (1)..(1035): Also known as  Ceres CDNA ID no. 23481756
atgaaatggttgctcgtcgccgtattgacctctcttacgatcttctccgccttaacacagtcccatctcctccatggatctccggtcaattctctctgcgctgatctcattcatcccgctaattactcctgcactgaacacagtattcaaacaaaggatggttacatattagctcttcaacgtgtagcttctcttggtccaagacttcaatctggtccacctgttttgcttcagcacggtctctttatggctggagatgtgtggttcttgaattcaccaaaagagtcactaggtttcattcttgctgatcatgggtttgatgtttgggttggaaatgttcgtggtacacgttacagttatggacatgtaactttgtctgacactgataaggagttttgggactggagttggcaagatttggcaatgtatgacttggcagaaatgattcagtatctgtattcaatttcaaactccaaaattttccttgttggacattctcaggggactatcatgtcttttgctgctcttactcagccgcatgttgcggaaatggttgaagcagctgcgttgctttgtccaatatcatatttggatcatgtcacagctcctcttgttgaaagaatggtttttatgcatctcgatcagatagaatactatctagattacgagcctcacccatcatctgtcaagaatattcgacatcttttccaaatgattcggaagggaacctttgcacaatacgactacgggtatttcaaaaatctacggacttatgggctgtcgaaacctccagaattcatactaagccacatcccggcatcattaccaatgtggatggggtatggtggaactgatggtttagcagatgtgacagatgtggaacatactctcgcggaactaccttccagtccagagttactatatcttgaggattatggtcacattgactttgtgcttggctcaagtgctaaagaagatgtctataagcacatgattcaatttttcagagcaaaggttaagtctagtagttggtaa

SEQ ID NO: 1704 - protein, 1035 aa, Arabidopsis thaliana
  misc_feature: PFam Name: peroxidase; PFam Description: Peroxidase
  misc_feature: GI Number: 21537275; NR Description: putative peroxidase
  misc_feature: GI Number: 21436133; NR Description: putative peroxidase [Arabidopsis thaliana] >gi|18377686|gb|AAL66993.1| putative peroxidase [Arabidopsis thaliana] >gi|4006918|emb|CAB16848.1| peroxidase like protein [Arabidopsis thaliana]
  misc_feature: GI Number: 4874288; NR Description: putative peroxidase [Arabidopsis thaliana] >gi|27311903|gb|AAO00917.1| putative peroxidase [Arabidopsis thaliana] >gi|19698903|gb|AAL91187.1| putative peroxidase [Arabidopsis thaliana]
  misc_feature: GI Number: 30725302; NR Description: At5g66390 [Arabidopsis thaliana] >gi|10177520|dbj|BAB10915.1| peroxidase [Arabidopsis thaliana] >gi|26397792|sp|Q9FJZ9|PE72_ARATH Peroxidase 72 precursor
ATGAAATGGTTGCTCGTCGCCGTATTGACCTCTCTTACGATCTTCTCCGCCTTAACACAGTCCCATCTCCTCCATGGATCTCCGGTCAATTCTCTCTGCGCTGATCTCATTCATCCCGCTAATTACTCCTGCACTGAACACAGTATTCAAACAAAGGATGGTTACATATTAGCTCTTCAACGTGTAGCTTCTCTTGGTCCAAGACTTCAATCTGGTCCACCTGTTTTGCTTCAGCACGGTCTCTTTATGGCTGGAGATGTGTGGTTCTTGAATTCACCAAAAGAGTCACTAGGTTTCATTCTTGCTGATCATGGGTTTGATGTTTGGGTTGGAAATGTTCGTGGTACACGTTACAGTTATGGACATGTAACTTTGTCTGACACTGATAAGGAGTTTTGGGACTGGAGTTGGCAAGATTTGGCAATGTATGACTTGGCAGAAATGATTCAGTATCTGTATTCAATTTCAAACTCCAAAATTTTCCTTGTTGGACATTCTCAGGGGACTATCATGTCTTTTGCTGCTCTTACTCAGCCGCATGTTGCGGAAATGGTTGAAGCAGCTGCGTTGCTTTGTCCAATATCATATTTGGATCATGTCACAGCTCCTCTTGTTGAAAGAATGGTTTTTATGCATCTCGATCAGATAGAATACTATCTAGATTACGAGCCTCACCCATCATCTGTCAAGAATATTCGACATCTTTTCCAAATGATTCGGAAGGGAACCTTTGCACAATACGACTACGGGTATTTCAAAAATCTACGGACTTATGGGCTGTCGAAACCTCCAGAATTCATACTAAGCCACATCCCGGCATCATTACCAATGTGGATGGGGTATGGTGGAACTGATGGTTTAGCAGATGTGACAGATGTGGAACATACTCTCGCGGAACTACCTTCCAGTCCAGAGTTACTATATCTTGAGGATTATGGTCACATTGACTTTGTGCTTGGCTCAAGTGCTAAAGAAGATGTCTATAAGCACATGATTCAATTTTTCAGAGCAAAGGTTAAGTCTAGTAGTTGGTAA

SEQ ID NO: 1705 - DNA, 1272 bp, Arabidopsis thaliana
  misc_feature (1)..(1272): Ceres cDNA ID no. 12671540
  misc_feature (1)..(1272): Also known as  Ceres CDNA ID no. 23481756
atgaacaagattttaccggaaatgaaatcaactcagaatttgatctcttcttcaccaccaccaccattgatacctctcaaatcaaacacaagcttgtcaaatttaaacagcaaaatcactccaaatattcttctaataatcataatcctctcgatcatcttcttcatctctggtcttctccatattcttgtcaaattcctcctcacaccatcaagagaaagcagagaagattacttcgacaatgttacagctcttcaaggccagcttcaacaactctttaacctccatgattctggcgttgaccaatccttaatcgacacgttacctgtttttcattacaagtccattgtcggtctcaaaatctctccttttgattgtcctgtttgtctctgtgagtttgaaacagaggataaacttagactcttgcctaaatgcagccatgcctttcacgttgagtgtatcgacacgtggcttctctctcactctacttgtcccttgtgtagatctaatctcctctctggtttttcgtctcaccacaatctaagctcctcgtatctacttgttcttgagagtgaacaaagctcgagagatatggttcctgttcttgagtctaactctcaactaggttatgatgtgaacaatgattctgagtcgacccggattaggtcgggtcgtaaatcatgtgacccggatggtgacatggatggtttagatgaaaaggttgttcctttagaagttaagttagggaagtttaggaacatagatcatgttggtgaaggaagtgaccagaagaaaaatagcataagtggtaatagtaaaaatgtggatggaaggaggtgtttgtcaatgggatcatatgagtatattatggatcaagaagctacacttaaggttcatgtttcgaccaagaaactatccggaaaagaccgggtgccgagccacaggaccgttatgtccgaatgcggttttgatccaacagttaagggaattgagaagagtgttgtggagagggagagcttttctttatcgaaaatttggctaaggggtaaaaaggagaagcaaaaggggactagtgctagagattcggattgttctttcgtgtcttcctcttcactccggtttccaaaccatcggattcctcccgaagagagtcttaagagcgaaaattcggaatctttggagacgaaaacgccatcttttgctaggaggaccatgcattggcttgcagggagacaaaacaagattgttcagccttctacatccaatgtctag

SEQ ID NO: 1706 - protein, 1272 aa, Arabidopsis thaliana
  misc_feature: PFam Name: peroxidase; PFam Description: Peroxidase
  misc_feature: GI Number: 21537275; NR Description: putative peroxidase
  misc_feature: GI Number: 21436133; NR Description: putative peroxidase [Arabidopsis thaliana] >gi|18377686|gb|AAL66993.1| putative peroxidase [Arabidopsis thaliana] >gi|4006918|emb|CAB16848.1| peroxidase like protein [Arabidopsis thaliana]
  misc_feature: GI Number: 4874288; NR Description: putative peroxidase [Arabidopsis thaliana] >gi|27311903|gb|AAO00917.1| putative peroxidase [Arabidopsis thaliana] >gi|19698903|gb|AAL91187.1| putative peroxidase [Arabidopsis thaliana]
  misc_feature: GI Number: 30725302; NR Description: At5g66390 [Arabidopsis thaliana] >gi|10177520|dbj|BAB10915.1| peroxidase [Arabidopsis thaliana] >gi|26397792|sp|Q9FJZ9|PE72_ARATH Peroxidase 72 precursor
ATGAACAAGATTTTACCGGAAATGAAATCAACTCAGAATTTGATCTCTTCTTCACCACCACCACCATTGATACCTCTCAAATCAAACACAAGCTTGTCAAATTTAAACAGCAAAATCACTCCAAATATTCTTCTAATAATCATAATCCTCTCGATCATCTTCTTCATCTCTGGTCTTCTCCATATTCTTGTCAAATTCCTCCTCACACCATCAAGAGAAAGCAGAGAAGATTACTTCGACAATGTTACAGCTCTTCAAGGCCAGCTTCAACAACTCTTTAACCTCCATGATTCTGGCGTTGACCAATCCTTAATCGACACGTTACCTGTTTTTCATTACAAGTCCATTGTCGGTCTCAAAATCTCTCCTTTTGATTGTCCTGTTTGTCTCTGTGAGTTTGAAACAGAGGATAAACTTAGACTCTTGCCTAAATGCAGCCATGCCTTTCACGTTGAGTGTATCGACACGTGGCTTCTCTCTCACTCTACTTGTCCCTTGTGTAGATCTAATCTCCTCTCTGGTTTTTCGTCTCACCACAATCTAAGCTCCTCGTATCTACTTGTTCTTGAGAGTGAACAAAGCTCGAGAGATATGGTTCCTGTTCTTGAGTCTAACTCTCAACTAGGTTATGATGTGAACAATGATTCTGAGTCGACCCGGATTAGGTCGGGTCGTAAATCATGTGACCCGGATGGTGACATGGATGGTTTAGATGAAAAGGTTGTTCCTTTAGAAGTTAAGTTAGGGAAGTTTAGGAACATAGATCATGTTGGTGAAGGAAGTGACCAGAAGAAAAATAGCATAAGTGGTAATAGTAAAAATGTGGATGGAAGGAGGTGTTTGTCAATGGGATCATATGAGTATATTATGGATCAAGAAGCTACACTTAAGGTTCATGTTTCGACCAAGAAACTATCCGGAAAAGACCGGGTGCCGAGCCACAGGACCGTTATGTCCGAATGCGGTTTTGATCCAACAGTTAAGGGAATTGAGAAGAGTGTTGTGGAGAGGGAGAGCTTTTCTTTATCGAAAATTTGGCTAAGGGGTAAAAAGGAGAAGCAAAAGGGGACTAGTGCTAGAGATTCGGATTGTTCTTTCGTGTCTTCCTCTTCACTCCGGTTTCCAAACCATCGGATTCCTCCCGAAGAGAGTCTTAAGAGCGAAAATTCGGAATCTTTGGAGACGAAAACGCCATCTTTTGCTAGGAGGACCATGCATTGGCTTGCAGGGAGACAAAACAAGATTGTTCAGCCTTCTACATCCAATGTCTAG

SEQ ID NO: 1707 - DNA, 972 bp, Arabidopsis thaliana
  misc_feature (1)..(972): Ceres cDNA ID no. 12672056
  misc_feature (1)..(972): Also known as  Ceres CDNA ID no. 23481756
atgcaggtcaagatctcaaactacggcaccaccatcacctctttgtctgttcccgacaagaacgggaaactgggggatgtagttctcggattcgactcggtggatccatatgtgaaagggcttgcaccatactttgggtgcattgttggtcgtgtggcaaatcggatcaaggagggaaaattcagtctcaatggagttaactacactttgcctatcaacaagcctcctaatagtctccacggtggtaacaagggtttcgataagaagatatgggaagttgcagggcacaagagagacggcgaaaaacctttcatcactttcaaatatcacagtgccgatggagaagaaggttaccctggtgcggtttctgtcacggcgacatacactctcacgtcagccacgacaatgagacttgacatggaagctgttccagagaacaaagatactcccatcaacttagctcaacatacatactggaacttagcaggtcatgactcaggaaacattctagaccataagattcagatatgggggtctcatatcacgccggttgacgaatacacagttcctacaggagagatcttgcctgtaaagggaactcctttcgatttcactgaggagaagcggataggcgagtctattggagaggttggtatcggatacgatcataactacgtgttggactgtcctgatcaagagaaggaggggctgaaacacgcagcgaagctcagtgatgctgctagctcaagggtactgaacttgtggaccaatgtgccgggaatgcagttttataccgggaactatgtgaatggagtggttgggaaagggaatgcggtttacgggaaacatgcgggtgtgtgccttgagacgcagggattcccgaacgcgattaaccagtcgaatttcccgtctgttgtggttaaggctggtgagaagtacaatcacacgatgctgtttgagttttcagcttga

SEQ ID NO: 1708 - protein, 972 aa, Arabidopsis thaliana
  misc_feature: PFam Name: peroxidase; PFam Description: Peroxidase
  misc_feature: GI Number: 21537275; NR Description: putative peroxidase
  misc_feature: GI Number: 21436133; NR Description: putative peroxidase [Arabidopsis thaliana] >gi|18377686|gb|AAL66993.1| putative peroxidase [Arabidopsis thaliana] >gi|4006918|emb|CAB16848.1| peroxidase like protein [Arabidopsis thaliana]
  misc_feature: GI Number: 4874288; NR Description: putative peroxidase [Arabidopsis thaliana] >gi|27311903|gb|AAO00917.1| putative peroxidase [Arabidopsis thaliana] >gi|19698903|gb|AAL91187.1| putative peroxidase [Arabidopsis thaliana]
  misc_feature: GI Number: 30725302; NR Description: At5g66390 [Arabidopsis thaliana] >gi|10177520|dbj|BAB10915.1| peroxidase [Arabidopsis thaliana] >gi|26397792|sp|Q9FJZ9|PE72_ARATH Peroxidase 72 precursor
ATGCAGGTCAAGATCTCAAACTACGGCACCACCATCACCTCTTTGTCTGTTCCCGACAAGAACGGGAAACTGGGGGATGTAGTTCTCGGATTCGACTCGGTGGATCCATATGTGAAAGGGCTTGCACCATACTTTGGGTGCATTGTTGGTCGTGTGGCAAATCGGATCAAGGAGGGAAAATTCAGTCTCAATGGAGTTAACTACACTTTGCCTATCAACAAGCCTCCTAATAGTCTCCACGGTGGTAACAAGGGTTTCGATAAGAAGATATGGGAAGTTGCAGGGCACAAGAGAGACGGCGAAAAACCTTTCATCACTTTCAAATATCACAGTGCCGATGGAGAAGAAGGTTACCCTGGTGCGGTTTCTGTCACGGCGACATACACTCTCACGTCAGCCACGACAATGAGACTTGACATGGAAGCTGTTCCAGAGAACAAAGATACTCCCATCAACTTAGCTCAACATACATACTGGAACTTAGCAGGTCATGACTCAGGAAACATTCTAGACCATAAGATTCAGATATGGGGGTCTCATATCACGCCGGTTGACGAATACACAGTTCCTACAGGAGAGATCTTGCCTGTAAAGGGAACTCCTTTCGATTTCACTGAGGAGAAGCGGATAGGCGAGTCTATTGGAGAGGTTGGTATCGGATACGATCATAACTACGTGTTGGACTGTCCTGATCAAGAGAAGGAGGGGCTGAAACACGCAGCGAAGCTCAGTGATGCTGCTAGCTCAAGGGTACTGAACTTGTGGACCAATGTGCCGGGAATGCAGTTTTATACCGGGAACTATGTGAATGGAGTGGTTGGGAAAGGGAATGCGGTTTACGGGAAACATGCGGGTGTGTGCCTTGAGACGCAGGGATTCCCGAACGCGATTAACCAGTCGAATTTCCCGTCTGTTGTGGTTAAGGCTGGTGAGAAGTACAATCACACGATGCTGTTTGAGTTTTCAGCTTGA

SEQ ID NO: 1709 - DNA, 1773 bp, Arabidopsis thaliana
  misc_feature (1)..(1773): Ceres cDNA ID no. 12672193
  misc_feature (1)..(1773): Also known as  Ceres CDNA ID no. 23481756
actccaaaacataaaacaataaccttagaaagaaaaaaaagagaaaaaaacagatcaaatcaagaatgtcgatctctctctatttccttttgctcttgcctctctttttaatcttcttcaaaaagctctcaccttctaaaggaaagcttcctcctggacctctaggtcttccgattatcgggaacttgcaccaacttggaaaatctctccatagatcttttcataaactttctcaaaactatggacccgtgatgtttctacatttcggtgtggtccctgtggttgtggtctccacaagagaagcagctgaagaagttctcaagactcatgatctcgagacttgtacccgaccaaagctaacagcgaccaaattgttttcttacaactacaaagacattggcttcgctcaatacggtgatgactggagagagatgaggaagcttgcgatgctcgagctttttagctcgaaaaagctcaaggctttcaggtatattagagaagaagagagtgaagtcctagtcaataaactctcgaaatctgctgagacacgaactatggtagacttgagaaaagctcttttctcttataccgctagtatcgtatgtagactcgcttttggacagaacttccatgagtgcgattttgtcgatatggataaagttgaagatcttgtgctcgaatctgagaccaatcttggctcattcgcgttcactgacttcttccccgcaggtcttgggtgggttatagaccggatctctggccaacattcggagttgcacaaagcctttgctagacttagtaatttctttcaacatgtgatcgatgatcacttgaagcccgggcaatctcaagatcattcagacatcattggtgtcatgttagatatgatcaataaagagagtaaagtcggttccttccaagtcacctacgaccatcttaaaggagtcatgtcggatgtgtttttagcgggagtgaacgcaggagcgatcacaatgatatgggcgatgacagagctagccagacatccgagagtgatgaagaaacttcaacaagagattcgagaaatactcggagacaacaaagaaaaaatcacggaacaagatctcgaaaaggttcactacttgaaacttgtgatcgaagaaacattcagattacatcctccagctcctctcttgctacctagagagacaatgtctgacttaaagattcaaggctacaatattcccaagaacacgatgatagagatcaatacttattcaataggacgcgatcctaattgctgggaaaaccctaacgatttcaacccggagagatttatcgatagccctgtcgaatataagggtcaacattacgagttgttgccttttggtgctggtcgcaggatttgtccaggaatggctacggggataactatcgtcgagctcggtttacttaatgttctttacttctttgattggagtttgcctgatggaatgaaaattgaagacatagacatggaagaagctggagctttcgtcgtcgccaagaaagtccctcttgagctgattccaactccacatcagtggtgaagttatgaagaggtgtaaataatctaataagatcaagattttctcttgcgatcggtttcatttttattatattgttatttgttacgttcatgagttgttgttatcagtagacatttgtatgttcattatgttttttgtttattttaatgttcattatgtttaattcatgtttgaaataaagaaacgtccgattgtgacattagtt

SEQ ID NO: 1710 - protein, 1773 aa, Arabidopsis thaliana
  misc_feature: PFam Name: peroxidase; PFam Description: Peroxidase
  misc_feature: GI Number: 21537275; NR Description: putative peroxidase
  misc_feature: GI Number: 21436133; NR Description: putative peroxidase [Arabidopsis thaliana] >gi|18377686|gb|AAL66993.1| putative peroxidase [Arabidopsis thaliana] >gi|4006918|emb|CAB16848.1| peroxidase like protein [Arabidopsis thaliana]
  misc_feature: GI Number: 4874288; NR Description: putative peroxidase [Arabidopsis thaliana] >gi|27311903|gb|AAO00917.1| putative peroxidase [Arabidopsis thaliana] >gi|19698903|gb|AAL91187.1| putative peroxidase [Arabidopsis thaliana]
  misc_feature: GI Number: 30725302; NR Description: At5g66390 [Arabidopsis thaliana] >gi|10177520|dbj|BAB10915.1| peroxidase [Arabidopsis thaliana] >gi|26397792|sp|Q9FJZ9|PE72_ARATH Peroxidase 72 precursor
ACTCCAAAACATAAAACAATAACCTTAGAAAGAAAAAAAAGAGAAAAAAACAGATCAAATCAAGAATGTCGATCTCTCTCTATTTCCTTTTGCTCTTGCCTCTCTTTTTAATCTTCTTCAAAAAGCTCTCACCTTCTAAAGGAAAGCTTCCTCCTGGACCTCTAGGTCTTCCGATTATCGGGAACTTGCACCAACTTGGAAAATCTCTCCATAGATCTTTTCATAAACTTTCTCAAAACTATGGACCCGTGATGTTTCTACATTTCGGTGTGGTCCCTGTGGTTGTGGTCTCCACAAGAGAAGCAGCTGAAGAAGTTCTCAAGACTCATGATCTCGAGACTTGTACCCGACCAAAGCTAACAGCGACCAAATTGTTTTCTTACAACTACAAAGACATTGGCTTCGCTCAATACGGTGATGACTGGAGAGAGATGAGGAAGCTTGCGATGCTCGAGCTTTTTAGCTCGAAAAAGCTCAAGGCTTTCAGGTATATTAGAGAAGAAGAGAGTGAAGTCCTAGTCAATAAACTCTCGAAATCTGCTGAGACACGAACTATGGTAGACTTGAGAAAAGCTCTTTTCTCTTATACCGCTAGTATCGTATGTAGACTCGCTTTTGGACAGAACTTCCATGAGTGCGATTTTGTCGATATGGATAAAGTTGAAGATCTTGTGCTCGAATCTGAGACCAATCTTGGCTCATTCGCGTTCACTGACTTCTTCCCCGCAGGTCTTGGGTGGGTTATAGACCGGATCTCTGGCCAACATTCGGAGTTGCACAAAGCCTTTGCTAGACTTAGTAATTTCTTTCAACATGTGATCGATGATCACTTGAAGCCCGGGCAATCTCAAGATCATTCAGACATCATTGGTGTCATGTTAGATATGATCAATAAAGAGAGTAAAGTCGGTTCCTTCCAAGTCACCTACGACCATCTTAAAGGAGTCATGTCGGATGTGTTTTTAGCGGGAGTGAACGCAGGAGCGATCACAATGATATGGGCGATGACAGAGCTAGCCAGACATCCGAGAGTGATGAAGAAACTTCAACAAGAGATTCGAGAAATACTCGGAGACAACAAAGAAAAAATCACGGAACAAGATCTCGAAAAGGTTCACTACTTGAAACTTGTGATCGAAGAAACATTCAGATTACATCCTCCAGCTCCTCTCTTGCTACCTAGAGAGACAATGTCTGACTTAAAGATTCAAGGCTACAATATTCCCAAGAACACGATGATAGAGATCAATACTTATTCAATAGGACGCGATCCTAATTGCTGGGAAAACCCTAACGATTTCAACCCGGAGAGATTTATCGATAGCCCTGTCGAATATAAGGGTCAACATTACGAGTTGTTGCCTTTTGGTGCTGGTCGCAGGATTTGTCCAGGAATGGCTACGGGGATAACTATCGTCGAGCTCGGTTTACTTAATGTTCTTTACTTCTTTGATTGGAGTTTGCCTGATGGAATGAAAATTGAAGACATAGACATGGAAGAAGCTGGAGCTTTCGTCGTCGCCAAGAAAGTCCCTCTTGAGCTGATTCCAACTCCACATCAGTGGTGAAGTTATGAAGAGGTGTAAATAATCTAATAAGATCAAGATTTTCTCTTGCGATCGGTTTCATTTTTATTATATTGTTATTTGTTACGTTCATGAGTTGTTGTTATCAGTAGACATTTGTATGTTCATTATGTTTTTTGTTTATTTTAATGTTCATTATGTTTAATTCATGTTTGAAATAAAGAAACGTCCGATTGTGACATTAGTT

SEQ ID NO: 1711 - DNA, 1086 bp, Arabidopsis thaliana
  misc_feature (1)..(1086): Ceres cDNA ID no. 12672489
  misc_feature (1)..(1086): Also known as  Ceres CDNA ID no. 23481756
atggagcagaaacaacatattcttaaacaaagtacattctcttcctctcctagttcttattcttcaatctcagaccgtcccatctctctccttagccgcaacggtctcctccttctccttctcgctctcgtcctgctcctcggtgtactcttgccctggccaggatctcccttattcctgtttccaaatagactttcttcttctttgtcaccgtctccgcagtccaaatggcgcgactatacccttgctcaggcggctaggttcgtggccaagaatggcactgtgatagtctgcgccgtgagctcaccattcttgccttttctcaacaactggttgattagtgtttctagacaaaagcatcaagacaaagtcctcgtgatcgctgaggattacattactctgtataaagtcaacgagaagtggcctggccacgccgttcttattcctccagcgctcgattctaaaaccgcattcagtttcggttcccagggtttcttcaatttcacagctcgaaggccgcaacatctcttgcaaattttggagctaggttacaatgttatgtacaacgatgttgatatggtttggttgcaagatccatttctgtatttggagggaagccatgacgcgtatttcaccgatgacatgcctcaaataaagcctttgaatcactctcatgatttaccacatccggatcgaaacggagagacttatatatgtagctgcatgatttacttgcgacctacgaatggtgcaaagcttctaatgaagaaatggagtgaggaacttcaatcccaagcttggtctgaatccatccgttttaaagcaaatgatcagcctgcttttaacttggcacttaacaaaacagctcatcaagtggatctctacttgctttctcaagtagctttcccaacaggaggattgtacttcaagaacgaggcatgggttcaagagacaaaggggaaacatgtcatagtccacaataactacattatcggttacgacaggaaaatgaaacgtttccaagattacggtctatggcttgtcgatgatcacgctcttgagtctccattagggaaattagagtaa

SEQ ID NO: 1712 - protein, 1086 aa, Arabidopsis thaliana
  misc_feature: PFam Name: peroxidase; PFam Description: Peroxidase
  misc_feature: GI Number: 21537275; NR Description: putative peroxidase
  misc_feature: GI Number: 21436133; NR Description: putative peroxidase [Arabidopsis thaliana] >gi|18377686|gb|AAL66993.1| putative peroxidase [Arabidopsis thaliana] >gi|4006918|emb|CAB16848.1| peroxidase like protein [Arabidopsis thaliana]
  misc_feature: GI Number: 4874288; NR Description: putative peroxidase [Arabidopsis thaliana] >gi|27311903|gb|AAO00917.1| putative peroxidase [Arabidopsis thaliana] >gi|19698903|gb|AAL91187.1| putative peroxidase [Arabidopsis thaliana]
  misc_feature: GI Number: 30725302; NR Description: At5g66390 [Arabidopsis thaliana] >gi|10177520|dbj|BAB10915.1| peroxidase [Arabidopsis thaliana] >gi|26397792|sp|Q9FJZ9|PE72_ARATH Peroxidase 72 precursor
ATGGAGCAGAAACAACATATTCTTAAACAAAGTACATTCTCTTCCTCTCCTAGTTCTTATTCTTCAATCTCAGACCGTCCCATCTCTCTCCTTAGCCGCAACGGTCTCCTCCTTCTCCTTCTCGCTCTCGTCCTGCTCCTCGGTGTACTCTTGCCCTGGCCAGGATCTCCCTTATTCCTGTTTCCAAATAGACTTTCTTCTTCTTTGTCACCGTCTCCGCAGTCCAAATGGCGCGACTATACCCTTGCTCAGGCGGCTAGGTTCGTGGCCAAGAATGGCACTGTGATAGTCTGCGCCGTGAGCTCACCATTCTTGCCTTTTCTCAACAACTGGTTGATTAGTGTTTCTAGACAAAAGCATCAAGACAAAGTCCTCGTGATCGCTGAGGATTACATTACTCTGTATAAAGTCAACGAGAAGTGGCCTGGCCACGCCGTTCTTATTCCTCCAGCGCTCGATTCTAAAACCGCATTCAGTTTCGGTTCCCAGGGTTTCTTCAATTTCACAGCTCGAAGGCCGCAACATCTCTTGCAAATTTTGGAGCTAGGTTACAATGTTATGTACAACGATGTTGATATGGTTTGGTTGCAAGATCCATTTCTGTATTTGGAGGGAAGCCATGACGCGTATTTCACCGATGACATGCCTCAAATAAAGCCTTTGAATCACTCTCATGATTTACCACATCCGGATCGAAACGGAGAGACTTATATATGTAGCTGCATGATTTACTTGCGACCTACGAATGGTGCAAAGCTTCTAATGAAGAAATGGAGTGAGGAACTTCAATCCCAAGCTTGGTCTGAATCCATCCGTTTTAAAGCAAATGATCAGCCTGCTTTTAACTTGGCACTTAACAAAACAGCTCATCAAGTGGATCTCTACTTGCTTTCTCAAGTAGCTTTCCCAACAGGAGGATTGTACTTCAAGAACGAGGCATGGGTTCAAGAGACAAAGGGGAAACATGTCATAGTCCACAATAACTACATTATCGGTTACGACAGGAAAATGAAACGTTTCCAAGATTACGGTCTATGGCTTGTCGATGATCACGCTCTTGAGTCTCCATTAGGGAAATTAGAGTAA

SEQ ID NO: 1713 - DNA, 1961 bp, Arabidopsis thaliana
  misc_feature (1)..(1961): Ceres cDNA ID no. 12672628
  misc_feature (1)..(1961): Also known as  Ceres CDNA ID no. 23481756
atcaatacgttcctctcagaacattctggaacttcacaacataatctctctctctctctatctctagcttcgtgatcatcgtgtgtctctgtgttcaatctggattgtgacaatctctttctttcttggttggtgtagattacgtcaagagagagatagagaagtttttggatttggttctaatgggtctgtgatagacgtttcctttctcttctctgtctagtttctgttttgagatctctatgtttccaactttcttcaaagctcattcccattggtagatttcatcattatcttaatttgggtattgggattaaggaaagtttagatttttgatctataactcatgccgggggaacaaaccggagaaactccgacggtggccggagttggcggcggtggagctggttgtagcgccgggaatagtggtggaagtagtggatgtggtgctggtggtggcggtggtggtagtggtggaggtggtggcggaggaggagattcacagaggtcaattccgacgccgtttttgacgaaaacgtatcagcttgtggaagatccggtttacgacgaattgatctcgtggaacgaagatggaaccacttttattgtgtggcgaccagctgaattcgctagagatcttcttcccaaatacttcaaacataataacttctcgagttttgttcgtcagctcaatacttacggatttcgaaaagtagttccagatcgttgggagttttctaatgattgttttaagagaggtgagaagattctgcttcgggatattcaacggcggaaaatctctcagcctgctatggccgcggctgctgcagcggcggcggcagccgtagcggcttcggctgttacagtagcagctgttcctgttgtagctcatattgtttctccatcgaactctggagaagaacaggttatatcgtctaattcttcgcctgcggctgctgctgctgctataggaggagtggttggtggtggttctttgcagaggacaacgagctgcaccactgcaccagagctggttgaggagaatgagcgattgaggaaagataatgagcgattgaggaaagagatgacaaagcttaaaggattgtatgcgaatatctacacattaatggcgaatttcacaccgggtcaagaagattgtgcgcatttgttacctgaagggaaacctttagatcttttaccggagagacaagagatgagtgaagccattatggcttctgaaatagagacagggattggtctgaaacttggtgaggatttgactccaaggttgtttggggtttctattggggtcaagcgagctagaagagaagaagaattgggtgctgcagaggaagaagatgatgatagacgagaagctgctgcccaagagggagaacaaagttctgatgttaaggcagagccaatggaggagaataactccggtaaccataatgggtcgtggcttgaactcggaaaatgaaaaacacttgccgattcagaggcattgttgaatatgcaagaaactgttactgatccccattgcataggcaagccattgcgctgtcccggacggaaaatggggatgtgttcggtcataagaggacagatgttcattgagttggggtagtacaaaagtatctaaaaacactgattctaccatcctgagttgttcctgatttcagatgttgcctcctgaatcttcttcttgatggaactgaaactattctggcttgctgtgctccagtgagtggatgtgcttctcacgatttcggataaagcaggcagattcaatgttacatcttcatattctgcaacaaatagcaggaatcaatggtttttaagagttatggcaatgttgatacagaatcatttcttttgagttcaaaacaattgtagctctctgacttgtaatgatcttaatgaaatttatctctcttatttaaagatggtccaagttctct

SEQ ID NO: 1714 - protein, 1961 aa, Arabidopsis thaliana
  misc_feature: PFam Name: peroxidase; PFam Description: Peroxidase
  misc_feature: GI Number: 21537275; NR Description: putative peroxidase
  misc_feature: GI Number: 21436133; NR Description: putative peroxidase [Arabidopsis thaliana] >gi|18377686|gb|AAL66993.1| putative peroxidase [Arabidopsis thaliana] >gi|4006918|emb|CAB16848.1| peroxidase like protein [Arabidopsis thaliana]
  misc_feature: GI Number: 4874288; NR Description: putative peroxidase [Arabidopsis thaliana] >gi|27311903|gb|AAO00917.1| putative peroxidase [Arabidopsis thaliana] >gi|19698903|gb|AAL91187.1| putative peroxidase [Arabidopsis thaliana]
  misc_feature: GI Number: 30725302; NR Description: At5g66390 [Arabidopsis thaliana] >gi|10177520|dbj|BAB10915.1| peroxidase [Arabidopsis thaliana] >gi|26397792|sp|Q9FJZ9|PE72_ARATH Peroxidase 72 precursor
ATCAATACGTTCCTCTCAGAACATTCTGGAACTTCACAACATAATCTCTCTCTCTCTCTATCTCTAGCTTCGTGATCATCGTGTGTCTCTGTGTTCAATCTGGATTGTGACAATCTCTTTCTTTCTTGGTTGGTGTAGATTACGTCAAGAGAGAGATAGAGAAGTTTTTGGATTTGGTTCTAATGGGTCTGTGATAGACGTTTCCTTTCTCTTCTCTGTCTAGTTTCTGTTTTGAGATCTCTATGTTTCCAACTTTCTTCAAAGCTCATTCCCATTGGTAGATTTCATCATTATCTTAATTTGGGTATTGGGATTAAGGAAAGTTTAGATTTTTGATCTATAACTCATGCCGGGGGAACAAACCGGAGAAACTCCGACGGTGGCCGGAGTTGGCGGCGGTGGAGCTGGTTGTAGCGCCGGGAATAGTGGTGGAAGTAGTGGATGTGGTGCTGGTGGTGGCGGTGGTGGTAGTGGTGGAGGTGGTGGCGGAGGAGGAGATTCACAGAGGTCAATTCCGACGCCGTTTTTGACGAAAACGTATCAGCTTGTGGAAGATCCGGTTTACGACGAATTGATCTCGTGGAACGAAGATGGAACCACTTTTATTGTGTGGCGACCAGCTGAATTCGCTAGAGATCTTCTTCCCAAATACTTCAAACATAATAACTTCTCGAGTTTTGTTCGTCAGCTCAATACTTACGGATTTCGAAAAGTAGTTCCAGATCGTTGGGAGTTTTCTAATGATTGTTTTAAGAGAGGTGAGAAGATTCTGCTTCGGGATATTCAACGGCGGAAAATCTCTCAGCCTGCTATGGCCGCGGCTGCTGCAGCGGCGGCGGCAGCCGTAGCGGCTTCGGCTGTTACAGTAGCAGCTGTTCCTGTTGTAGCTCATATTGTTTCTCCATCGAACTCTGGAGAAGAACAGGTTATATCGTCTAATTCTTCGCCTGCGGCTGCTGCTGCTGCTATAGGAGGAGTGGTTGGTGGTGGTTCTTTGCAGAGGACAACGAGCTGCACCACTGCACCAGAGCTGGTTGAGGAGAATGAGCGATTGAGGAAAGATAATGAGCGATTGAGGAAAGAGATGACAAAGCTTAAAGGATTGTATGCGAATATCTACACATTAATGGCGAATTTCACACCGGGTCAAGAAGATTGTGCGCATTTGTTACCTGAAGGGAAACCTTTAGATCTTTTACCGGAGAGACAAGAGATGAGTGAAGCCATTATGGCTTCTGAAATAGAGACAGGGATTGGTCTGAAACTTGGTGAGGATTTGACTCCAAGGTTGTTTGGGGTTTCTATTGGGGTCAAGCGAGCTAGAAGAGAAGAAGAATTGGGTGCTGCAGAGGAAGAAGATGATGATAGACGAGAAGCTGCTGCCCAAGAGGGAGAACAAAGTTCTGATGTTAAGGCAGAGCCAATGGAGGAGAATAACTCCGGTAACCATAATGGGTCGTGGCTTGAACTCGGAAAATGAAAAACACTTGCCGATTCAGAGGCATTGTTGAATATGCAAGAAACTGTTACTGATCCCCATTGCATAGGCAAGCCATTGCGCTGTCCCGGACGGAAAATGGGGATGTGTTCGGTCATAAGAGGACAGATGTTCATTGAGTTGGGGTAGTACAAAAGTATCTAAAAACACTGATTCTACCATCCTGAGTTGTTCCTGATTTCAGATGTTGCCTCCTGAATCTTCTTCTTGATGGAACTGAAACTATTCTGGCTTGCTGTGCTCCAGTGAGTGGATGTGCTTCTCACGATTTCGGATAAAGCAGGCAGATTCAATGTTACATCTTCATATTCTGCAACAAATAGCAGGAATCAATGGTTTTTAAGAGTTATGGCAATGTTGATACAGAATCATTTCTTTTGAGTTCAAAACAATTGTAGCTCTCTGACTTGTAATGATCTTAATGAAATTTATCTCTCTTATTTAAAGATGGTCCAAGTTCTCT

SEQ ID NO: 1715 - DNA, 2472 bp, Arabidopsis thaliana
  misc_feature (1)..(2472): Ceres cDNA ID no. 12672842
  misc_feature (1)..(2472): Also known as  Ceres CDNA ID no. 23481756
atgaaatttggaaccttttcacttcccagacaaattccaacctgcaaaggtgggcgctttacacgagttttgcaatctatcggatcagttattagagaattttcagcatctgcaaatgctttgcaagactgttggaaaaatgggaatgaaagtaaagagattgatgatgttcacacacttttcagatattgcactaatttgcaatcagccaaatgtctccacgcacgtctcgttgtctccaaacaaatccaaaatgtttgtatctctgctaaacttgttaatctctattgttaccttggcaatgtcgcattggctaggcacacgtttgatcatatccagaacagagatgtatacgcttggaatttgatgatttctggttatggccgtgcgggaaattcttcagaagtgattaggtgttttagtctctttatgttgagttctggacttacacctgattacaggacttttccttcggttttgaaagcttgtaggactgtgattgatgggaataagattcattgcttggctttgaagtttgggtttatgtgggatgtctatgttgctgcctcgttgattcatttgtactctcgatataaagctgtggggaatgcacgtatactgtttgatgaaatgcctgtaagagatatgggttcttggaatgcaatgatttctgggtattgtcaaagcggaaatgctaaagaggcgttaactctgtctaatgggttgagagctatggattcagttaccgttgtgagtctcctttcggcttgcactgaagccggtgatttcaatagaggagttactattcattcatactcgataaaacatggtctggagtccgaattgtttgtttccaacaagctgattgatttgtatgctgaatttggtaggcttagggattgccagaaggtttttgataggatgtatgtgagggatttgatttcttggaattcgataattaaggcgtacgagctgaatgagcagccgcttagagcgatttcgttgtttcaggagatgcggttgagtagaattcaaccagattgccttactttgattagtttggcttctatactatcacagttaggggacattcgtgcttgtagatctgtgcagggtttcactttgaggaaaggctggttcttggaagatattaccatcgggaatgctgttgtggttatgtatgcaaaactaggccttgtagattcagcaagagcagtgtttaattggcttccgaatacagatgttatttcatggaataccataatctcgggttatgctcaaaacggttttgctagtgaagcaattgaaatgtataacataatggaggaagaaggtgaaatagccgctaaccaagggacttgggtgagtgttttgcccgcttgttcgcaggctggagcgttgcgtcaaggtatgaaactccatggccgtctcttgaagaacggtctttatttggatgtttttgttgttacaagccttgctgatatgtatggaaagtgtggacgactagaggatgccctctctttgttttatcaaatcccaagagtcaactctgtgccatggaacaccctaatagcgtgtcacgggtttcacgggcatggcgagaaagcagtgatgctgttcaaagaaatgctggatgaaggagtgaagccagatcacattacatttgtgactctgttatcggcttgtagccattctgggttagtagacgagggtcaatggtgctttgagatgatgcaaacggattatgggataacaccgagcttgaaacattacggttgtatggtagatatgtatggtcgagctggtcagttagaaaccgcgttgaagtttataaaaagtatgtcgcttcagcctgatgcatccatttggggagctcttctcagcgcttgtagagtccatgggaatgttgatcttggcaagatcgcatctgaacatttgttcgaggttgaacctgagcatgtcgggtatcatgttctattgtcaaacatgtatgctagtgctggaaaatgggaaggagttgatgaaatacgttcaatagcccatggcaaaggtttgaggaagacaccgggttggagctcaatggaagtagacaacaaagtcgaagtcttttacacgggaaaccaaacgcatccaatgtatgaagagatgtacagagaattaacggcattacaagcgaaactgaagatgattgggtatgtaccggaccatagatttgtgttgcaggatgttgaagacgacgagaaagagcatatcctcatgagtcatagtgaaagattagctattgcatttgcacttatcgccactcctgcaaagacaacgattcggatttttaagaatctaagggtatgcggcgattgccatagcgtaaccaagttcatatcgaaaatcactgagagagagatcattgtgagggattcaaaccggtttcatcatttcaagaatggagtctgctcttgcggtgattactggtga

SEQ ID NO: 1716 - protein, 2472 aa, Arabidopsis thaliana
  misc_feature: PFam Name: peroxidase; PFam Description: Peroxidase
  misc_feature: GI Number: 21537275; NR Description: putative peroxidase
  misc_feature: GI Number: 21436133; NR Description: putative peroxidase [Arabidopsis thaliana] >gi|18377686|gb|AAL66993.1| putative peroxidase [Arabidopsis thaliana] >gi|4006918|emb|CAB16848.1| peroxidase like protein [Arabidopsis thaliana]
  misc_feature: GI Number: 4874288; NR Description: putative peroxidase [Arabidopsis thaliana] >gi|27311903|gb|AAO00917.1| putative peroxidase [Arabidopsis thaliana] >gi|19698903|gb|AAL91187.1| putative peroxidase [Arabidopsis thaliana]
  misc_feature: GI Number: 30725302; NR Description: At5g66390 [Arabidopsis thaliana] >gi|10177520|dbj|BAB10915.1| peroxidase [Arabidopsis thaliana] >gi|26397792|sp|Q9FJZ9|PE72_ARATH Peroxidase 72 precursor
ATGAAATTTGGAACCTTTTCACTTCCCAGACAAATTCCAACCTGCAAAGGTGGGCGCTTTACACGAGTTTTGCAATCTATCGGATCAGTTATTAGAGAATTTTCAGCATCTGCAAATGCTTTGCAAGACTGTTGGAAAAATGGGAATGAAAGTAAAGAGATTGATGATGTTCACACACTTTTCAGATATTGCACTAATTTGCAATCAGCCAAATGTCTCCACGCACGTCTCGTTGTCTCCAAACAAATCCAAAATGTTTGTATCTCTGCTAAACTTGTTAATCTCTATTGTTACCTTGGCAATGTCGCATTGGCTAGGCACACGTTTGATCATATCCAGAACAGAGATGTATACGCTTGGAATTTGATGATTTCTGGTTATGGCCGTGCGGGAAATTCTTCAGAAGTGATTAGGTGTTTTAGTCTCTTTATGTTGAGTTCTGGACTTACACCTGATTACAGGACTTTTCCTTCGGTTTTGAAAGCTTGTAGGACTGTGATTGATGGGAATAAGATTCATTGCTTGGCTTTGAAGTTTGGGTTTATGTGGGATGTCTATGTTGCTGCCTCGTTGATTCATTTGTACTCTCGATATAAAGCTGTGGGGAATGCACGTATACTGTTTGATGAAATGCCTGTAAGAGATATGGGTTCTTGGAATGCAATGATTTCTGGGTATTGTCAAAGCGGAAATGCTAAAGAGGCGTTAACTCTGTCTAATGGGTTGAGAGCTATGGATTCAGTTACCGTTGTGAGTCTCCTTTCGGCTTGCACTGAAGCCGGTGATTTCAATAGAGGAGTTACTATTCATTCATACTCGATAAAACATGGTCTGGAGTCCGAATTGTTTGTTTCCAACAAGCTGATTGATTTGTATGCTGAATTTGGTAGGCTTAGGGATTGCCAGAAGGTTTTTGATAGGATGTATGTGAGGGATTTGATTTCTTGGAATTCGATAATTAAGGCGTACGAGCTGAATGAGCAGCCGCTTAGAGCGATTTCGTTGTTTCAGGAGATGCGGTTGAGTAGAATTCAACCAGATTGCCTTACTTTGATTAGTTTGGCTTCTATACTATCACAGTTAGGGGACATTCGTGCTTGTAGATCTGTGCAGGGTTTCACTTTGAGGAAAGGCTGGTTCTTGGAAGATATTACCATCGGGAATGCTGTTGTGGTTATGTATGCAAAACTAGGCCTTGTAGATTCAGCAAGAGCAGTGTTTAATTGGCTTCCGAATACAGATGTTATTTCATGGAATACCATAATCTCGGGTTATGCTCAAAACGGTTTTGCTAGTGAAGCAATTGAAATGTATAACATAATGGAGGAAGAAGGTGAAATAGCCGCTAACCAAGGGACTTGGGTGAGTGTTTTGCCCGCTTGTTCGCAGGCTGGAGCGTTGCGTCAAGGTATGAAACTCCATGGCCGTCTCTTGAAGAACGGTCTTTATTTGGATGTTTTTGTTGTTACAAGCCTTGCTGATATGTATGGAAAGTGTGGACGACTAGAGGATGCCCTCTCTTTGTTTTATCAAATCCCAAGAGTCAACTCTGTGCCATGGAACACCCTAATAGCGTGTCACGGGTTTCACGGGCATGGCGAGAAAGCAGTGATGCTGTTCAAAGAAATGCTGGATGAAGGAGTGAAGCCAGATCACATTACATTTGTGACTCTGTTATCGGCTTGTAGCCATTCTGGGTTAGTAGACGAGGGTCAATGGTGCTTTGAGATGATGCAAACGGATTATGGGATAACACCGAGCTTGAAACATTACGGTTGTATGGTAGATATGTATGGTCGAGCTGGTCAGTTAGAAACCGCGTTGAAGTTTATAAAAAGTATGTCGCTTCAGCCTGATGCATCCATTTGGGGAGCTCTTCTCAGCGCTTGTAGAGTCCATGGGAATGTTGATCTTGGCAAGATCGCATCTGAACATTTGTTCGAGGTTGAACCTGAGCATGTCGGGTATCATGTTCTATTGTCAAACATGTATGCTAGTGCTGGAAAATGGGAAGGAGTTGATGAAATACGTTCAATAGCCCATGGCAAAGGTTTGAGGAAGACACCGGGTTGGAGCTCAATGGAAGTAGACAACAAAGTCGAAGTCTTTTACACGGGAAACCAAACGCATCCAATGTATGAAGAGATGTACAGAGAATTAACGGCATTACAAGCGAAACTGAAGATGATTGGGTATGTACCGGACCATAGATTTGTGTTGCAGGATGTTGAAGACGACGAGAAAGAGCATATCCTCATGAGTCATAGTGAAAGATTAGCTATTGCATTTGCACTTATCGCCACTCCTGCAAAGACAACGATTCGGATTTTTAAGAATCTAAGGGTATGCGGCGATTGCCATAGCGTAACCAAGTTCATATCGAAAATCACTGAGAGAGAGATCATTGTGAGGGATTCAAACCGGTTTCATCATTTCAAGAATGGAGTCTGCTCTTGCGGTGATTACTGGTGA

SEQ ID NO: 1717 - DNA, 1067 bp, Arabidopsis thaliana
  misc_feature (1)..(1067): Ceres cDNA ID no. 12672898
  misc_feature (1)..(1067): Also known as  Ceres CDNA ID no. 23481756
gtctttatcttgtccgatggttcaaacagaaaccgatcaaaggatgggtcttaatctgaatttgtctatctactctttaccaaaacccttatctcaatttctcgatgaagtgtcgaggatcaaagacaatcattccaaactgtctgaaatcgatggttatgtcggaaaattagaggaagaaaggaacaaaatcgatgtttttaaacgagaactccctttatgcatgctcttattgaacgaagagattgtttttctctgtgtagcgattggggcgttgaaggatgaggctagaaaagggttatcactgatggcatctaatgggaaattcgatgatgttgaaagggcaaaaccggaaactgataagaagagctggatgagctctgcccagttatggatctcgaaccctaattcccaattccgatcgacaaatgaagaagaagaagatcggtgtgtgagtcagaacccatttcagacatgtaattaccctaatcaaggaggggtatttatgccatttaaccgtcccccacctcctccaccaccagctcctctgtctctcatgactccaacatcagagatgatgatggattatagcagaattgagcagagtcatcatcatcatcaattcaataaaccttcttcacagagtcatcacattcagaagaaagagcagagaaggagatggtcacaggaacttcaccgtaaatttgttgatgctcttcataggcttggagggccacaagttgctacaccaaagcagattagagatttgatgaaagttgatggtttaaccaatgatgaagtcaagagccatttacaaaaatatagaatgcatatccgtaagcatccgctgcatccgacaaagactttgtcatcgtcggatcagccaggtgtgttagagagagaatcgcagagcttaataagtttgtcgaggtcggattcgccacaaagcccacttgttgcaagagggttgttcagtagtaatgttggtcatagctcagaggaagatgaggaggaggaggatgaagaggaggagaagtctgatggacgtagtagctgtagaaatgatg

SEQ ID NO: 1718 - protein, 1067 aa, Arabidopsis thaliana
  misc_feature: PFam Name: peroxidase; PFam Description: Peroxidase
  misc_feature: GI Number: 21537275; NR Description: putative peroxidase
  misc_feature: GI Number: 21436133; NR Description: putative peroxidase [Arabidopsis thaliana] >gi|18377686|gb|AAL66993.1| putative peroxidase [Arabidopsis thaliana] >gi|4006918|emb|CAB16848.1| peroxidase like protein [Arabidopsis thaliana]
  misc_feature: GI Number: 4874288; NR Description: putative peroxidase [Arabidopsis thaliana] >gi|27311903|gb|AAO00917.1| putative peroxidase [Arabidopsis thaliana] >gi|19698903|gb|AAL91187.1| putative peroxidase [Arabidopsis thaliana]
  misc_feature: GI Number: 30725302; NR Description: At5g66390 [Arabidopsis thaliana] >gi|10177520|dbj|BAB10915.1| peroxidase [Arabidopsis thaliana] >gi|26397792|sp|Q9FJZ9|PE72_ARATH Peroxidase 72 precursor
GTCTTTATCTTGTCCGATGGTTCAAACAGAAACCGATCAAAGGATGGGTCTTAATCTGAATTTGTCTATCTACTCTTTACCAAAACCCTTATCTCAATTTCTCGATGAAGTGTCGAGGATCAAAGACAATCATTCCAAACTGTCTGAAATCGATGGTTATGTCGGAAAATTAGAGGAAGAAAGGAACAAAATCGATGTTTTTAAACGAGAACTCCCTTTATGCATGCTCTTATTGAACGAAGAGATTGTTTTTCTCTGTGTAGCGATTGGGGCGTTGAAGGATGAGGCTAGAAAAGGGTTATCACTGATGGCATCTAATGGGAAATTCGATGATGTTGAAAGGGCAAAACCGGAAACTGATAAGAAGAGCTGGATGAGCTCTGCCCAGTTATGGATCTCGAACCCTAATTCCCAATTCCGATCGACAAATGAAGAAGAAGAAGATCGGTGTGTGAGTCAGAACCCATTTCAGACATGTAATTACCCTAATCAAGGAGGGGTATTTATGCCATTTAACCGTCCCCCACCTCCTCCACCACCAGCTCCTCTGTCTCTCATGACTCCAACATCAGAGATGATGATGGATTATAGCAGAATTGAGCAGAGTCATCATCATCATCAATTCAATAAACCTTCTTCACAGAGTCATCACATTCAGAAGAAAGAGCAGAGAAGGAGATGGTCACAGGAACTTCACCGTAAATTTGTTGATGCTCTTCATAGGCTTGGAGGGCCACAAGTTGCTACACCAAAGCAGATTAGAGATTTGATGAAAGTTGATGGTTTAACCAATGATGAAGTCAAGAGCCATTTACAAAAATATAGAATGCATATCCGTAAGCATCCGCTGCATCCGACAAAGACTTTGTCATCGTCGGATCAGCCAGGTGTGTTAGAGAGAGAATCGCAGAGCTTAATAAGTTTGTCGAGGTCGGATTCGCCACAAAGCCCACTTGTTGCAAGAGGGTTGTTCAGTAGTAATGTTGGTCATAGCTCAGAGGAAGATGAGGAGGAGGAGGATGAAGAGGAGGAGAAGTCTGATGGACGTAGTAGCTGTAGAAATGATG

SEQ ID NO: 1719 - DNA, 1465 bp, Arabidopsis thaliana
  misc_feature (1)..(1465): Ceres cDNA ID no. 12672976
  misc_feature (1)..(1465): Also known as  Ceres CDNA ID no. 23481756
atcgtagtgcgttacaagcgttttaagctctcactagcaagcaagtactagcaacaatggcgtcaagcactgcgactatgctcaaagcctcaccggtgaaatctgattgggttaagggacagagtcttctcctccgtcaaccttcctctgtctcagctattcgcagccacgtggcaccttccgctctcaccgtccgagccgcttctgcttacgccgatgagctcgtcaaaaccgctaaaacaatcgcgtctccgggacacggaattatggcgatggatgagtccaacgcgacttgtggaaagcgtttggcgtcaattgggctagagaacacggaggctaaccgtcaagcttacaggacgttgcttgtgtcggctccaggacttggacagtacatctccggagctatcctgttcgaggagactctgtaccaatccaccactgatggcaagaaaatggttgatgttctcgtcgagcagaacatcgtccctggcatcaaagtcgacaagggtttggtgccacttgttgggtcttacgacgagtcatggtgccaaggacttgacggtttagcctctcgcaccgctgcttactaccaacaaggtgctcgtttcgccaaatggcgtactgttgtgagcattccaaatggaccctctgctttggctgttaaagaagcagcttggggacttgctcgctacgcagctatttctcaagacagcggtctggtgccgattgtggagccagagattatgttggacggagaacacggcattgacaggacatacgacgttgcagagaaggtttgggctgaggtcttcttctacctcgctcagaacaacgtcatgttcgaaggtattctcctgaagccaagcatggttactccaggagctgaggccacagacagagctactcctgagcaggttgcttcctacactctcaagctccttcgcaacagaatccctcctgctgtccccggaatcatgttcttgtctggtggacagtccgagttggaggcgaccttgaacttgaacgcaatgaaccaggcaccgaacccatggcacgtgtccttctcctacgcacgtgccttgcagaacacttgcttgaagacatggggaggcaaggaagagaacgtgaaggcggctcaggacattctcttggccagagccaaagccaattcgctggctcagctcgggaaatacactggagaaggcgagtctgaggaagccaaggagggtatgtttgtaaaaggctacacctactaagctatttgtaataatggttccatagatcaaaactcaaaaacttgagcttgattctggtcatttgagttattatactcttcttcaggtataaaagtcagttctgtgttatcatgtgagactagttttgtttcttcatggttaatatcttagtacctactcgttactactaataattgagttagtagtctgtttctatcattgttatcact

SEQ ID NO: 1720 - protein, 1465 aa, Arabidopsis thaliana
  misc_feature: PFam Name: peroxidase; PFam Description: Peroxidase
  misc_feature: GI Number: 21537275; NR Description: putative peroxidase
  misc_feature: GI Number: 21436133; NR Description: putative peroxidase [Arabidopsis thaliana] >gi|18377686|gb|AAL66993.1| putative peroxidase [Arabidopsis thaliana] >gi|4006918|emb|CAB16848.1| peroxidase like protein [Arabidopsis thaliana]
  misc_feature: GI Number: 4874288; NR Description: putative peroxidase [Arabidopsis thaliana] >gi|27311903|gb|AAO00917.1| putative peroxidase [Arabidopsis thaliana] >gi|19698903|gb|AAL91187.1| putative peroxidase [Arabidopsis thaliana]
  misc_feature: GI Number: 30725302; NR Description: At5g66390 [Arabidopsis thaliana] >gi|10177520|dbj|BAB10915.1| peroxidase [Arabidopsis thaliana] >gi|26397792|sp|Q9FJZ9|PE72_ARATH Peroxidase 72 precursor
ATCGTAGTGCGTTACAAGCGTTTTAAGCTCTCACTAGCAAGCAAGTACTAGCAACAATGGCGTCAAGCACTGCGACTATGCTCAAAGCCTCACCGGTGAAATCTGATTGGGTTAAGGGACAGAGTCTTCTCCTCCGTCAACCTTCCTCTGTCTCAGCTATTCGCAGCCACGTGGCACCTTCCGCTCTCACCGTCCGAGCCGCTTCTGCTTACGCCGATGAGCTCGTCAAAACCGCTAAAACAATCGCGTCTCCGGGACACGGAATTATGGCGATGGATGAGTCCAACGCGACTTGTGGAAAGCGTTTGGCGTCAATTGGGCTAGAGAACACGGAGGCTAACCGTCAAGCTTACAGGACGTTGCTTGTGTCGGCTCCAGGACTTGGACAGTACATCTCCGGAGCTATCCTGTTCGAGGAGACTCTGTACCAATCCACCACTGATGGCAAGAAAATGGTTGATGTTCTCGTCGAGCAGAACATCGTCCCTGGCATCAAAGTCGACAAGGGTTTGGTGCCACTTGTTGGGTCTTACGACGAGTCATGGTGCCAAGGACTTGACGGTTTAGCCTCTCGCACCGCTGCTTACTACCAACAAGGTGCTCGTTTCGCCAAATGGCGTACTGTTGTGAGCATTCCAAATGGACCCTCTGCTTTGGCTGTTAAAGAAGCAGCTTGGGGACTTGCTCGCTACGCAGCTATTTCTCAAGACAGCGGTCTGGTGCCGATTGTGGAGCCAGAGATTATGTTGGACGGAGAACACGGCATTGACAGGACATACGACGTTGCAGAGAAGGTTTGGGCTGAGGTCTTCTTCTACCTCGCTCAGAACAACGTCATGTTCGAAGGTATTCTCCTGAAGCCAAGCATGGTTACTCCAGGAGCTGAGGCCACAGACAGAGCTACTCCTGAGCAGGTTGCTTCCTACACTCTCAAGCTCCTTCGCAACAGAATCCCTCCTGCTGTCCCCGGAATCATGTTCTTGTCTGGTGGACAGTCCGAGTTGGAGGCGACCTTGAACTTGAACGCAATGAACCAGGCACCGAACCCATGGCACGTGTCCTTCTCCTACGCACGTGCCTTGCAGAACACTTGCTTGAAGACATGGGGAGGCAAGGAAGAGAACGTGAAGGCGGCTCAGGACATTCTCTTGGCCAGAGCCAAAGCCAATTCGCTGGCTCAGCTCGGGAAATACACTGGAGAAGGCGAGTCTGAGGAAGCCAAGGAGGGTATGTTTGTAAAAGGCTACACCTACTAAGCTATTTGTAATAATGGTTCCATAGATCAAAACTCAAAAACTTGAGCTTGATTCTGGTCATTTGAGTTATTATACTCTTCTTCAGGTATAAAAGTCAGTTCTGTGTTATCATGTGAGACTAGTTTTGTTTCTTCATGGTTAATATCTTAGTACCTACTCGTTACTACTAATAATTGAGTTAGTAGTCTGTTTCTATCATTGTTATCACT

SEQ ID NO: 1721 - DNA, 4243 bp, Arabidopsis thaliana
  misc_feature (1)..(4243): Ceres cDNA ID no. 12673693
  misc_feature (1)..(4243): Also known as  Ceres CDNA ID no. 23481756
gaattcttatattaacttttgttccttcagttttatacatatagtcatatgacattgaaaaaccagcacaaactccttcagttgatcaccaatagaaacaacaaaatacagtataatatttctaatttttagtgaaaatttacgaatattgtggaaacaacttttatagatgtctgagtctgacttatgtcagtattattttttcttcacttatagcagtataacattcattatttcacattaatgccaaaaaaaaattaaaaactttattatcaaatataatattcaaatctcgatattgacaggtttgccctcgtcctttgcctataaatttgacatgatctacgttcattcaaacaaaaaccaagccacaaagaaattaaatacacacaatgaccaaagaagtttgctccaacattggactttggttattgctcacgttacttattggtaactatgtcgtcaatcttgaagcctcgcaccatgtctacaagagacttacccaaagcactaacaccaaatctccttccgtaaaccagccctaccggaccggtttccatttccaaccccccaaaaattggatgaacggtatgaccaaaatgccatatcaacctcaatctcaatgtttgttattttcattactctcttacctttgcttttatttcgttgtggttcgtgcttggacaaaatggattgatcattggtcatgagcagatcctaatggttagtttttctctcttttatctcctatctttttaatttttttctcttagtcaactcttcaaatccaatagacagatcattttccctgaaaactcgtgttttttattattttataaaacattgattacaccaatatatgtcagcatacaactgtacatttgattattgtattgtattggtcgaccttgtgttacgctgcaggatccttttacactatccatatacttaactaataaaaatacacatatttaaaattttaatacagggcctatgatatacaaaggaatatatcatcttttctaccaatggaacccgaaaggagccgtgtggggtaacatcgtgtgggctcattccacgtcaacagacttaatcaattgggatccacatcctccagctatcttcccatctgcacccttcgatatcaacggatgctggtccggttcagctactattctccctaatggaaaaccggttatcctctataccggaatcgaccctaagaaccaacaggtccaaaacatagccgagcctaagaatctctccgatccttatctccgagaatggaaaaagtcgccgttaaatcctctcatggctcctgacgccgttaacggaatcaacgccagctcgttccgtgacccaaccaccgcgtggctaggccaagacaagaaatggagagtgatcatcggaagcaagattcaccgtcgtggactagccattacttacacgagtaaagactttctaaaatgggaaaaatctccagagccgttgcattacgacgacggaagtggaatgtgggaatgtcctgattttttcccggtcacgaggtttggttctaacggcgtggaaacgtcttcgtttggtgaacctaatgagattttgaagcacgtgttgaaaataagtttggacgacacgaaacatgattattacacgattggtacgtacgatcgggttaaagataaattcgtaccggacaatggtttcaagatggacggtacggctccgagatacgattacggaaagtattacgcgtctaaaacgttttttgactcggctaagaaccggagaatcttgtggggttggactaacgagtcatcgtcggttgaggatgatgttgagaaaggctggtccggtattcaggtaattagttacgcttaactgaaactaataatgtgaatataattgttagagattgaatcaattttttgtttctttcttgattagacgattccaaggaaaatatggcttgatagatcagggaaacaattaattcagtggccggttagggaagttgaaagattacgtacaaaacaagtcaaaaacttacgcaacaaagttctaaagtcaggatctaggcttgaagtctatggtgtgacagctgcacaggtttgattattatcatttttttttgaaaaatcagtaggtatgagaaaattagggttttaaaagtcttgtgatttgtacaggcggatgtagaagtattgttcaaagtgagagacttggagaaagcggatgtgatagaaccaagttggactgatccgcagttgatttgtagcaagatgaatgtatcggttaagtctggtttaggtccattcggtttaatggttttggcatctaagaatttggaagagtacacatctgtttattttagaatcttcaaagcccgtcaaaacagcaataagtacgttgtgctcatgtgcagtgaccaaagcaggtacgtttctttgattaagatcgggattaagtatattaatttttataatcttttgtcacaattcacaaatatttatgtttgttttaaacagtcggtcacaaaagatagatctaaaattgggttccctagaaatatccaaaacttgacttataattttgaggactttttggtgatgtggatttgggacagatcttcgctgaaggaagataatgacaaaacgacatacggagcttttgtggatattaatcctcaccaaccactatccctcagagccttggtaattaagtctcccattttgtattttacgtatatagttttatatattaatttatgttcatatgtaaaaacgcttgcaaatatagggaagaaaaacctcctttttaaaacccatgagagtaattatttaacagcttagcctcttgatcaagactatataatcttcaactatcttgttcaagtattaaggcgaatatttaattgtggatttgttaataaaagtttctgttatttgttgttgttggtgtagattgatcattcagtagtggagagtttcggtggaaagggaagagcatgcattacctcaagagtgtatccaaaattggcaataggaaaaagttcacatctctttgcttttaattatggatatcaaagtgttgatgtcttaaacttaaatgcttggagcatgaactctgcccaaatcagttgatcacgtaaagatacacacatgtaaacacattacatctccattgatttagcatttatatgagttgattttggagagatcttatatggtccactttgtttggttgtcaataaaattgtccaatttgtttgtttgaaataattctaaaaggctaatatatatgacattttatttgacttccttatagtatgacttactattataaaaaggacaattctagagtcggtagtcaaaatcttccaagttccaacgaacgtgataatagtggactttcaatgaatataaacgtaaatatgtatacatgtacatactatatgaaacaaattgagtacgatcttaaagtttggccccccaaaaaataactagtatgtgtatgtataggatcattctatgtaaatcagcacacgtaacttttttctaaaatgcccgacggctatattaccacaagtatgaaattgcccaatatgacgtaacgaacctataacactagcgcctatctatccatagcgatgccaacatgatttattatttattacaacggcgttgggtttacattgttttcatctaaacggcccaccgtttcagcatttaagaccaacaacttcacgtcaacgggtctggtcaactaattaaagcgatcaaaccatctccaccgtccgatactaatccaacttcgtctgtcccgcccaagggcaagcccgtaaatatgttcaccagcaatgatgggagtagcatgtgggacataacattgcatggtagtgttttttccaacagcgcgctaaggctaaatcgttgtcgtttagtaaactgctggctctagatttagaatacgtgcgtgagatgtagccagagcccagagggaagttatggttgaatccggtttgtgtccactttaatttggtgtgtagtgattctcgcctgcacatctctctctttcgaaatattcaagtctcaagcaatagtgatgatatggacatgtaagtagcgaccaaatcaggtgcagtttcatttcattttttgcatttaattttatcagaactcagaagttgaaagtacatattttattaagcaaaaaaaccttctcaaattcagattaatcagaattc

SEQ ID NO: 1722 - protein, 4243 aa, Arabidopsis thaliana
  misc_feature: PFam Name: peroxidase; PFam Description: Peroxidase
  misc_feature: GI Number: 21537275; NR Description: putative peroxidase
  misc_feature: GI Number: 21436133; NR Description: putative peroxidase [Arabidopsis thaliana] >gi|18377686|gb|AAL66993.1| putative peroxidase [Arabidopsis thaliana] >gi|4006918|emb|CAB16848.1| peroxidase like protein [Arabidopsis thaliana]
  misc_feature: GI Number: 4874288; NR Description: putative peroxidase [Arabidopsis thaliana] >gi|27311903|gb|AAO00917.1| putative peroxidase [Arabidopsis thaliana] >gi|19698903|gb|AAL91187.1| putative peroxidase [Arabidopsis thaliana]
  misc_feature: GI Number: 30725302; NR Description: At5g66390 [Arabidopsis thaliana] >gi|10177520|dbj|BAB10915.1| peroxidase [Arabidopsis thaliana] >gi|26397792|sp|Q9FJZ9|PE72_ARATH Peroxidase 72 precursor
GAATTCTTATATTAACTTTTGTTCCTTCAGTTTTATACATATAGTCATATGACATTGAAAAACCAGCACAAACTCCTTCAGTTGATCACCAATAGAAACAACAAAATACAGTATAATATTTCTAATTTTTAGTGAAAATTTACGAATATTGTGGAAACAACTTTTATAGATGTCTGAGTCTGACTTATGTCAGTATTATTTTTTCTTCACTTATAGCAGTATAACATTCATTATTTCACATTAATGCCAAAAAAAAATTAAAAACTTTATTATCAAATATAATATTCAAATCTCGATATTGACAGGTTTGCCCTCGTCCTTTGCCTATAAATTTGACATGATCTACGTTCATTCAAACAAAAACCAAGCCACAAAGAAATTAAATACACACAATGACCAAAGAAGTTTGCTCCAACATTGGACTTTGGTTATTGCTCACGTTACTTATTGGTAACTATGTCGTCAATCTTGAAGCCTCGCACCATGTCTACAAGAGACTTACCCAAAGCACTAACACCAAATCTCCTTCCGTAAACCAGCCCTACCGGACCGGTTTCCATTTCCAACCCCCCAAAAATTGGATGAACGGTATGACCAAAATGCCATATCAACCTCAATCTCAATGTTTGTTATTTTCATTACTCTCTTACCTTTGCTTTTATTTCGTTGTGGTTCGTGCTTGGACAAAATGGATTGATCATTGGTCATGAGCAGATCCTAATGGTTAGTTTTTCTCTCTTTTATCTCCTATCTTTTTAATTTTTTTCTCTTAGTCAACTCTTCAAATCCAATAGACAGATCATTTTCCCTGAAAACTCGTGTTTTTTATTATTTTATAAAACATTGATTACACCAATATATGTCAGCATACAACTGTACATTTGATTATTGTATTGTATTGGTCGACCTTGTGTTACGCTGCAGGATCCTTTTACACTATCCATATACTTAACTAATAAAAATACACATATTTAAAATTTTAATACAGGGCCTATGATATACAAAGGAATATATCATCTTTTCTACCAATGGAACCCGAAAGGAGCCGTGTGGGGTAACATCGTGTGGGCTCATTCCACGTCAACAGACTTAATCAATTGGGATCCACATCCTCCAGCTATCTTCCCATCTGCACCCTTCGATATCAACGGATGCTGGTCCGGTTCAGCTACTATTCTCCCTAATGGAAAACCGGTTATCCTCTATACCGGAATCGACCCTAAGAACCAACAGGTCCAAAACATAGCCGAGCCTAAGAATCTCTCCGATCCTTATCTCCGAGAATGGAAAAAGTCGCCGTTAAATCCTCTCATGGCTCCTGACGCCGTTAACGGAATCAACGCCAGCTCGTTCCGTGACCCAACCACCGCGTGGCTAGGCCAAGACAAGAAATGGAGAGTGATCATCGGAAGCAAGATTCACCGTCGTGGACTAGCCATTACTTACACGAGTAAAGACTTTCTAAAATGGGAAAAATCTCCAGAGCCGTTGCATTACGACGACGGAAGTGGAATGTGGGAATGTCCTGATTTTTTCCCGGTCACGAGGTTTGGTTCTAACGGCGTGGAAACGTCTTCGTTTGGTGAACCTAATGAGATTTTGAAGCACGTGTTGAAAATAAGTTTGGACGACACGAAACATGATTATTACACGATTGGTACGTACGATCGGGTTAAAGATAAATTCGTACCGGACAATGGTTTCAAGATGGACGGTACGGCTCCGAGATACGATTACGGAAAGTATTACGCGTCTAAAACGTTTTTTGACTCGGCTAAGAACCGGAGAATCTTGTGGGGTTGGACTAACGAGTCATCGTCGGTTGAGGATGATGTTGAGAAAGGCTGGTCCGGTATTCAGGTAATTAGTTACGCTTAACTGAAACTAATAATGTGAATATAATTGTTAGAGATTGAATCAATTTTTTGTTTCTTTCTTGATTAGACGATTCCAAGGAAAATATGGCTTGATAGATCAGGGAAACAATTAATTCAGTGGCCGGTTAGGGAAGTTGAAAGATTACGTACAAAACAAGTCAAAAACTTACGCAACAAAGTTCTAAAGTCAGGATCTAGGCTTGAAGTCTATGGTGTGACAGCTGCACAGGTTTGATTATTATCATTTTTTTTTGAAAAATCAGTAGGTATGAGAAAATTAGGGTTTTAAAAGTCTTGTGATTTGTACAGGCGGATGTAGAAGTATTGTTCAAAGTGAGAGACTTGGAGAAAGCGGATGTGATAGAACCAAGTTGGACTGATCCGCAGTTGATTTGTAGCAAGATGAATGTATCGGTTAAGTCTGGTTTAGGTCCATTCGGTTTAATGGTTTTGGCATCTAAGAATTTGGAAGAGTACACATCTGTTTATTTTAGAATCTTCAAAGCCCGTCAAAACAGCAATAAGTACGTTGTGCTCATGTGCAGTGACCAAAGCAGGTACGTTTCTTTGATTAAGATCGGGATTAAGTATATTAATTTTTATAATCTTTTGTCACAATTCACAAATATTTATGTTTGTTTTAAACAGTCGGTCACAAAAGATAGATCTAAAATTGGGTTCCCTAGAAATATCCAAAACTTGACTTATAATTTTGAGGACTTTTTGGTGATGTGGATTTGGGACAGATCTTCGCTGAAGGAAGATAATGACAAAACGACATACGGAGCTTTTGTGGATATTAATCCTCACCAACCACTATCCCTCAGAGCCTTGGTAATTAAGTCTCCCATTTTGTATTTTACGTATATAGTTTTATATATTAATTTATGTTCATATGTAAAAACGCTTGCAAATATAGGGAAGAAAAACCTCCTTTTTAAAACCCATGAGAGTAATTATTTAACAGCTTAGCCTCTTGATCAAGACTATATAATCTTCAACTATCTTGTTCAAGTATTAAGGCGAATATTTAATTGTGGATTTGTTAATAAAAGTTTCTGTTATTTGTTGTTGTTGGTGTAGATTGATCATTCAGTAGTGGAGAGTTTCGGTGGAAAGGGAAGAGCATGCATTACCTCAAGAGTGTATCCAAAATTGGCAATAGGAAAAAGTTCACATCTCTTTGCTTTTAATTATGGATATCAAAGTGTTGATGTCTTAAACTTAAATGCTTGGAGCATGAACTCTGCCCAAATCAGTTGATCACGTAAAGATACACACATGTAAACACATTACATCTCCATTGATTTAGCATTTATATGAGTTGATTTTGGAGAGATCTTATATGGTCCACTTTGTTTGGTTGTCAATAAAATTGTCCAATTTGTTTGTTTGAAATAATTCTAAAAGGCTAATATATATGACATTTTATTTGACTTCCTTATAGTATGACTTACTATTATAAAAAGGACAATTCTAGAGTCGGTAGTCAAAATCTTCCAAGTTCCAACGAACGTGATAATAGTGGACTTTCAATGAATATAAACGTAAATATGTATACATGTACATACTATATGAAACAAATTGAGTACGATCTTAAAGTTTGGCCCCCCAAAAAATAACTAGTATGTGTATGTATAGGATCATTCTATGTAAATCAGCACACGTAACTTTTTTCTAAAATGCCCGACGGCTATATTACCACAAGTATGAAATTGCCCAATATGACGTAACGAACCTATAACACTAGCGCCTATCTATCCATAGCGATGCCAACATGATTTATTATTTATTACAACGGCGTTGGGTTTACATTGTTTTCATCTAAACGGCCCACCGTTTCAGCATTTAAGACCAACAACTTCACGTCAACGGGTCTGGTCAACTAATTAAAGCGATCAAACCATCTCCACCGTCCGATACTAATCCAACTTCGTCTGTCCCGCCCAAGGGCAAGCCCGTAAATATGTTCACCAGCAATGATGGGAGTAGCATGTGGGACATAACATTGCATGGTAGTGTTTTTTCCAACAGCGCGCTAAGGCTAAATCGTTGTCGTTTAGTAAACTGCTGGCTCTAGATTTAGAATACGTGCGTGAGATGTAGCCAGAGCCCAGAGGGAAGTTATGGTTGAATCCGGTTTGTGTCCACTTTAATTTGGTGTGTAGTGATTCTCGCCTGCACATCTCTCTCTTTCGAAATATTCAAGTCTCAAGCAATAGTGATGATATGGACATGTAAGTAGCGACCAAATCAGGTGCAGTTTCATTTCATTTTTTGCATTTAATTTTATCAGAACTCAGAAGTTGAAAGTACATATTTTATTAAGCAAAAAAACCTTCTCAAATTCAGATTAATCAGAATTC

SEQ ID NO: 1723 - DNA, 1357 bp, Arabidopsis thaliana
  misc_feature (1)..(1357): Ceres cDNA ID no. 12674073
  misc_feature (1)..(1357): Also known as  Ceres CDNA ID no. 23481756
atattcactctctcttcttcattagcctttcgtctccttcttctcttctctatctctctttagcttctctacgcaagcttattatctctttctcttaaagctttttctatatacaaacagaagcgtttgatactgtaaaaaagatttagaaatggagactctgagtcgtttattggttttcatgtctctgttttccggtttagtttctggatttgctctgcaaaatcttccaatcacatcttttgaagaaagttacactcaactttttggtgacaagaacttatttgttcatcaagatggcaaatctgtccggttaacgctcgatgaaagaaccggttccggttttgtttcaaatgattattacttgcatggattcttcagtgcttcaattaaattaccttctgattatacagctggagttgttgttgccttttatatgtctaatggagatatgtatgagaagaatcatgatgagatagattttgagtttcttggtaacattagagaaaaagaatggagagttcagacaaacatttacggtaatggaagtactcattcaggaagagaagagagatataatctctggtttgatcctactgaagattttcatcaatacagtatcctctggtctgattctcacatcatattctttgtagacaatgttcctattagagaggtcaaacgtactgcggaaatgggtggtcactttccatcaaagccgatgtctctctacacaacaatatgggacggttctaaatgggcaactaacggtggaaagtacggtgtaaactacaaatatgcgccttacattgcgcggttctcggatctagtcctgcacggctgccccgtggaccctatcgagcagtttccgaggtgcgatgaaggcgcggctgaggatatgcgtgcggcgcaagagattactccttcacaaaggagtaaaatggatgttttcagacggagactcatgacatattcatattgctatgatcgggctaggtacaatgttgctttatcggagtgtgtggtgaatcccgctgaggctcaaaggcttagggtttatgatccggtcagatttggcggcattccgaggcgccaccgcaatggaaagcaccggagcaagagaagccgggttgatggaaccgagtcgatatgataacatatataggcaaaatagtatgggtgagatttgggggttctataataagtccattattttggttatttatgattcaatgcattttcacatatagaggaggcatttttgtcatttgttagttgtatatcattataagaaaagaaaaaataattaatttatttatttgtgatattttttttatatatgataaattgtttcttg

SEQ ID NO: 1724 - protein, 1357 aa, Arabidopsis thaliana
  misc_feature: PFam Name: peroxidase; PFam Description: Peroxidase
  misc_feature: GI Number: 21537275; NR Description: putative peroxidase
  misc_feature: GI Number: 21436133; NR Description: putative peroxidase [Arabidopsis thaliana] >gi|18377686|gb|AAL66993.1| putative peroxidase [Arabidopsis thaliana] >gi|4006918|emb|CAB16848.1| peroxidase like protein [Arabidopsis thaliana]
  misc_feature: GI Number: 4874288; NR Description: putative peroxidase [Arabidopsis thaliana] >gi|27311903|gb|AAO00917.1| putative peroxidase [Arabidopsis thaliana] >gi|19698903|gb|AAL91187.1| putative peroxidase [Arabidopsis thaliana]
  misc_feature: GI Number: 30725302; NR Description: At5g66390 [Arabidopsis thaliana] >gi|10177520|dbj|BAB10915.1| peroxidase [Arabidopsis thaliana] >gi|26397792|sp|Q9FJZ9|PE72_ARATH Peroxidase 72 precursor
ATATTCACTCTCTCTTCTTCATTAGCCTTTCGTCTCCTTCTTCTCTTCTCTATCTCTCTTTAGCTTCTCTACGCAAGCTTATTATCTCTTTCTCTTAAAGCTTTTTCTATATACAAACAGAAGCGTTTGATACTGTAAAAAAGATTTAGAAATGGAGACTCTGAGTCGTTTATTGGTTTTCATGTCTCTGTTTTCCGGTTTAGTTTCTGGATTTGCTCTGCAAAATCTTCCAATCACATCTTTTGAAGAAAGTTACACTCAACTTTTTGGTGACAAGAACTTATTTGTTCATCAAGATGGCAAATCTGTCCGGTTAACGCTCGATGAAAGAACCGGTTCCGGTTTTGTTTCAAATGATTATTACTTGCATGGATTCTTCAGTGCTTCAATTAAATTACCTTCTGATTATACAGCTGGAGTTGTTGTTGCCTTTTATATGTCTAATGGAGATATGTATGAGAAGAATCATGATGAGATAGATTTTGAGTTTCTTGGTAACATTAGAGAAAAAGAATGGAGAGTTCAGACAAACATTTACGGTAATGGAAGTACTCATTCAGGAAGAGAAGAGAGATATAATCTCTGGTTTGATCCTACTGAAGATTTTCATCAATACAGTATCCTCTGGTCTGATTCTCACATCATATTCTTTGTAGACAATGTTCCTATTAGAGAGGTCAAACGTACTGCGGAAATGGGTGGTCACTTTCCATCAAAGCCGATGTCTCTCTACACAACAATATGGGACGGTTCTAAATGGGCAACTAACGGTGGAAAGTACGGTGTAAACTACAAATATGCGCCTTACATTGCGCGGTTCTCGGATCTAGTCCTGCACGGCTGCCCCGTGGACCCTATCGAGCAGTTTCCGAGGTGCGATGAAGGCGCGGCTGAGGATATGCGTGCGGCGCAAGAGATTACTCCTTCACAAAGGAGTAAAATGGATGTTTTCAGACGGAGACTCATGACATATTCATATTGCTATGATCGGGCTAGGTACAATGTTGCTTTATCGGAGTGTGTGGTGAATCCCGCTGAGGCTCAAAGGCTTAGGGTTTATGATCCGGTCAGATTTGGCGGCATTCCGAGGCGCCACCGCAATGGAAAGCACCGGAGCAAGAGAAGCCGGGTTGATGGAACCGAGTCGATATGATAACATATATAGGCAAAATAGTATGGGTGAGATTTGGGGGTTCTATAATAAGTCCATTATTTTGGTTATTTATGATTCAATGCATTTTCACATATAGAGGAGGCATTTTTGTCATTTGTTAGTTGTATATCATTATAAGAAAAGAAAAAATAATTAATTTATTTATTTGTGATATTTTTTTTATATATGATAAATTGTTTCTTG

SEQ ID NO: 1725 - DNA, 1665 bp, Arabidopsis thaliana
  misc_feature (1)..(1665): Ceres cDNA ID no. 12674275
  misc_feature (1)..(1665): Also known as  Ceres CDNA ID no. 23481756
atcacttcaaaatatctttctttccctttccactttttcgcttacactttccccaactcatcatcactctaaaatatctcccaccacataccacttaacccgacccgacccgaccggaaaacccgacccgatccatcccaatgtcaggagctaccaccgcttcctccggagaccacaacaacctccgtctcccaactccgacgcttgacgccgaatcgcaaactctgctgcaatcgatttctgctgaagggggttacgcttatgctcgcatggcggtgttagcggtggccggtgaccaaagcgcggcggaggcggcgcgtgatatggcttgggagcaacttcactctggtccgtggcactcggttctccccgtttggcgcgacgcttactcaatggcttgtctccacgtagctaaaatccatttcgccgccggcgagtttggtgaggcgcttggtgcgcttgatatgggtcttatcatgggaggtatgcttctccgcaaggatcttcatgattctgttttgttggtctcctctgaagctcgtaagatgacgaagagtcttgaagaagcttctggagatttcaaaggtgagagattggtcccggaagttcccgtcgacgtcaatgaggtgagacatgttttggctaatctacaattacttgtccttaagattctaccttgcaggtctttaacttgtaaaagagtagagaagaggtctggtttatctttggaggggtttctgcgtgattattatctgccaggtacaccagttgttataaccaattctatggctcattggccagccaggaccaagtggaatcacttggactacctcaatgctgttgctggtaaccgcaccgttcccgtggaggtggggaaaaactatttgtgttctgattggaagcaagagcttgtgacattttctaagttccttgaacggatgcggaccaataaatcgtctccaatggagcctacttatcttgcccagcatcctttgtttgatcagataaatgaactgagagatgatatatgtattcctgattactgttttgtcggtggtggggaactccaatcacttaatgcatggtttggcccggctgggacagttactccgttacaccatgatccacatcataatatacttgctcaggttgttggcaagaagtatataaggctttacccatccttcctgcaagacgaactttacccttactctgagacaatgctctgcaactctagtcaggttgatctagacaatatcgacgaaaccgagttcccaaaggccatggagttggagtttatggattgtattctagaagaaggtgaaatgttgtacatccctcccaaatggtggcactatgtcaggtccttaacaatgagtctctcggttagcttctggtggagcaatgaagcagaatcttctagctcgtagcgaatggatttatttttaatctctgtttcaggttctaagttcacgttgtgtctttatgtaagaagaaactatgtagagaagaaaacaactgctccgagcatgaagatgtttgtttggtttacgtctatgttgtaaaagacaattgagagctcttggtacagacattttttaggtattggtaatgtttgtctttgtttcaagtaagaaatggtttaatcaaaatctaatcttcaat

SEQ ID NO: 1726 - protein, 1665 aa, Arabidopsis thaliana
  misc_feature: PFam Name: peroxidase; PFam Description: Peroxidase
  misc_feature: GI Number: 21537275; NR Description: putative peroxidase
  misc_feature: GI Number: 21436133; NR Description: putative peroxidase [Arabidopsis thaliana] >gi|18377686|gb|AAL66993.1| putative peroxidase [Arabidopsis thaliana] >gi|4006918|emb|CAB16848.1| peroxidase like protein [Arabidopsis thaliana]
  misc_feature: GI Number: 4874288; NR Description: putative peroxidase [Arabidopsis thaliana] >gi|27311903|gb|AAO00917.1| putative peroxidase [Arabidopsis thaliana] >gi|19698903|gb|AAL91187.1| putative peroxidase [Arabidopsis thaliana]
  misc_feature: GI Number: 30725302; NR Description: At5g66390 [Arabidopsis thaliana] >gi|10177520|dbj|BAB10915.1| peroxidase [Arabidopsis thaliana] >gi|26397792|sp|Q9FJZ9|PE72_ARATH Peroxidase 72 precursor
ATCACTTCAAAATATCTTTCTTTCCCTTTCCACTTTTTCGCTTACACTTTCCCCAACTCATCATCACTCTAAAATATCTCCCACCACATACCACTTAACCCGACCCGACCCGACCGGAAAACCCGACCCGATCCATCCCAATGTCAGGAGCTACCACCGCTTCCTCCGGAGACCACAACAACCTCCGTCTCCCAACTCCGACGCTTGACGCCGAATCGCAAACTCTGCTGCAATCGATTTCTGCTGAAGGGGGTTACGCTTATGCTCGCATGGCGGTGTTAGCGGTGGCCGGTGACCAAAGCGCGGCGGAGGCGGCGCGTGATATGGCTTGGGAGCAACTTCACTCTGGTCCGTGGCACTCGGTTCTCCCCGTTTGGCGCGACGCTTACTCAATGGCTTGTCTCCACGTAGCTAAAATCCATTTCGCCGCCGGCGAGTTTGGTGAGGCGCTTGGTGCGCTTGATATGGGTCTTATCATGGGAGGTATGCTTCTCCGCAAGGATCTTCATGATTCTGTTTTGTTGGTCTCCTCTGAAGCTCGTAAGATGACGAAGAGTCTTGAAGAAGCTTCTGGAGATTTCAAAGGTGAGAGATTGGTCCCGGAAGTTCCCGTCGACGTCAATGAGGTGAGACATGTTTTGGCTAATCTACAATTACTTGTCCTTAAGATTCTACCTTGCAGGTCTTTAACTTGTAAAAGAGTAGAGAAGAGGTCTGGTTTATCTTTGGAGGGGTTTCTGCGTGATTATTATCTGCCAGGTACACCAGTTGTTATAACCAATTCTATGGCTCATTGGCCAGCCAGGACCAAGTGGAATCACTTGGACTACCTCAATGCTGTTGCTGGTAACCGCACCGTTCCCGTGGAGGTGGGGAAAAACTATTTGTGTTCTGATTGGAAGCAAGAGCTTGTGACATTTTCTAAGTTCCTTGAACGGATGCGGACCAATAAATCGTCTCCAATGGAGCCTACTTATCTTGCCCAGCATCCTTTGTTTGATCAGATAAATGAACTGAGAGATGATATATGTATTCCTGATTACTGTTTTGTCGGTGGTGGGGAACTCCAATCACTTAATGCATGGTTTGGCCCGGCTGGGACAGTTACTCCGTTACACCATGATCCACATCATAATATACTTGCTCAGGTTGTTGGCAAGAAGTATATAAGGCTTTACCCATCCTTCCTGCAAGACGAACTTTACCCTTACTCTGAGACAATGCTCTGCAACTCTAGTCAGGTTGATCTAGACAATATCGACGAAACCGAGTTCCCAAAGGCCATGGAGTTGGAGTTTATGGATTGTATTCTAGAAGAAGGTGAAATGTTGTACATCCCTCCCAAATGGTGGCACTATGTCAGGTCCTTAACAATGAGTCTCTCGGTTAGCTTCTGGTGGAGCAATGAAGCAGAATCTTCTAGCTCGTAGCGAATGGATTTATTTTTAATCTCTGTTTCAGGTTCTAAGTTCACGTTGTGTCTTTATGTAAGAAGAAACTATGTAGAGAAGAAAACAACTGCTCCGAGCATGAAGATGTTTGTTTGGTTTACGTCTATGTTGTAAAAGACAATTGAGAGCTCTTGGTACAGACATTTTTTAGGTATTGGTAATGTTTGTCTTTGTTTCAAGTAAGAAATGGTTTAATCAAAATCTAATCTTCAAT

SEQ ID NO: 1727 - DNA, 1187 bp, Arabidopsis thaliana
  misc_feature (1)..(1187): Ceres cDNA ID no. 12674479
  misc_feature (1)..(1187): Ceres CLONE  ID no. 26375
  misc_feature (1)..(1187): Also known as  Ceres CDNA ID no. 23376130
atcttaaaactcccaagtaacaaaaatggctatctcaaagcttattcctactcttgtgctctttgttttgttctcttttgatgttagtgttgctcatccaggtctaggatttggatggggaagtaatagtcccattggaggatctttttactcaaatctttacccacaattttaccagttctcttgtccacaagctgatgagattgttatgacggtgctcgaaaaagccatagctaaagaaccaagaatggcagcatctttactcagacttcacttccacgactgcttcgttcagggctgtgatgcatcaatcttgttggatgatagtgcaaccataagaagtgaaaagaatgctggaccaaacaagaactccgttagagggtttcaagtaatcgacgagatcaaagccaaacttgagcaagcttgtcctcaaactgtctcctgcgccgacattctagctctagctgctcgtggctcaactatactgagtggtggaccatcatgggagcttccactagggaggagagactcgaggaccgctagccttaatggcgcaaacacgaacattcctgcacctaactcaactattcaaaatctcttaaccatgttccaacgtaaaggtttgaacgaagaagaccttgtttccctatcaggaggacatacgattggagtagcgaggtgcacaacgtttaaacaaagactatacaatcaaaacggtaataaccaaccagacgagacgctagagaggtcttactactatggtctcaggtcaatttgtccaccaacaggcggtgacaacaatatttcacctctagacttagcctctcctgcaagattcgacaacacatacttcaagctccttctatggggcaaaggcttattgacatcagatgaagtgcttctcactggcaatgtaggcaagactggtgcattagtgaaagcttatgccgaagacgagagacttttcttccaacaattcgcaaagtcgatggttaacatgggaaacattcagcctcttactggttttaatggtgagatcaggaagagttgtcatgtgattaactaaagaaactgtgtgtttttgcattattattgtattaaggggtgattaagaataagtcgtgttatgtttttcgatatgttagtgatctaattaacgtctttgaatgaaaatggacggttgtttt

SEQ ID NO: 1728 - protein, 1187 aa, Arabidopsis thaliana
  misc_feature: PFam Name: peroxidase; PFam Description: Peroxidase
  misc_feature: GI Number: 21554765; NR Description: peroxidase, putative
  misc_feature: GI Number: 30793970; NR Description: putative peroxidase [Arabidopsis thaliana] >gi|1546700|emb|CAA67336.1| peroxidase; peroxidase ATP18a [Arabidopsis thaliana] >gi|25453202|sp|Q96512|PER9_ARATH Peroxidase 9 precursor (Atperox
  misc_feature: GI Number: 993004; NR Description: PRX [Mercurialis annua]
  misc_feature: GI Number: 14031051; NR Description: peroxidase [Nicotiana tabacum]
  misc_feature: GI Number: 7453855; NR Description: peroxidase prx15
ATCTTAAAACTCCCAAGTAACAAAAATGGCTATCTCAAAGCTTATTCCTACTCTTGTGCTCTTTGTTTTGTTCTCTTTTGATGTTAGTGTTGCTCATCCAGGTCTAGGATTTGGATGGGGAAGTAATAGTCCCATTGGAGGATCTTTTTACTCAAATCTTTACCCACAATTTTACCAGTTCTCTTGTCCACAAGCTGATGAGATTGTTATGACGGTGCTCGAAAAAGCCATAGCTAAAGAACCAAGAATGGCAGCATCTTTACTCAGACTTCACTTCCACGACTGCTTCGTTCAGGGCTGTGATGCATCAATCTTGTTGGATGATAGTGCAACCATAAGAAGTGAAAAGAATGCTGGACCAAACAAGAACTCCGTTAGAGGGTTTCAAGTAATCGACGAGATCAAAGCCAAACTTGAGCAAGCTTGTCCTCAAACTGTCTCCTGCGCCGACATTCTAGCTCTAGCTGCTCGTGGCTCAACTATACTGAGTGGTGGACCATCATGGGAGCTTCCACTAGGGAGGAGAGACTCGAGGACCGCTAGCCTTAATGGCGCAAACACGAACATTCCTGCACCTAACTCAACTATTCAAAATCTCTTAACCATGTTCCAACGTAAAGGTTTGAACGAAGAAGACCTTGTTTCCCTATCAGGAGGACATACGATTGGAGTAGCGAGGTGCACAACGTTTAAACAAAGACTATACAATCAAAACGGTAATAACCAACCAGACGAGACGCTAGAGAGGTCTTACTACTATGGTCTCAGGTCAATTTGTCCACCAACAGGCGGTGACAACAATATTTCACCTCTAGACTTAGCCTCTCCTGCAAGATTCGACAACACATACTTCAAGCTCCTTCTATGGGGCAAAGGCTTATTGACATCAGATGAAGTGCTTCTCACTGGCAATGTAGGCAAGACTGGTGCATTAGTGAAAGCTTATGCCGAAGACGAGAGACTTTTCTTCCAACAATTCGCAAAGTCGATGGTTAACATGGGAAACATTCAGCCTCTTACTGGTTTTAATGGTGAGATCAGGAAGAGTTGTCATGTGATTAACTAAAGAAACTGTGTGTTTTTGCATTATTATTGTATTAAGGGGTGATTAAGAATAAGTCGTGTTATGTTTTTCGATATGTTAGTGATCTAATTAACGTCTTTGAATGAAAATGGACGGTTGTTTT

SEQ ID NO: 1729 - DNA, 789 bp, Arabidopsis thaliana
  misc_feature (1)..(789): Ceres cDNA ID no. 12674935
  misc_feature (1)..(789): Also known as  Ceres CDNA ID no. 23376130
attgcttgcttgttattatgcatccaaaccttaaaaacttgtctcctcagattcaccatcctacaaaacttatcaatctcttcttcatctttcttctgcatcctccaccctaatctctctgcaaattccttcatcttctccttttgttcttcattgatctttgtcctcactctcttcttcttcctcatcatcatcatcatcaaacttttcccatcaacgttttggttacgatgactcagaatcttcttcatatcctcgcttgaagatgaagtcctccgtccaatctcacccgttggatgcattacacgtggcttgtacgagctgttactgctgtaaaacgccggagttatcatcagctgatgatcttgtttactgttcctgtgtccgtacacttctttccggtggaagctccggtgacagttacaggcggcgcattttaaagcaccgagtgtaccttcttctccgccggccatgaactcgcagcatccgtccaccacgtgtcctccggttgaggccgcgtggttcttctgacattcccggtacttagctccttggtcgacacgtgtctttggtttttggttttctttcttgatcgggaataaagccatggatggatctgattcgggtttggcttctggttccggatccgtatgtggctttacttctgttgagatcattgttgtggttgtaattgcattgcattttcctccaagctccattgtgaatctgacccaaaacaacaaaactttgttaaatattaatacttataaatcattcaataatgcatgc

SEQ ID NO: 1730 - protein, 789 aa, Arabidopsis thaliana
  misc_feature: PFam Name: peroxidase; PFam Description: Peroxidase
  misc_feature: GI Number: 21554765; NR Description: peroxidase, putative
  misc_feature: GI Number: 30793970; NR Description: putative peroxidase [Arabidopsis thaliana] >gi|1546700|emb|CAA67336.1| peroxidase; peroxidase ATP18a [Arabidopsis thaliana] >gi|25453202|sp|Q96512|PER9_ARATH Peroxidase 9 precursor (Atperox
  misc_feature: GI Number: 993004; NR Description: PRX [Mercurialis annua]
  misc_feature: GI Number: 14031051; NR Description: peroxidase [Nicotiana tabacum]
  misc_feature: GI Number: 7453855; NR Description: peroxidase prx15
ATTGCTTGCTTGTTATTATGCATCCAAACCTTAAAAACTTGTCTCCTCAGATTCACCATCCTACAAAACTTATCAATCTCTTCTTCATCTTTCTTCTGCATCCTCCACCCTAATCTCTCTGCAAATTCCTTCATCTTCTCCTTTTGTTCTTCATTGATCTTTGTCCTCACTCTCTTCTTCTTCCTCATCATCATCATCATCAAACTTTTCCCATCAACGTTTTGGTTACGATGACTCAGAATCTTCTTCATATCCTCGCTTGAAGATGAAGTCCTCCGTCCAATCTCACCCGTTGGATGCATTACACGTGGCTTGTACGAGCTGTTACTGCTGTAAAACGCCGGAGTTATCATCAGCTGATGATCTTGTTTACTGTTCCTGTGTCCGTACACTTCTTTCCGGTGGAAGCTCCGGTGACAGTTACAGGCGGCGCATTTTAAAGCACCGAGTGTACCTTCTTCTCCGCCGGCCATGAACTCGCAGCATCCGTCCACCACGTGTCCTCCGGTTGAGGCCGCGTGGTTCTTCTGACATTCCCGGTACTTAGCTCCTTGGTCGACACGTGTCTTTGGTTTTTGGTTTTCTTTCTTGATCGGGAATAAAGCCATGGATGGATCTGATTCGGGTTTGGCTTCTGGTTCCGGATCCGTATGTGGCTTTACTTCTGTTGAGATCATTGTTGTGGTTGTAATTGCATTGCATTTTCCTCCAAGCTCCATTGTGAATCTGACCCAAAACAACAAAACTTTGTTAAATATTAATACTTATAAATCATTCAATAATGCATGC

SEQ ID NO: 1731 - DNA, 1409 bp, Arabidopsis thaliana
  misc_feature (1)..(1409): Ceres cDNA ID no. 12675031
  misc_feature (1)..(1409): Ceres CLONE  ID no. 8976
  misc_feature (1)..(1409): Also known as  Ceres CDNA ID no. 23360388
accaaaagcttcttcttcttcttcctctcgtctctaaaaatccttcctttctttctgggttttctcgaatcttcatctctcattcaaacccacaagtccgatctcgcgatccaaacaccatggaagaggttgaagaagaagtgagacgaatcgtcgaacaagttaaagagcttcatgactcttccacatccttcgtctcttcttcttctcaagaagagctttctctccgtaacagagcctccgtcgttgactcatcaatccgccgtcttcattctactcttgcctctgacaaacatctcgatcccaagcttttcgaaaagctagaagaggatctgcaacgagctagatgcatgcttgcagatggagacacttcatcgtttcttccatctaaacctcaaggacgttttgtgagaatgtttttgggacctgtgaatgttagagcttcacgaaaagatatacagcttaaagttaaagaagaatataatagctacagagataggacagctcttctttttcttgttttccctgcaatacttttgacactaagatcttatgtttgggatggatgtttgcctgcattccctgttcagctctaccaggcttggctactgtttctttatgctggtttggttatgcgagagaacattttaagagctaatgggagtgatatccgttcatggtggctttatcatcattattttgcaatggctatgtcccttgtcagtctcacttgggaaatcaaaggtcaaccaaactgcgttcagaagcagaaaggagtgcgtcttttcctccaatgggctatgatgcaaggtgtcgcgatgcttctgcaaaatagatatcagcgccaaagattatacactcgcattgcacttggaaaggctaaaaggatggacgtcgtatggggagaaacggctggagtagatgggcaactattgctattatttcctattttgttcactttacagggctttgaagcatacgtgggattccagttgcttaggacagtgttgatgggggtagtcgctgaatggcaggtattggtttgtggcattcttctggttgtgatggccattggaaacttcataaacacagtagagacactaatggtgaagtcgagattcaaggcgaagatgaagagaagtaaaagcagagcagaactttgattaaacttcctaacttatatgactacacctttatagtttccaactgtggatctttctccccattatttgcttcagtcgataaattttgtttcttggggcaaaagtaacctaagtctgaaaaaaaaaaaaacagggagtgccctttgtttgtgtaaatggaagttgggatttgatagttgattgattaaactgtgttttgtaaacttttcaactaacacttgttcggtttccaatgatcagattttc

SEQ ID NO: 1732 - protein, 1409 aa, Arabidopsis thaliana
  misc_feature: PFam Name: TMPIT; PFam Description: TMPIT-like protein
  misc_feature: GI Number: 50758114; NR Description: PREDICTED: similar to transmembrane protein induced by tumor necrosis factor alpha
  misc_feature: GI Number: 34871732; NR Description: similar to transmembrane
  misc_feature: GI Number: 57870649; NR Description: Transmembrane protein induced by tumor necrosis factor alpha [Rattus norvegicus] gi|58219512|ref|NP_001010945.1| transmembrane protein induced by
  misc_feature: GI Number: 29789387; NR Description: transmembrane protein induced by tumor necrosis factor alpha [Mus musculus] >gi|28436931|gb|AAH46757.1| Transmembrane protein induced by tumor
  misc_feature: GI Number: 58701915; NR Description: Unknown (protein for
ACCAAAAGCTTCTTCTTCTTCTTCCTCTCGTCTCTAAAAATCCTTCCTTTCTTTCTGGGTTTTCTCGAATCTTCATCTCTCATTCAAACCCACAAGTCCGATCTCGCGATCCAAACACCATGGAAGAGGTTGAAGAAGAAGTGAGACGAATCGTCGAACAAGTTAAAGAGCTTCATGACTCTTCCACATCCTTCGTCTCTTCTTCTTCTCAAGAAGAGCTTTCTCTCCGTAACAGAGCCTCCGTCGTTGACTCATCAATCCGCCGTCTTCATTCTACTCTTGCCTCTGACAAACATCTCGATCCCAAGCTTTTCGAAAAGCTAGAAGAGGATCTGCAACGAGCTAGATGCATGCTTGCAGATGGAGACACTTCATCGTTTCTTCCATCTAAACCTCAAGGACGTTTTGTGAGAATGTTTTTGGGACCTGTGAATGTTAGAGCTTCACGAAAAGATATACAGCTTAAAGTTAAAGAAGAATATAATAGCTACAGAGATAGGACAGCTCTTCTTTTTCTTGTTTTCCCTGCAATACTTTTGACACTAAGATCTTATGTTTGGGATGGATGTTTGCCTGCATTCCCTGTTCAGCTCTACCAGGCTTGGCTACTGTTTCTTTATGCTGGTTTGGTTATGCGAGAGAACATTTTAAGAGCTAATGGGAGTGATATCCGTTCATGGTGGCTTTATCATCATTATTTTGCAATGGCTATGTCCCTTGTCAGTCTCACTTGGGAAATCAAAGGTCAACCAAACTGCGTTCAGAAGCAGAAAGGAGTGCGTCTTTTCCTCCAATGGGCTATGATGCAAGGTGTCGCGATGCTTCTGCAAAATAGATATCAGCGCCAAAGATTATACACTCGCATTGCACTTGGAAAGGCTAAAAGGATGGACGTCGTATGGGGAGAAACGGCTGGAGTAGATGGGCAACTATTGCTATTATTTCCTATTTTGTTCACTTTACAGGGCTTTGAAGCATACGTGGGATTCCAGTTGCTTAGGACAGTGTTGATGGGGGTAGTCGCTGAATGGCAGGTATTGGTTTGTGGCATTCTTCTGGTTGTGATGGCCATTGGAAACTTCATAAACACAGTAGAGACACTAATGGTGAAGTCGAGATTCAAGGCGAAGATGAAGAGAAGTAAAAGCAGAGCAGAACTTTGATTAAACTTCCTAACTTATATGACTACACCTTTATAGTTTCCAACTGTGGATCTTTCTCCCCATTATTTGCTTCAGTCGATAAATTTTGTTTCTTGGGGCAAAAGTAACCTAAGTCTGAAAAAAAAAAAAACAGGGAGTGCCCTTTGTTTGTGTAAATGGAAGTTGGGATTTGATAGTTGATTGATTAAACTGTGTTTTGTAAACTTTTCAACTAACACTTGTTCGGTTTCCAATGATCAGATTTTC

SEQ ID NO: 1733 - DNA, 1323 bp, Arabidopsis thaliana
  misc_feature (1)..(1323): Ceres cDNA ID no. 12675270
  misc_feature (1)..(1323): Also known as  Ceres CDNA ID no. 23360388
ataagactcctctccaaatgctaccacacaattcctctatcaaagccgcccaatcctccacccaaaaatggcttatctccggcgagcagccaccgcattggttctcattttccagctccatctctttctctctctctcaaatgcacataacataacccgtcgataactcagcaatgtcctccatcctctctaacggatactcactctaccaaatccgcaacattctctctctccacgtcctggtcgattacttcggcaccaagaaacttcaccagatcaccgacggctccacctccactgcctccatgtttcaatccaccggatccgccaccggaacttctggatacatcaacatcaccgatataaaaggcggtaaagtcgcttttggtgtccaagacgacgatagcaagctcacagctcactacgtcaaatccgtctttgaaaagccttacaacatctctgttcttcacatcagccaagtcttaacctcgccggaagcagaagctcccacggcgagtcccagcgacctcatcctcaccacaatcctcgaaaaacaagggtgcaaagctttctccgacatcttgaagtcaaccggcgccgacaaaacgttccaagataccgtagacggaggcttaacggtgttctgtccctccgacagcgctgtcggtaagttcatgccgaaattcaaatccctttctccggcgaacaagactgcgttagtgctttaccacggcatgccggtttaccagtcgttacaaatgcttagatcaggtaacggcgccgttaacacgttagcgacggaaggtaacaacaagtttgatttcaccgttcaaaatgacggagaagacgtgacgctggagacggacgttgtgacggcgaaggtaatggggacgttaaaggatcaagagccattgatagtttacaagatcgataaagtgttgttgcctagagaaatctacaaggccgttaagacgtccgctccagctcctaagtcgagtaagaaaaagcctaagaacgcggaggctgacgccgacggacctagcgccgatgctccgtcagatgatgatgttgaggtggctgacgataaaaacggcgccgtatcagcgatgattactcgaacaagtaatgtcgtaacggccattgtcgggctctgtttcggagtttggcttatgtgaagtgacgtggcatttacctcgctttgggaatcttgttttcctttttctttgtgatctgtcggtttaatttattttacatattcttttttttgttcacgttgatacttggtgtggagatttggaataattaattgttccacttgtgttg

SEQ ID NO: 1734 - protein, 1323 aa, Arabidopsis thaliana
  misc_feature: PFam Name: TMPIT; PFam Description: TMPIT-like protein
  misc_feature: GI Number: 50758114; NR Description: PREDICTED: similar to transmembrane protein induced by tumor necrosis factor alpha
  misc_feature: GI Number: 34871732; NR Description: similar to transmembrane
  misc_feature: GI Number: 57870649; NR Description: Transmembrane protein induced by tumor necrosis factor alpha [Rattus norvegicus] gi|58219512|ref|NP_001010945.1| transmembrane protein induced by
  misc_feature: GI Number: 29789387; NR Description: transmembrane protein induced by tumor necrosis factor alpha [Mus musculus] >gi|28436931|gb|AAH46757.1| Transmembrane protein induced by tumor
  misc_feature: GI Number: 58701915; NR Description: Unknown (protein for
ATAAGACTCCTCTCCAAATGCTACCACACAATTCCTCTATCAAAGCCGCCCAATCCTCCACCCAAAAATGGCTTATCTCCGGCGAGCAGCCACCGCATTGGTTCTCATTTTCCAGCTCCATCTCTTTCTCTCTCTCTCAAATGCACATAACATAACCCGTCGATAACTCAGCAATGTCCTCCATCCTCTCTAACGGATACTCACTCTACCAAATCCGCAACATTCTCTCTCTCCACGTCCTGGTCGATTACTTCGGCACCAAGAAACTTCACCAGATCACCGACGGCTCCACCTCCACTGCCTCCATGTTTCAATCCACCGGATCCGCCACCGGAACTTCTGGATACATCAACATCACCGATATAAAAGGCGGTAAAGTCGCTTTTGGTGTCCAAGACGACGATAGCAAGCTCACAGCTCACTACGTCAAATCCGTCTTTGAAAAGCCTTACAACATCTCTGTTCTTCACATCAGCCAAGTCTTAACCTCGCCGGAAGCAGAAGCTCCCACGGCGAGTCCCAGCGACCTCATCCTCACCACAATCCTCGAAAAACAAGGGTGCAAAGCTTTCTCCGACATCTTGAAGTCAACCGGCGCCGACAAAACGTTCCAAGATACCGTAGACGGAGGCTTAACGGTGTTCTGTCCCTCCGACAGCGCTGTCGGTAAGTTCATGCCGAAATTCAAATCCCTTTCTCCGGCGAACAAGACTGCGTTAGTGCTTTACCACGGCATGCCGGTTTACCAGTCGTTACAAATGCTTAGATCAGGTAACGGCGCCGTTAACACGTTAGCGACGGAAGGTAACAACAAGTTTGATTTCACCGTTCAAAATGACGGAGAAGACGTGACGCTGGAGACGGACGTTGTGACGGCGAAGGTAATGGGGACGTTAAAGGATCAAGAGCCATTGATAGTTTACAAGATCGATAAAGTGTTGTTGCCTAGAGAAATCTACAAGGCCGTTAAGACGTCCGCTCCAGCTCCTAAGTCGAGTAAGAAAAAGCCTAAGAACGCGGAGGCTGACGCCGACGGACCTAGCGCCGATGCTCCGTCAGATGATGATGTTGAGGTGGCTGACGATAAAAACGGCGCCGTATCAGCGATGATTACTCGAACAAGTAATGTCGTAACGGCCATTGTCGGGCTCTGTTTCGGAGTTTGGCTTATGTGAAGTGACGTGGCATTTACCTCGCTTTGGGAATCTTGTTTTCCTTTTTCTTTGTGATCTGTCGGTTTAATTTATTTTACATATTCTTTTTTTTGTTCACGTTGATACTTGGTGTGGAGATTTGGAATAATTAATTGTTCCACTTGTGTTG

SEQ ID NO: 1735 - DNA, 1292 bp, Arabidopsis thaliana
  misc_feature (1)..(1292): Ceres cDNA ID no. 12675281
  misc_feature (1)..(1292): Also known as  Ceres CDNA ID no. 23360388
tctgaaagttcttaagtggttccacgatgtttccattttgttctgacttccgaggccaacgagatgagtccaataaacaaagggcacggaaacattctttttaaattaggtttgtttttttatttttggtttttggtttttcccggaaattgtatgaagtcttcgttacagtttctctctctcaccttctctgtataaagtcttcttgagatcgaaggataacttcaattcaattctctccaaggtacacacagctgatttttgtgataagaagattgattgagatgggtactagagctcagcagattcctttacttgaaggtgagactgataattacgatggtgttactgtaaccatggtggaacctatggattctgaggtttttactgaaagtcttagggcttctctttcgcattggagagaagaggggaagaagggaatttggataaagctgcctcttggattggctaatcttgtggaggctgcagttagtgaaggatttagatatcaccacgcggagcctgagtacttgatgcttgtatcttggatctctgaaactcctgatacaatcccagccaatgcttctcatgttgtaggtgctggtgctttggtcatcaacaaaaatactaaagaggtcctcgttgtccaggagaggagtgggtttttcaaagataaaaatgtgtggaagctgcctactggtgttatcaacgagggcgaggatatatggactggagtagctagggaagtggaagaagaaactggaattattgcagattttgtcgaagtactggctttcaggcaaagccacaaagccatcttaaaaaagaaaacagatatgtttttcctgtgtgtcttaagtccgcgctcttacgatattactgaacaaaaatctgagatcttgcaagctaagtggatgccgatccaagagtatgtagaccaaccatggaacaagaagaacgagatgttcaagttcatggctaacatttgccaaaagaagtgtgaggaagaatacttgggattcgccattgtgccaactaccacatcatctggtaaagagagctttatctactgcaatgcggatcatgccaagcgccttaaagtatcgcgtgaccaagcctctgcttctctctgaaaacattctcatctgattctgtttgatctcggcatgtgtgtgtccagtgtgtacaaaacaggaaactttcttctatattattccgattctacaaaattgcgtctaaatatttaagtttataccatctctatgagccactgtaaaacttgccatcgactt

SEQ ID NO: 1736 - protein, 1292 aa, Arabidopsis thaliana
  misc_feature: PFam Name: TMPIT; PFam Description: TMPIT-like protein
  misc_feature: GI Number: 50758114; NR Description: PREDICTED: similar to transmembrane protein induced by tumor necrosis factor alpha
  misc_feature: GI Number: 34871732; NR Description: similar to transmembrane
  misc_feature: GI Number: 57870649; NR Description: Transmembrane protein induced by tumor necrosis factor alpha [Rattus norvegicus] gi|58219512|ref|NP_001010945.1| transmembrane protein induced by
  misc_feature: GI Number: 29789387; NR Description: transmembrane protein induced by tumor necrosis factor alpha [Mus musculus] >gi|28436931|gb|AAH46757.1| Transmembrane protein induced by tumor
  misc_feature: GI Number: 58701915; NR Description: Unknown (protein for
TCTGAAAGTTCTTAAGTGGTTCCACGATGTTTCCATTTTGTTCTGACTTCCGAGGCCAACGAGATGAGTCCAATAAACAAAGGGCACGGAAACATTCTTTTTAAATTAGGTTTGTTTTTTTATTTTTGGTTTTTGGTTTTTCCCGGAAATTGTATGAAGTCTTCGTTACAGTTTCTCTCTCTCACCTTCTCTGTATAAAGTCTTCTTGAGATCGAAGGATAACTTCAATTCAATTCTCTCCAAGGTACACACAGCTGATTTTTGTGATAAGAAGATTGATTGAGATGGGTACTAGAGCTCAGCAGATTCCTTTACTTGAAGGTGAGACTGATAATTACGATGGTGTTACTGTAACCATGGTGGAACCTATGGATTCTGAGGTTTTTACTGAAAGTCTTAGGGCTTCTCTTTCGCATTGGAGAGAAGAGGGGAAGAAGGGAATTTGGATAAAGCTGCCTCTTGGATTGGCTAATCTTGTGGAGGCTGCAGTTAGTGAAGGATTTAGATATCACCACGCGGAGCCTGAGTACTTGATGCTTGTATCTTGGATCTCTGAAACTCCTGATACAATCCCAGCCAATGCTTCTCATGTTGTAGGTGCTGGTGCTTTGGTCATCAACAAAAATACTAAAGAGGTCCTCGTTGTCCAGGAGAGGAGTGGGTTTTTCAAAGATAAAAATGTGTGGAAGCTGCCTACTGGTGTTATCAACGAGGGCGAGGATATATGGACTGGAGTAGCTAGGGAAGTGGAAGAAGAAACTGGAATTATTGCAGATTTTGTCGAAGTACTGGCTTTCAGGCAAAGCCACAAAGCCATCTTAAAAAAGAAAACAGATATGTTTTTCCTGTGTGTCTTAAGTCCGCGCTCTTACGATATTACTGAACAAAAATCTGAGATCTTGCAAGCTAAGTGGATGCCGATCCAAGAGTATGTAGACCAACCATGGAACAAGAAGAACGAGATGTTCAAGTTCATGGCTAACATTTGCCAAAAGAAGTGTGAGGAAGAATACTTGGGATTCGCCATTGTGCCAACTACCACATCATCTGGTAAAGAGAGCTTTATCTACTGCAATGCGGATCATGCCAAGCGCCTTAAAGTATCGCGTGACCAAGCCTCTGCTTCTCTCTGAAAACATTCTCATCTGATTCTGTTTGATCTCGGCATGTGTGTGTCCAGTGTGTACAAAACAGGAAACTTTCTTCTATATTATTCCGATTCTACAAAATTGCGTCTAAATATTTAAGTTTATACCATCTCTATGAGCCACTGTAAAACTTGCCATCGACTT

SEQ ID NO: 1737 - DNA, 1379 bp, Arabidopsis thaliana
  misc_feature (1)..(1379): Ceres cDNA ID no. 12677331
  misc_feature (1)..(1379): Also known as  Ceres CDNA ID no. 23360388
atcacggaaaatgtcaagcagagaaaaccctagcggaatctgcaaaagcattcccaagctcatctcttccttcgtcgacactttcgttgattactccgtctccggcatcttcctgccccaagatcctagctcacaaaatgagattctgcaaacgaggttcgagaagccggagcgactcgttgcaatcggtgatctccatggcgatctcgagaagtctagagaagcattcaagatcgctggtctgattgattcgtcggacagatggactggtggatcaacgatggttgttcaggtgggcgacgtactagatcgaggtggagaggagttgaagatactttatttcttagagaaattgaaacgagaggctgagagagctggaggtaagattctgactatgaatgggaaccatgagatcatgaatatagaaggtgactttagatatgtgactaagaaaggtttagaggaatttcagatttgggctgattggtattgtttagggaacaagatgaagactttatgcagtggtcttgataaacctaaggatccttacgaagggattccgatgagcttccctcgtatgagagccgactgttttgaaggaattagagctaggattgctgcattgagacctgatggtccgattgcaaagagattcttgactaagaatcaaacagttgctgttgttggtgattcggtttttgttcacggtggtcttttagctgagcatatagagtatggactggagaggattaacgaggaggttcggggttggattaacgggtttaaaggaggaagatatgcgcctgcttattgtagaggagggaactctgtagtttggttgaggaagttctcggaagaaatggctcacaaatgtgattgtgcagctcttgagcatgctctttccactattcccggggttaagaggatgatcatgggacatacaatccaggatgctggtatcaacggtgtttgtaatgataaagccattaggattgatgttggcatgtccaagggatgtgctgatggattgcctgaggttttggagatccgcagggactccggtgtacggatagtgacatcgaatccattgtataaggagaatctgtattctcatgtagctcctgatagtaaaacgggtctcgggttactggtaccagttcctaagcaagttgaagtcaaagcttgaagacttttcgttgatactctctgtttagatgattgatgccttttgcaagtctagcattggcggattcttagcatgaccaaccataaacatcttcttggcgcataaattgtagtttttatcattaaaacgatagataatgtttgtagcaatatggaacattatttcttattcaatataattgttcaaggtctct

SEQ ID NO: 1738 - protein, 1379 aa, Arabidopsis thaliana
  misc_feature: PFam Name: TMPIT; PFam Description: TMPIT-like protein
  misc_feature: GI Number: 50758114; NR Description: PREDICTED: similar to transmembrane protein induced by tumor necrosis factor alpha
  misc_feature: GI Number: 34871732; NR Description: similar to transmembrane
  misc_feature: GI Number: 57870649; NR Description: Transmembrane protein induced by tumor necrosis factor alpha [Rattus norvegicus] gi|58219512|ref|NP_001010945.1| transmembrane protein induced by
  misc_feature: GI Number: 29789387; NR Description: transmembrane protein induced by tumor necrosis factor alpha [Mus musculus] >gi|28436931|gb|AAH46757.1| Transmembrane protein induced by tumor
  misc_feature: GI Number: 58701915; NR Description: Unknown (protein for
ATCACGGAAAATGTCAAGCAGAGAAAACCCTAGCGGAATCTGCAAAAGCATTCCCAAGCTCATCTCTTCCTTCGTCGACACTTTCGTTGATTACTCCGTCTCCGGCATCTTCCTGCCCCAAGATCCTAGCTCACAAAATGAGATTCTGCAAACGAGGTTCGAGAAGCCGGAGCGACTCGTTGCAATCGGTGATCTCCATGGCGATCTCGAGAAGTCTAGAGAAGCATTCAAGATCGCTGGTCTGATTGATTCGTCGGACAGATGGACTGGTGGATCAACGATGGTTGTTCAGGTGGGCGACGTACTAGATCGAGGTGGAGAGGAGTTGAAGATACTTTATTTCTTAGAGAAATTGAAACGAGAGGCTGAGAGAGCTGGAGGTAAGATTCTGACTATGAATGGGAACCATGAGATCATGAATATAGAAGGTGACTTTAGATATGTGACTAAGAAAGGTTTAGAGGAATTTCAGATTTGGGCTGATTGGTATTGTTTAGGGAACAAGATGAAGACTTTATGCAGTGGTCTTGATAAACCTAAGGATCCTTACGAAGGGATTCCGATGAGCTTCCCTCGTATGAGAGCCGACTGTTTTGAAGGAATTAGAGCTAGGATTGCTGCATTGAGACCTGATGGTCCGATTGCAAAGAGATTCTTGACTAAGAATCAAACAGTTGCTGTTGTTGGTGATTCGGTTTTTGTTCACGGTGGTCTTTTAGCTGAGCATATAGAGTATGGACTGGAGAGGATTAACGAGGAGGTTCGGGGTTGGATTAACGGGTTTAAAGGAGGAAGATATGCGCCTGCTTATTGTAGAGGAGGGAACTCTGTAGTTTGGTTGAGGAAGTTCTCGGAAGAAATGGCTCACAAATGTGATTGTGCAGCTCTTGAGCATGCTCTTTCCACTATTCCCGGGGTTAAGAGGATGATCATGGGACATACAATCCAGGATGCTGGTATCAACGGTGTTTGTAATGATAAAGCCATTAGGATTGATGTTGGCATGTCCAAGGGATGTGCTGATGGATTGCCTGAGGTTTTGGAGATCCGCAGGGACTCCGGTGTACGGATAGTGACATCGAATCCATTGTATAAGGAGAATCTGTATTCTCATGTAGCTCCTGATAGTAAAACGGGTCTCGGGTTACTGGTACCAGTTCCTAAGCAAGTTGAAGTCAAAGCTTGAAGACTTTTCGTTGATACTCTCTGTTTAGATGATTGATGCCTTTTGCAAGTCTAGCATTGGCGGATTCTTAGCATGACCAACCATAAACATCTTCTTGGCGCATAAATTGTAGTTTTTATCATTAAAACGATAGATAATGTTTGTAGCAATATGGAACATTATTTCTTATTCAATATAATTGTTCAAGGTCTCT

SEQ ID NO: 1739 - DNA, 2384 bp, Arabidopsis thaliana
  misc_feature (1)..(2384): Ceres cDNA ID no. 12677907
  misc_feature (1)..(2384): Also known as  Ceres CDNA ID no. 23360388
accctatataaacatatccaaaaaccgcaagaaagctcacaagaaatctcctcccatggcagattcaagttcttctctccctcctctttgcgagaagatctcatacaaaaactattttctaagagttgtggatctcacgattctaggctttctcttttctcttctcttgtaccgaattctacttatgaaccaaaacaactccgtttgggttgtggctttcctctgtgaatcctttttctctttcatatggcttcttattaccagcataaaatggagtcctgcttcatataaatcatatcctgaaagacttgatgaaagggttcatgaccttccatcggtagatatgtttgtgactactgcggatcctgttcgggagccgccgattcttgtagcaaacacgttgctttcgctgttagcagtgaattatccagcgaataaacttgcttgttatgtatcggatgatggatgctcacctctcacttacttctctctcaaggaagcttctaagttcgccaagatttgggttcccttctgcaaaaaatataacattaaagttagagctccttttagatattttttgaaccctccagccgcaacagaaagttctgaattcagtaaagactgggaaataaccaagagggagtacgagaaattaagcaggagggtggaagatgccactggagattcccattggttggatgcagaagatgactttgaagatttctcgaatacaaaaccaaatgatcattcaactatagtaaaggtggtatgggagaacaagggaggtgtcggagtcgagaacgaggttcctcattttgtatacatttcaagagagaaaagaccaaattatcttcatcattacaaagctggagccatgaactttctggtaagagtgtcagggttgatgacaaatgcaccatacatgttgaacgtagactgtgacatgtatgctaatgaagcagatgtggtgcgccaagcaatgtgtatatttctacaaaaatcaatgaattcaaaccattgtgcttttgttcaattccctcaagagttctatgattctaacgccgacgaactcaccgtcttacaatcatatttgggacgaggaattgcgggaatccaaggacctacatatgcaggttcaggatgcttccacactagaagagttatgtacggtctatcaatagatgatttagaagatgatggaagtctttcttcacttgcaacaaggaagtatttggctgaagagaatttagctagagaatttgggaactctaacgagatggtgacatcggtggtcgaggcattacaaagaaaaccaaatccgcaaaatacccttgcaaactccctcgaagcggctcaagaagtgggacattgtcattttgagtaccaaactagctggggcaaaactattggttggttatacgaatcaacagcggaagatgcaaacacgagtatcggaatccattcgagagggtggactagctcatatatatctccgaaaccaccagcgtttcttggggctatgccaccgggaggtccggaagcgatgctccagcagcggcgatgggccacaggactgctcgaagtccttttcaacaaacaaagtccgttgatcggaatgttttgtaggaaaataagatttcgacaaagcttggcttatttatacattttcacttggggtctaaggtcaatccctgagcttatttattgtctcttgcctgcttattgcctactccacaacgctgccttatttcccaagggagtttatttaggtatagtcgtcacacttgtgggaatgcattgtctttactctctatgggaatttatgagccttggtttctcagtacaatcgtggtttgcctcccaatcattttggaggataaaaaccacttgcagttggttatttagcatccctgatatcatactcaagctacttggaatctcgaaaactgttttcatagtcactaaaaagactatgcccaagacaatgtcaggatctggatccgaaaaatctcaacgagaagttgattgtccaaaccaagattccggtaaatttgaatttgatggctcgctttatttcttgcctggcacatttatccttttagtgaatctagccgctctagccggttgttcggtgggtctacaacgtcacagaggaggtggttcgggtttagcagaagcttgtggatgtattttggtggttatattgtttcttccatttctaaagggtatgtttgagaagggaaaatatggtatcccatggtctactctttctaaagctgcctttttagcagttttatttgttgttttctctgtgggaaactagtatactgatatggctttaatttgtagctaaaaactgctaatatgaaaataattattctcta

SEQ ID NO: 1740 - protein, 2384 aa, Arabidopsis thaliana
  misc_feature: PFam Name: TMPIT; PFam Description: TMPIT-like protein
  misc_feature: GI Number: 50758114; NR Description: PREDICTED: similar to transmembrane protein induced by tumor necrosis factor alpha
  misc_feature: GI Number: 34871732; NR Description: similar to transmembrane
  misc_feature: GI Number: 57870649; NR Description: Transmembrane protein induced by tumor necrosis factor alpha [Rattus norvegicus] gi|58219512|ref|NP_001010945.1| transmembrane protein induced by
  misc_feature: GI Number: 29789387; NR Description: transmembrane protein induced by tumor necrosis factor alpha [Mus musculus] >gi|28436931|gb|AAH46757.1| Transmembrane protein induced by tumor
  misc_feature: GI Number: 58701915; NR Description: Unknown (protein for
ACCCTATATAAACATATCCAAAAACCGCAAGAAAGCTCACAAGAAATCTCCTCCCATGGCAGATTCAAGTTCTTCTCTCCCTCCTCTTTGCGAGAAGATCTCATACAAAAACTATTTTCTAAGAGTTGTGGATCTCACGATTCTAGGCTTTCTCTTTTCTCTTCTCTTGTACCGAATTCTACTTATGAACCAAAACAACTCCGTTTGGGTTGTGGCTTTCCTCTGTGAATCCTTTTTCTCTTTCATATGGCTTCTTATTACCAGCATAAAATGGAGTCCTGCTTCATATAAATCATATCCTGAAAGACTTGATGAAAGGGTTCATGACCTTCCATCGGTAGATATGTTTGTGACTACTGCGGATCCTGTTCGGGAGCCGCCGATTCTTGTAGCAAACACGTTGCTTTCGCTGTTAGCAGTGAATTATCCAGCGAATAAACTTGCTTGTTATGTATCGGATGATGGATGCTCACCTCTCACTTACTTCTCTCTCAAGGAAGCTTCTAAGTTCGCCAAGATTTGGGTTCCCTTCTGCAAAAAATATAACATTAAAGTTAGAGCTCCTTTTAGATATTTTTTGAACCCTCCAGCCGCAACAGAAAGTTCTGAATTCAGTAAAGACTGGGAAATAACCAAGAGGGAGTACGAGAAATTAAGCAGGAGGGTGGAAGATGCCACTGGAGATTCCCATTGGTTGGATGCAGAAGATGACTTTGAAGATTTCTCGAATACAAAACCAAATGATCATTCAACTATAGTAAAGGTGGTATGGGAGAACAAGGGAGGTGTCGGAGTCGAGAACGAGGTTCCTCATTTTGTATACATTTCAAGAGAGAAAAGACCAAATTATCTTCATCATTACAAAGCTGGAGCCATGAACTTTCTGGTAAGAGTGTCAGGGTTGATGACAAATGCACCATACATGTTGAACGTAGACTGTGACATGTATGCTAATGAAGCAGATGTGGTGCGCCAAGCAATGTGTATATTTCTACAAAAATCAATGAATTCAAACCATTGTGCTTTTGTTCAATTCCCTCAAGAGTTCTATGATTCTAACGCCGACGAACTCACCGTCTTACAATCATATTTGGGACGAGGAATTGCGGGAATCCAAGGACCTACATATGCAGGTTCAGGATGCTTCCACACTAGAAGAGTTATGTACGGTCTATCAATAGATGATTTAGAAGATGATGGAAGTCTTTCTTCACTTGCAACAAGGAAGTATTTGGCTGAAGAGAATTTAGCTAGAGAATTTGGGAACTCTAACGAGATGGTGACATCGGTGGTCGAGGCATTACAAAGAAAACCAAATCCGCAAAATACCCTTGCAAACTCCCTCGAAGCGGCTCAAGAAGTGGGACATTGTCATTTTGAGTACCAAACTAGCTGGGGCAAAACTATTGGTTGGTTATACGAATCAACAGCGGAAGATGCAAACACGAGTATCGGAATCCATTCGAGAGGGTGGACTAGCTCATATATATCTCCGAAACCACCAGCGTTTCTTGGGGCTATGCCACCGGGAGGTCCGGAAGCGATGCTCCAGCAGCGGCGATGGGCCACAGGACTGCTCGAAGTCCTTTTCAACAAACAAAGTCCGTTGATCGGAATGTTTTGTAGGAAAATAAGATTTCGACAAAGCTTGGCTTATTTATACATTTTCACTTGGGGTCTAAGGTCAATCCCTGAGCTTATTTATTGTCTCTTGCCTGCTTATTGCCTACTCCACAACGCTGCCTTATTTCCCAAGGGAGTTTATTTAGGTATAGTCGTCACACTTGTGGGAATGCATTGTCTTTACTCTCTATGGGAATTTATGAGCCTTGGTTTCTCAGTACAATCGTGGTTTGCCTCCCAATCATTTTGGAGGATAAAAACCACTTGCAGTTGGTTATTTAGCATCCCTGATATCATACTCAAGCTACTTGGAATCTCGAAAACTGTTTTCATAGTCACTAAAAAGACTATGCCCAAGACAATGTCAGGATCTGGATCCGAAAAATCTCAACGAGAAGTTGATTGTCCAAACCAAGATTCCGGTAAATTTGAATTTGATGGCTCGCTTTATTTCTTGCCTGGCACATTTATCCTTTTAGTGAATCTAGCCGCTCTAGCCGGTTGTTCGGTGGGTCTACAACGTCACAGAGGAGGTGGTTCGGGTTTAGCAGAAGCTTGTGGATGTATTTTGGTGGTTATATTGTTTCTTCCATTTCTAAAGGGTATGTTTGAGAAGGGAAAATATGGTATCCCATGGTCTACTCTTTCTAAAGCTGCCTTTTTAGCAGTTTTATTTGTTGTTTTCTCTGTGGGAAACTAGTATACTGATATGGCTTTAATTTGTAGCTAAAAACTGCTAATATGAAAATAATTATTCTCTA

SEQ ID NO: 1741 - DNA, 1934 bp, Arabidopsis thaliana
  misc_feature (1)..(1934): Ceres cDNA ID no. 12678032
  misc_feature (1)..(1934): Also known as  Ceres CDNA ID no. 23360388
atagtgtcgtacacaatcacaatttccatcgtcagcaaaaccaaaatcgtgaggcctataatttcccttcatctccaaaatcatttctcctcaaatttcttctttagaagattaaaaatcttctctctaatctctccactctttcataaatattttcctaattcttctaccttggtgtctgattctagcaccaaaccattttctcctaccaaaatctgggtttcgatcaattttaggtcttttgattcctacttgtctaatcgtcttgcaatttcaaagatgacagttgttggagatgttgctccaattccaaggaggaacagttctacttgctctaatgatatcgctgctccgttattaccagagtgtcatggagatgaagttgctcatgatgaattcaatggagcttcttttagtggcgcggtttttaacctcgccacgactataattggtgctggtatcatggctttgcctgctacaatgaagattcttggacttggacttggaatcacgatgattgttgttatggctttcttgactgatgcgtcgattgagttcttgcttaggtttagtaaagctgggaagaatcgatcttacggtggtttaatgggtggttcttttggtaatcctggaaggattttgcttcaagtcgcggttttagttaataacatcggtgttttgattgtatacatgatcattataggtgatgtgttggctggaaagacggaagatggtatccatcatttcggtgttctcgaaggatggtttggtcaccattggtggaatggaagagctgctattcttctgattactactcttggtgtgtttgctccattggcttgcttcaagcgaatcgattctttgaaatttacatcggccttatccgtggctctggcggttgtgtttctcattattactgcgggaatttcaattatgaagttgatcagtggcggtgtggcgatgccaagattgttaccagatgttactgacttaacatctttctggaatctcttcacagtcgtacctgttcttgtcacagcattcatttgccattacaatgttcacagtatacagaacgagctcgaagacccctctcagataagacctgttgttcgatcagcacttatgctctgctcatctgtttacataatgacaagtattttcgggttcctcttgtttggtgatgatactcttgatgatgtccttgcaaactttgacactgatcttggaatcccttttggttctatccttaatgatgcggttcgagttagctacgcgcttcatttgatgctcgtgttcccgattgttttctaccctcttcggattaacattgacgggctcttgttcccttccgctcgatcattatctacctcaaatgtgaggttcggttgcctcactgccggtctcatctctgtaatcttcttgggtgcaaacttcatcccaagcatttgggatgctttccaattcactggagcaaccgccgctgtttgtctcggcttcatcttcccagcttctatcatactaaaggatcgtcatgacaaagcaacaaacagggacacaaccttagctattttcatgattgttcttgcggtattgtccaatgcaatcgccatttacagcgatgcttatgcgctattcaagaagaacgctcctcgtgagtaaatcccggtatgagaaaatgtgcagtttggtgtttagcttttgctttttcttctatgtgaaatcaaataatgaagaagacaagacttctcttctcttatatgtttgtacttttgtcgttgagtgttctaagcggacttttgcttcggtgttatataccaccatgagtgttgtttgtaaaaaaactctgtataaaaattgtaatgcagatacatattttgccttttcatgactcttagctattgcttcatatctatatacatatttggttttaa

SEQ ID NO: 1742 - protein, 1934 aa, Arabidopsis thaliana
  misc_feature: PFam Name: TMPIT; PFam Description: TMPIT-like protein
  misc_feature: GI Number: 50758114; NR Description: PREDICTED: similar to transmembrane protein induced by tumor necrosis factor alpha
  misc_feature: GI Number: 34871732; NR Description: similar to transmembrane
  misc_feature: GI Number: 57870649; NR Description: Transmembrane protein induced by tumor necrosis factor alpha [Rattus norvegicus] gi|58219512|ref|NP_001010945.1| transmembrane protein induced by
  misc_feature: GI Number: 29789387; NR Description: transmembrane protein induced by tumor necrosis factor alpha [Mus musculus] >gi|28436931|gb|AAH46757.1| Transmembrane protein induced by tumor
  misc_feature: GI Number: 58701915; NR Description: Unknown (protein for
ATAGTGTCGTACACAATCACAATTTCCATCGTCAGCAAAACCAAAATCGTGAGGCCTATAATTTCCCTTCATCTCCAAAATCATTTCTCCTCAAATTTCTTCTTTAGAAGATTAAAAATCTTCTCTCTAATCTCTCCACTCTTTCATAAATATTTTCCTAATTCTTCTACCTTGGTGTCTGATTCTAGCACCAAACCATTTTCTCCTACCAAAATCTGGGTTTCGATCAATTTTAGGTCTTTTGATTCCTACTTGTCTAATCGTCTTGCAATTTCAAAGATGACAGTTGTTGGAGATGTTGCTCCAATTCCAAGGAGGAACAGTTCTACTTGCTCTAATGATATCGCTGCTCCGTTATTACCAGAGTGTCATGGAGATGAAGTTGCTCATGATGAATTCAATGGAGCTTCTTTTAGTGGCGCGGTTTTTAACCTCGCCACGACTATAATTGGTGCTGGTATCATGGCTTTGCCTGCTACAATGAAGATTCTTGGACTTGGACTTGGAATCACGATGATTGTTGTTATGGCTTTCTTGACTGATGCGTCGATTGAGTTCTTGCTTAGGTTTAGTAAAGCTGGGAAGAATCGATCTTACGGTGGTTTAATGGGTGGTTCTTTTGGTAATCCTGGAAGGATTTTGCTTCAAGTCGCGGTTTTAGTTAATAACATCGGTGTTTTGATTGTATACATGATCATTATAGGTGATGTGTTGGCTGGAAAGACGGAAGATGGTATCCATCATTTCGGTGTTCTCGAAGGATGGTTTGGTCACCATTGGTGGAATGGAAGAGCTGCTATTCTTCTGATTACTACTCTTGGTGTGTTTGCTCCATTGGCTTGCTTCAAGCGAATCGATTCTTTGAAATTTACATCGGCCTTATCCGTGGCTCTGGCGGTTGTGTTTCTCATTATTACTGCGGGAATTTCAATTATGAAGTTGATCAGTGGCGGTGTGGCGATGCCAAGATTGTTACCAGATGTTACTGACTTAACATCTTTCTGGAATCTCTTCACAGTCGTACCTGTTCTTGTCACAGCATTCATTTGCCATTACAATGTTCACAGTATACAGAACGAGCTCGAAGACCCCTCTCAGATAAGACCTGTTGTTCGATCAGCACTTATGCTCTGCTCATCTGTTTACATAATGACAAGTATTTTCGGGTTCCTCTTGTTTGGTGATGATACTCTTGATGATGTCCTTGCAAACTTTGACACTGATCTTGGAATCCCTTTTGGTTCTATCCTTAATGATGCGGTTCGAGTTAGCTACGCGCTTCATTTGATGCTCGTGTTCCCGATTGTTTTCTACCCTCTTCGGATTAACATTGACGGGCTCTTGTTCCCTTCCGCTCGATCATTATCTACCTCAAATGTGAGGTTCGGTTGCCTCACTGCCGGTCTCATCTCTGTAATCTTCTTGGGTGCAAACTTCATCCCAAGCATTTGGGATGCTTTCCAATTCACTGGAGCAACCGCCGCTGTTTGTCTCGGCTTCATCTTCCCAGCTTCTATCATACTAAAGGATCGTCATGACAAAGCAACAAACAGGGACACAACCTTAGCTATTTTCATGATTGTTCTTGCGGTATTGTCCAATGCAATCGCCATTTACAGCGATGCTTATGCGCTATTCAAGAAGAACGCTCCTCGTGAGTAAATCCCGGTATGAGAAAATGTGCAGTTTGGTGTTTAGCTTTTGCTTTTTCTTCTATGTGAAATCAAATAATGAAGAAGACAAGACTTCTCTTCTCTTATATGTTTGTACTTTTGTCGTTGAGTGTTCTAAGCGGACTTTTGCTTCGGTGTTATATACCACCATGAGTGTTGTTTGTAAAAAAACTCTGTATAAAAATTGTAATGCAGATACATATTTTGCCTTTTCATGACTCTTAGCTATTGCTTCATATCTATATACATATTTGGTTTTAA

SEQ ID NO: 1743 - DNA, 1861 bp, Arabidopsis thaliana
  misc_feature (1)..(1861): Ceres cDNA ID no. 12678420
  misc_feature (1)..(1861): Also known as  Ceres CDNA ID no. 23360388
aaagagaaaagaaacgattagagaaagagaagagggtagagacttcttttctttgtttctgtggaggctcttcttcttcttcttctctgtctctgtctctgtctctctgtaatcttctgtgctctccacaaatttgtctctcctctctctcgccgactccacaaattttgagcttctttttttgaagttcttgagaacaagtgaaagagcttaatatccacaagactcttgtttctttcttaaatggctaaagtttattggccttatttcgatcctgaatatgagaacttgagctccagaatcaatcctccaagtgtttctatagataacactagctgcaaagaatgcactcttgtcaaggtggacagtatgaacaaacctggaatactacttgaagttgtgcaagtcctaaccgatctcgatctcactatcactaaagcttatatctcttctgatggtggatggttcatggacgtattccatgtcaccgatcaacaaggaaacaaggttactgatagcaaaaccatcgattacatcgagaaggtgttaggaccaaagggtcatgcttcggcttcacaaaacacttggcctggtaaaagagtcggtgtccattcattaggcgaccacacatcgatagagattattgctcgtgatcgtcctggtctcttgtcggaggtttcagccgtactagcagacctcaacattaatgtggtggcagctgaagcatggactcacaaccgtaggattgcgtgtgtcctctatgtgaatgacaatgcaacttctagagccgttgatgatccagaaagattgtcttccatggaagaacagcttaacaatgtgctgcgtgggtgcgaagaacaagatgagaaatttgctcggacgagtctctccattgggtcgactcacgttgatcgaaggcttcatcagatgtttttcgctgatagagactacgaagcagtgactaagcttgatgattctgcttcttgcggattcgagcccaaaatcacggttgagcattgtgaagagaaaggttactccgtgataaacgtgagctgcgaggatcgaccaaagctcatgtttgacattgtatgcacgcttacggatatgcaatacattgtgtttcacgccacgatttcatcaagcggctctcatgcttctcaggagtatttcatcagacacaaagacggttgcactcttgacacagaaggagagaaagagagagttgtcaaatgtctggaagctgcaatccatagacgagtcagcgagggttggagtttggagctctgcgcaaaggacagagttggattactgtcggaagtgacaaggattctgagagagcacgggctatcagtgtcgagagctggtgtgacaacagtaggagaacaagccgtcaacgttttctatgtgaaagatgcttcagggaatccagtggatgtgaagacgattgaggcgttacgcggagagattggacacagtatgatgattgacttcaagaataaagttccgagcagaaaatggaaagaagaaggtcaagccggaacaggaggaggatgggccaaaaccagtttcttctttgggaatttgctggagaagttactgccttgagagaaaaggtaactatgtgtggataaaacgtactgtaaaatgtgtattatgtatgatctagagggccttagtgtgatgtatgacttggtcagggattttggtggtttgcccgaagtcaaaccgaaccaaaactggttttcggttactttagactttagtcatagtaaaatgaacatgtctataaatgaataatatgcaactcttccaattggtaggcttgcttttgtctatgtaatatcaatccttcttgttatgt

SEQ ID NO: 1744 - protein, 1861 aa, Arabidopsis thaliana
  misc_feature: PFam Name: TMPIT; PFam Description: TMPIT-like protein
  misc_feature: GI Number: 50758114; NR Description: PREDICTED: similar to transmembrane protein induced by tumor necrosis factor alpha
  misc_feature: GI Number: 34871732; NR Description: similar to transmembrane
  misc_feature: GI Number: 57870649; NR Description: Transmembrane protein induced by tumor necrosis factor alpha [Rattus norvegicus] gi|58219512|ref|NP_001010945.1| transmembrane protein induced by
  misc_feature: GI Number: 29789387; NR Description: transmembrane protein induced by tumor necrosis factor alpha [Mus musculus] >gi|28436931|gb|AAH46757.1| Transmembrane protein induced by tumor
  misc_feature: GI Number: 58701915; NR Description: Unknown (protein for
AAAGAGAAAAGAAACGATTAGAGAAAGAGAAGAGGGTAGAGACTTCTTTTCTTTGTTTCTGTGGAGGCTCTTCTTCTTCTTCTTCTCTGTCTCTGTCTCTGTCTCTCTGTAATCTTCTGTGCTCTCCACAAATTTGTCTCTCCTCTCTCTCGCCGACTCCACAAATTTTGAGCTTCTTTTTTTGAAGTTCTTGAGAACAAGTGAAAGAGCTTAATATCCACAAGACTCTTGTTTCTTTCTTAAATGGCTAAAGTTTATTGGCCTTATTTCGATCCTGAATATGAGAACTTGAGCTCCAGAATCAATCCTCCAAGTGTTTCTATAGATAACACTAGCTGCAAAGAATGCACTCTTGTCAAGGTGGACAGTATGAACAAACCTGGAATACTACTTGAAGTTGTGCAAGTCCTAACCGATCTCGATCTCACTATCACTAAAGCTTATATCTCTTCTGATGGTGGATGGTTCATGGACGTATTCCATGTCACCGATCAACAAGGAAACAAGGTTACTGATAGCAAAACCATCGATTACATCGAGAAGGTGTTAGGACCAAAGGGTCATGCTTCGGCTTCACAAAACACTTGGCCTGGTAAAAGAGTCGGTGTCCATTCATTAGGCGACCACACATCGATAGAGATTATTGCTCGTGATCGTCCTGGTCTCTTGTCGGAGGTTTCAGCCGTACTAGCAGACCTCAACATTAATGTGGTGGCAGCTGAAGCATGGACTCACAACCGTAGGATTGCGTGTGTCCTCTATGTGAATGACAATGCAACTTCTAGAGCCGTTGATGATCCAGAAAGATTGTCTTCCATGGAAGAACAGCTTAACAATGTGCTGCGTGGGTGCGAAGAACAAGATGAGAAATTTGCTCGGACGAGTCTCTCCATTGGGTCGACTCACGTTGATCGAAGGCTTCATCAGATGTTTTTCGCTGATAGAGACTACGAAGCAGTGACTAAGCTTGATGATTCTGCTTCTTGCGGATTCGAGCCCAAAATCACGGTTGAGCATTGTGAAGAGAAAGGTTACTCCGTGATAAACGTGAGCTGCGAGGATCGACCAAAGCTCATGTTTGACATTGTATGCACGCTTACGGATATGCAATACATTGTGTTTCACGCCACGATTTCATCAAGCGGCTCTCATGCTTCTCAGGAGTATTTCATCAGACACAAAGACGGTTGCACTCTTGACACAGAAGGAGAGAAAGAGAGAGTTGTCAAATGTCTGGAAGCTGCAATCCATAGACGAGTCAGCGAGGGTTGGAGTTTGGAGCTCTGCGCAAAGGACAGAGTTGGATTACTGTCGGAAGTGACAAGGATTCTGAGAGAGCACGGGCTATCAGTGTCGAGAGCTGGTGTGACAACAGTAGGAGAACAAGCCGTCAACGTTTTCTATGTGAAAGATGCTTCAGGGAATCCAGTGGATGTGAAGACGATTGAGGCGTTACGCGGAGAGATTGGACACAGTATGATGATTGACTTCAAGAATAAAGTTCCGAGCAGAAAATGGAAAGAAGAAGGTCAAGCCGGAACAGGAGGAGGATGGGCCAAAACCAGTTTCTTCTTTGGGAATTTGCTGGAGAAGTTACTGCCTTGAGAGAAAAGGTAACTATGTGTGGATAAAACGTACTGTAAAATGTGTATTATGTATGATCTAGAGGGCCTTAGTGTGATGTATGACTTGGTCAGGGATTTTGGTGGTTTGCCCGAAGTCAAACCGAACCAAAACTGGTTTTCGGTTACTTTAGACTTTAGTCATAGTAAAATGAACATGTCTATAAATGAATAATATGCAACTCTTCCAATTGGTAGGCTTGCTTTTGTCTATGTAATATCAATCCTTCTTGTTATGT

SEQ ID NO: 1745 - DNA, 630 bp, Arabidopsis thaliana
  misc_feature (1)..(630): Ceres cDNA ID no. 12678644
  misc_feature (1)..(630): Also known as  Ceres CDNA ID no. 23360388
agatcaaaatcagaatcagaatcaaatttctcgtcgtgtcggagtaaatcaagccatggattccggaaccaaagtgaagaaaggagccgctggaagaagaagtggtggaggtcctaagaagaaaccggtttcccgttcggttaaatccggtctacagtttcctgtcggtaggatcggtcggtatcttaagaaaggtcgttattcgaagcgtgtcggaaccggagctccggtctatctcgccgccgtcctcgagtatcttgctgctgaggttctcgagcttgctggtaacgctgcaagagataacaaaaagaaccgtattataccacgccatgttctattagcggtgaggaacgacgaggagctagggacactactcaaaggcgtaaccattgcacacggcggtgttttaccaaacataaacccaatactcctcccaaagaagtctgagaaagcagcttcaactacaaaaacacccaaatcaccatcaaaggcaaccaaatcccctaagaaatcttagtacttctttcttcattcctctgtataacctactgtttctatctctctgtacgtttctctgtaaagacagaacagaatatctctttgttgttgtgagaaagcttagtttctctg

SEQ ID NO: 1746 - protein, 630 aa, Arabidopsis thaliana
  misc_feature: PFam Name: TMPIT; PFam Description: TMPIT-like protein
  misc_feature: GI Number: 50758114; NR Description: PREDICTED: similar to transmembrane protein induced by tumor necrosis factor alpha
  misc_feature: GI Number: 34871732; NR Description: similar to transmembrane
  misc_feature: GI Number: 57870649; NR Description: Transmembrane protein induced by tumor necrosis factor alpha [Rattus norvegicus] gi|58219512|ref|NP_001010945.1| transmembrane protein induced by
  misc_feature: GI Number: 29789387; NR Description: transmembrane protein induced by tumor necrosis factor alpha [Mus musculus] >gi|28436931|gb|AAH46757.1| Transmembrane protein induced by tumor
  misc_feature: GI Number: 58701915; NR Description: Unknown (protein for
AGATCAAAATCAGAATCAGAATCAAATTTCTCGTCGTGTCGGAGTAAATCAAGCCATGGATTCCGGAACCAAAGTGAAGAAAGGAGCCGCTGGAAGAAGAAGTGGTGGAGGTCCTAAGAAGAAACCGGTTTCCCGTTCGGTTAAATCCGGTCTACAGTTTCCTGTCGGTAGGATCGGTCGGTATCTTAAGAAAGGTCGTTATTCGAAGCGTGTCGGAACCGGAGCTCCGGTCTATCTCGCCGCCGTCCTCGAGTATCTTGCTGCTGAGGTTCTCGAGCTTGCTGGTAACGCTGCAAGAGATAACAAAAAGAACCGTATTATACCACGCCATGTTCTATTAGCGGTGAGGAACGACGAGGAGCTAGGGACACTACTCAAAGGCGTAACCATTGCACACGGCGGTGTTTTACCAAACATAAACCCAATACTCCTCCCAAAGAAGTCTGAGAAAGCAGCTTCAACTACAAAAACACCCAAATCACCATCAAAGGCAACCAAATCCCCTAAGAAATCTTAGTACTTCTTTCTTCATTCCTCTGTATAACCTACTGTTTCTATCTCTCTGTACGTTTCTCTGTAAAGACAGAACAGAATATCTCTTTGTTGTTGTGAGAAAGCTTAGTTTCTCTG

SEQ ID NO: 1747 - DNA, 1962 bp, Arabidopsis thaliana
  misc_feature (1)..(1962): Ceres cDNA ID no. 12678880
  misc_feature (1)..(1962): Also known as  Ceres CDNA ID no. 23360388
gtcgtctttttaaaaacgttttactttccacggcgaattttggtctgattccaaattcttccctagtttgaaaaatcttctgtattctgaaaagagattttatgcgtatcgctgaaataggaagaaaacagattcctttccatttcccaaattttgtcattgagtcttggcatttcaaccaatcgcaatttattgaaattccggcgagtcattagatttttttggattccgtttcaaggtacggtgctttttcgcagattgagaagagcttaataagaaagatgacattgacgatcccaaacgcacctgggagctccgggtacttggatatgttcccagagagaaggatgtcgtattttgggaattcttacattctgggtttgactgtcactgccggaatcggtggccttctgttcggttatgatacaggtgtaatttccggtgcccttttgtacattaaggatgatttcgaagttgttaagcagagcagtttcttacaggaaactattgtaagtatggctttagttggtgccatgattggtgctgcagctggaggttggatcaatgactactacggtcgtaaaaaggcgactctttttgcagatgttgtctttgcagctggagctatcgttatggctgctgctcctgatccgtatgttttgatatcgggtcgtctcttggtcggtttaggagttggtgttgcttctgtgactgctccggtttatatagcggaagcatctccatcggaagttagaggtggacttgtgagcaccaacgtattgatgatcactggtggacagtttctttcatatctcgttaattctgctttcacacaggttccaggaacatggagatggatgcttggtgtttcaggcgttcccgctgtgattcagttcatcctcatgcttttcatgccagaatcccctcgatggcttttcatgaaaaatcgtaaagcggaagccatccaagtgctcgccagaacctatgacatctcgcggttagaagacgagattgatcatctttcagcggctgaagaggaagaaaaacaaaggaagcgcactgttggctacttggatgttttcagatccaaagaattgagacttgcatttcttgccggagcaggacttcaggcgtttcagcagttcactggtatcaatacagttatgtactacagccctacgatagtccaaatggctggatttcactcaaaccagctcgctttgttcctgtctctcattgttgctgccatgaatgctgctggaacagtcgtggggatttacttcatcgatcattgtggaaggaaaaagctagctctctcaagtttatttggcgtcattatatcactcttaatcctctcagtctcgtttttcaaacaatctgagacatcatctgatggagggctctatggttggctcgctgtgcttggcttagctctatacattgttttctttgcaccgggaatgggaccagtcccatggacggtgaactcagagatataccctcaacaataccgaggcatatgcggaggcatgtcagctacagttaactggatcagcaatttgattgtggcacaaacattcttgacaatcgcggaagctgctggaacaggaatgactttcttgattttggcgggaattgcggttcttgctgtaatctttgtgattgtgtttgtccctgagactcaagggctaacgttttcggaagttgaacagatttggaaagaaagagcttatggaaatatcagtggctggggcagtagcagtgatagcaacaacatggaagggttactcgagcagggatctcaatcttaaagatcttggatggctcatgagtcatgcatgacttacacattgtgaaatcacatagtagtaaaccgggattggttccggtttagcaatgtgagatgtatgtgatgttggaattgtaatgttcttaggaactgtgattgtaaataaatacatt

SEQ ID NO: 1748 - protein, 1962 aa, Arabidopsis thaliana
  misc_feature: PFam Name: TMPIT; PFam Description: TMPIT-like protein
  misc_feature: GI Number: 50758114; NR Description: PREDICTED: similar to transmembrane protein induced by tumor necrosis factor alpha
  misc_feature: GI Number: 34871732; NR Description: similar to transmembrane
  misc_feature: GI Number: 57870649; NR Description: Transmembrane protein induced by tumor necrosis factor alpha [Rattus norvegicus] gi|58219512|ref|NP_001010945.1| transmembrane protein induced by
  misc_feature: GI Number: 29789387; NR Description: transmembrane protein induced by tumor necrosis factor alpha [Mus musculus] >gi|28436931|gb|AAH46757.1| Transmembrane protein induced by tumor
  misc_feature: GI Number: 58701915; NR Description: Unknown (protein for
GTCGTCTTTTTAAAAACGTTTTACTTTCCACGGCGAATTTTGGTCTGATTCCAAATTCTTCCCTAGTTTGAAAAATCTTCTGTATTCTGAAAAGAGATTTTATGCGTATCGCTGAAATAGGAAGAAAACAGATTCCTTTCCATTTCCCAAATTTTGTCATTGAGTCTTGGCATTTCAACCAATCGCAATTTATTGAAATTCCGGCGAGTCATTAGATTTTTTTGGATTCCGTTTCAAGGTACGGTGCTTTTTCGCAGATTGAGAAGAGCTTAATAAGAAAGATGACATTGACGATCCCAAACGCACCTGGGAGCTCCGGGTACTTGGATATGTTCCCAGAGAGAAGGATGTCGTATTTTGGGAATTCTTACATTCTGGGTTTGACTGTCACTGCCGGAATCGGTGGCCTTCTGTTCGGTTATGATACAGGTGTAATTTCCGGTGCCCTTTTGTACATTAAGGATGATTTCGAAGTTGTTAAGCAGAGCAGTTTCTTACAGGAAACTATTGTAAGTATGGCTTTAGTTGGTGCCATGATTGGTGCTGCAGCTGGAGGTTGGATCAATGACTACTACGGTCGTAAAAAGGCGACTCTTTTTGCAGATGTTGTCTTTGCAGCTGGAGCTATCGTTATGGCTGCTGCTCCTGATCCGTATGTTTTGATATCGGGTCGTCTCTTGGTCGGTTTAGGAGTTGGTGTTGCTTCTGTGACTGCTCCGGTTTATATAGCGGAAGCATCTCCATCGGAAGTTAGAGGTGGACTTGTGAGCACCAACGTATTGATGATCACTGGTGGACAGTTTCTTTCATATCTCGTTAATTCTGCTTTCACACAGGTTCCAGGAACATGGAGATGGATGCTTGGTGTTTCAGGCGTTCCCGCTGTGATTCAGTTCATCCTCATGCTTTTCATGCCAGAATCCCCTCGATGGCTTTTCATGAAAAATCGTAAAGCGGAAGCCATCCAAGTGCTCGCCAGAACCTATGACATCTCGCGGTTAGAAGACGAGATTGATCATCTTTCAGCGGCTGAAGAGGAAGAAAAACAAAGGAAGCGCACTGTTGGCTACTTGGATGTTTTCAGATCCAAAGAATTGAGACTTGCATTTCTTGCCGGAGCAGGACTTCAGGCGTTTCAGCAGTTCACTGGTATCAATACAGTTATGTACTACAGCCCTACGATAGTCCAAATGGCTGGATTTCACTCAAACCAGCTCGCTTTGTTCCTGTCTCTCATTGTTGCTGCCATGAATGCTGCTGGAACAGTCGTGGGGATTTACTTCATCGATCATTGTGGAAGGAAAAAGCTAGCTCTCTCAAGTTTATTTGGCGTCATTATATCACTCTTAATCCTCTCAGTCTCGTTTTTCAAACAATCTGAGACATCATCTGATGGAGGGCTCTATGGTTGGCTCGCTGTGCTTGGCTTAGCTCTATACATTGTTTTCTTTGCACCGGGAATGGGACCAGTCCCATGGACGGTGAACTCAGAGATATACCCTCAACAATACCGAGGCATATGCGGAGGCATGTCAGCTACAGTTAACTGGATCAGCAATTTGATTGTGGCACAAACATTCTTGACAATCGCGGAAGCTGCTGGAACAGGAATGACTTTCTTGATTTTGGCGGGAATTGCGGTTCTTGCTGTAATCTTTGTGATTGTGTTTGTCCCTGAGACTCAAGGGCTAACGTTTTCGGAAGTTGAACAGATTTGGAAAGAAAGAGCTTATGGAAATATCAGTGGCTGGGGCAGTAGCAGTGATAGCAACAACATGGAAGGGTTACTCGAGCAGGGATCTCAATCTTAAAGATCTTGGATGGCTCATGAGTCATGCATGACTTACACATTGTGAAATCACATAGTAGTAAACCGGGATTGGTTCCGGTTTAGCAATGTGAGATGTATGTGATGTTGGAATTGTAATGTTCTTAGGAACTGTGATTGTAAATAAATACATT

SEQ ID NO: 1749 - DNA, 1052 bp, Arabidopsis thaliana
  misc_feature (1)..(1052): Ceres cDNA ID no. 12678888
  misc_feature (1)..(1052): Also known as  Ceres CDNA ID no. 23360388
ccttgagatggttatgattcatatcttcctcaccgtgatggtggttggaggcgtcagtctcttcccggagacggcagaagcgatcgtgatgggaccgtcgatgcagaagctgacgtggcattactataaagtttacaacacttgcgagaatgcagagaattttgtgaggcaccaagttgagatattttacaagaacgataaaagtattgctcctaagctccttcgtctcctctactcagactgctttgtttccggatgcgatgcatcagttcttctagaaggtccaaactcagagaaaatggcgccacaaaacagaggacttggaggattcgttctcatagacaaaatcaaaatagtcttggaacagagatgtcctggtgttgtctcttgcgccgacattcttaatcttgcaactcgtgatgctgttcatttggcgggtgcaccatcttatcctgtgttcacaggcaggagagatggtttgacgtctgataagcaaaccgtggacctaccatcgccatccatctcatgggaccaagccatgtcttatttcaaatccagaggcttgaatgttcttgacatggctacacttctaggatcacattcaatggggagaacacattgcagctatgttgttgatcgactctacaattacaacaagaccggtaaaccaagccctactatgaacaagtatttcctatctgaaatggcaaagcaatgtcctccaagaacgaggaaaggccagaccgatccgctcgtgtacctaaacccggactcaggctcaaaccacagcttcacaagctcattttactcaagaattctatcaaacaaatctgtacttgaagtagatcaacaactgctttacaatgatgacaccaagcaaatatctaaggaattctcagagggtttcgaggattttcggaaatcatttgctctttcgatgagcaagatgggagcgataaatgtgttaactaaaacggaaggtgagatacgaaaagattgcaggcatataaactaaacacaaaagcacaatctctctctcaccactgtgatac

SEQ ID NO: 1750 - protein, 1052 aa, Arabidopsis thaliana
  misc_feature: PFam Name: TMPIT; PFam Description: TMPIT-like protein
  misc_feature: GI Number: 50758114; NR Description: PREDICTED: similar to transmembrane protein induced by tumor necrosis factor alpha
  misc_feature: GI Number: 34871732; NR Description: similar to transmembrane
  misc_feature: GI Number: 57870649; NR Description: Transmembrane protein induced by tumor necrosis factor alpha [Rattus norvegicus] gi|58219512|ref|NP_001010945.1| transmembrane protein induced by
  misc_feature: GI Number: 29789387; NR Description: transmembrane protein induced by tumor necrosis factor alpha [Mus musculus] >gi|28436931|gb|AAH46757.1| Transmembrane protein induced by tumor
  misc_feature: GI Number: 58701915; NR Description: Unknown (protein for
CCTTGAGATGGTTATGATTCATATCTTCCTCACCGTGATGGTGGTTGGAGGCGTCAGTCTCTTCCCGGAGACGGCAGAAGCGATCGTGATGGGACCGTCGATGCAGAAGCTGACGTGGCATTACTATAAAGTTTACAACACTTGCGAGAATGCAGAGAATTTTGTGAGGCACCAAGTTGAGATATTTTACAAGAACGATAAAAGTATTGCTCCTAAGCTCCTTCGTCTCCTCTACTCAGACTGCTTTGTTTCCGGATGCGATGCATCAGTTCTTCTAGAAGGTCCAAACTCAGAGAAAATGGCGCCACAAAACAGAGGACTTGGAGGATTCGTTCTCATAGACAAAATCAAAATAGTCTTGGAACAGAGATGTCCTGGTGTTGTCTCTTGCGCCGACATTCTTAATCTTGCAACTCGTGATGCTGTTCATTTGGCGGGTGCACCATCTTATCCTGTGTTCACAGGCAGGAGAGATGGTTTGACGTCTGATAAGCAAACCGTGGACCTACCATCGCCATCCATCTCATGGGACCAAGCCATGTCTTATTTCAAATCCAGAGGCTTGAATGTTCTTGACATGGCTACACTTCTAGGATCACATTCAATGGGGAGAACACATTGCAGCTATGTTGTTGATCGACTCTACAATTACAACAAGACCGGTAAACCAAGCCCTACTATGAACAAGTATTTCCTATCTGAAATGGCAAAGCAATGTCCTCCAAGAACGAGGAAAGGCCAGACCGATCCGCTCGTGTACCTAAACCCGGACTCAGGCTCAAACCACAGCTTCACAAGCTCATTTTACTCAAGAATTCTATCAAACAAATCTGTACTTGAAGTAGATCAACAACTGCTTTACAATGATGACACCAAGCAAATATCTAAGGAATTCTCAGAGGGTTTCGAGGATTTTCGGAAATCATTTGCTCTTTCGATGAGCAAGATGGGAGCGATAAATGTGTTAACTAAAACGGAAGGTGAGATACGAAAAGATTGCAGGCATATAAACTAAACACAAAAGCACAATCTCTCTCTCACCACTGTGATAC

SEQ ID NO: 1751 - DNA, 1713 bp, Arabidopsis thaliana
  misc_feature (1)..(1713): Ceres cDNA ID no. 12679064
  misc_feature (1)..(1713): Also known as  Ceres CDNA ID no. 23360388
gagagaagcaagacaccaaaaacttagtctgacatcaaaacccaaaatccaagaagaaagaaagagagagtcttcacgctcacactggctttggctttggctctggcgttgtaaacaatgctcctccctctcttcttcttctttctccatctccatctccatctctcttcttcttcttcaatctccttccctgattttcaaatcatcgacgttttacaacctcctctcaccgtcactgcaactcttcccgatttcaacaacacccatttctccgatgaatccagttctaagtacactctccgtcttctccaccgcgacagattcccttcagtcacttaccgtaaccaccaccaccgtctccatgctcgtatgcgcagagacacagacagagtctccgccattctccgccgcatttctgggaaagttataccttcttccgattctagatacgaggttaacgattttgggtccgatattgtttccggtatggatcaaggaagtggtgagtatttcgtcagaatcggcgtcggaagtcctccgagagatcagtacatggtcattgattccggtagcgatatggtttgggttcaatgtcagccttgtaagctctgttacaaacaatccgacccggtttttgacccggctaaatccgggtcttacactggagtctcttgtggctcttccgtctgtgaccggattgaaaactccggttgtcactccggtgggtgccgttacgaggtcatgtacggagacgggtcttacacgaagggaacgttagctctcgaaacgctgacgtttgctaagacggtggttagaaacgttgcgatgggatgtggtcaccggaatagaggaatgtttattggagctgccggtttattgggtatcggaggcggttcaatgtcgtttgtgggtcaattaagcggtcaaaccggtggtgcgttcggttattgtttagtgagtcgtggcactgactcgaccggttcattggtattcgggcgggaagcgttgcccgttggtgcctcgtgggtcccgttggtccggaacccgcgggctccaagtttttactacgttgggctcaagggccttggagtaggaggcgtccggattccgttaccggatggtgtttttgacctgactgaaaccggtgacggtggtgtggttatggataccggaacagccgtcacaagacttcccacggcggcttacgtcgcttttcgagatggattcaagtcgcagacagcgaatttgccgcgggcttccggtgtatcgatattcgacacgtgttatgatctgtcagggtttgtttcggtacgagtcccgaccgtgtcgttctatttcacggaaggtccggttttgacattaccggcgaggaattttctgatgccggtggatgattcgggaacgtattgttttgcgtttgcggcgtctccgacgggtttgtcaataatagggaacatacaacaagaagggattcaagtatctttcgacggagccaatggctttgttggttttggccccaacgtttgctagcggttaagatagagaaattacgatttttgtttgctagtaagtaaaaagcttttgtctcaaaactatatatgtatttgtctctttttttctttcttattagtttggtttgagtttttaataaatctgattagtatagagagataacaaaaatgtatatgttttgaccaaatttgtcttttgatt

SEQ ID NO: 1752 - protein, 1713 aa, Arabidopsis thaliana
  misc_feature: PFam Name: TMPIT; PFam Description: TMPIT-like protein
  misc_feature: GI Number: 50758114; NR Description: PREDICTED: similar to transmembrane protein induced by tumor necrosis factor alpha
  misc_feature: GI Number: 34871732; NR Description: similar to transmembrane
  misc_feature: GI Number: 57870649; NR Description: Transmembrane protein induced by tumor necrosis factor alpha [Rattus norvegicus] gi|58219512|ref|NP_001010945.1| transmembrane protein induced by
  misc_feature: GI Number: 29789387; NR Description: transmembrane protein induced by tumor necrosis factor alpha [Mus musculus] >gi|28436931|gb|AAH46757.1| Transmembrane protein induced by tumor
  misc_feature: GI Number: 58701915; NR Description: Unknown (protein for
GAGAGAAGCAAGACACCAAAAACTTAGTCTGACATCAAAACCCAAAATCCAAGAAGAAAGAAAGAGAGAGTCTTCACGCTCACACTGGCTTTGGCTTTGGCTCTGGCGTTGTAAACAATGCTCCTCCCTCTCTTCTTCTTCTTTCTCCATCTCCATCTCCATCTCTCTTCTTCTTCTTCAATCTCCTTCCCTGATTTTCAAATCATCGACGTTTTACAACCTCCTCTCACCGTCACTGCAACTCTTCCCGATTTCAACAACACCCATTTCTCCGATGAATCCAGTTCTAAGTACACTCTCCGTCTTCTCCACCGCGACAGATTCCCTTCAGTCACTTACCGTAACCACCACCACCGTCTCCATGCTCGTATGCGCAGAGACACAGACAGAGTCTCCGCCATTCTCCGCCGCATTTCTGGGAAAGTTATACCTTCTTCCGATTCTAGATACGAGGTTAACGATTTTGGGTCCGATATTGTTTCCGGTATGGATCAAGGAAGTGGTGAGTATTTCGTCAGAATCGGCGTCGGAAGTCCTCCGAGAGATCAGTACATGGTCATTGATTCCGGTAGCGATATGGTTTGGGTTCAATGTCAGCCTTGTAAGCTCTGTTACAAACAATCCGACCCGGTTTTTGACCCGGCTAAATCCGGGTCTTACACTGGAGTCTCTTGTGGCTCTTCCGTCTGTGACCGGATTGAAAACTCCGGTTGTCACTCCGGTGGGTGCCGTTACGAGGTCATGTACGGAGACGGGTCTTACACGAAGGGAACGTTAGCTCTCGAAACGCTGACGTTTGCTAAGACGGTGGTTAGAAACGTTGCGATGGGATGTGGTCACCGGAATAGAGGAATGTTTATTGGAGCTGCCGGTTTATTGGGTATCGGAGGCGGTTCAATGTCGTTTGTGGGTCAATTAAGCGGTCAAACCGGTGGTGCGTTCGGTTATTGTTTAGTGAGTCGTGGCACTGACTCGACCGGTTCATTGGTATTCGGGCGGGAAGCGTTGCCCGTTGGTGCCTCGTGGGTCCCGTTGGTCCGGAACCCGCGGGCTCCAAGTTTTTACTACGTTGGGCTCAAGGGCCTTGGAGTAGGAGGCGTCCGGATTCCGTTACCGGATGGTGTTTTTGACCTGACTGAAACCGGTGACGGTGGTGTGGTTATGGATACCGGAACAGCCGTCACAAGACTTCCCACGGCGGCTTACGTCGCTTTTCGAGATGGATTCAAGTCGCAGACAGCGAATTTGCCGCGGGCTTCCGGTGTATCGATATTCGACACGTGTTATGATCTGTCAGGGTTTGTTTCGGTACGAGTCCCGACCGTGTCGTTCTATTTCACGGAAGGTCCGGTTTTGACATTACCGGCGAGGAATTTTCTGATGCCGGTGGATGATTCGGGAACGTATTGTTTTGCGTTTGCGGCGTCTCCGACGGGTTTGTCAATAATAGGGAACATACAACAAGAAGGGATTCAAGTATCTTTCGACGGAGCCAATGGCTTTGTTGGTTTTGGCCCCAACGTTTGCTAGCGGTTAAGATAGAGAAATTACGATTTTTGTTTGCTAGTAAGTAAAAAGCTTTTGTCTCAAAACTATATATGTATTTGTCTCTTTTTTTCTTTCTTATTAGTTTGGTTTGAGTTTTTAATAAATCTGATTAGTATAGAGAGATAACAAAAATGTATATGTTTTGACCAAATTTGTCTTTTGATT

SEQ ID NO: 1753 - DNA, 2973 bp, Arabidopsis thaliana
  misc_feature (1)..(2973): Ceres cDNA ID no. 12679328
  misc_feature (1)..(2973): Also known as  Ceres CDNA ID no. 23360388
atgggaacaaaggtgcactgtgaaagcttatttggtggatatcatcattctatgggagatctcaacaaagaatctaataacggttgtagatggccattgttctacggtgacaataaaacctctgcatcaaacaacgatcaatgctacaataatgggttcacgtctcagactacatttgggtttgacaaagatgtggttttggaacttcaccgggtatataggacacagaaggatatgatggatgaattgaaaaggaaacagtttaataaagaatgggttcagattgaggcatcactttcttctcaagctacgaatgatgatgttcgtaaatggaaaatccctagcttccctttggcgaactcggtttacgatagaccatccatgtcggttgttgaggataatggccattctcccatgaaaggaagcaattctcaaggtccagtttcatggcaaaatggagctagttccaaaagtgttgaagtgtccgaggttagaccgacgaaaatcagaagaaagatgatagatctttgccttccagctgatgagtacattgatgacaatgaagaagttgttgagttaaaggatcacagggtctgcagtacatcgagtcagcttcctaatggagatgtgaagactgaatctcgcatagatggtgtgagaattggctatgggtctagtagaagcaatggtttggctgacttaaatgaaccagttgatgctcaagaagcaaacgaatttgcttatggccactcccgtgacttgcgtaatggggagtttcaaggccatattcgtgactacggaaaatctctaaactcaggtagtgtaagggagcatattcctgttatccctctgcagccagatttgaacggcaaaccaaaagtttggtcacaccaacccctaagaactgatcattataatggcacacacaagtctgctgctccattttttcaaccggctaaaccactggattctttgtctcagcctatgcaagttttgatgaacagttcacaaagagttatgagtttacctaattcaggtccaccaagtaaggcagtcgtctggagagaaagaacgtttattgacctagaggctgatactgataccaatagtagtcatgaagccgtcattcatcaaaatcacttggattcaagtttaacttctcaccaacagcgccccttgtatccatatattcgtccagattctgctgtctcctggaaccatttgcactcttcttggcaaaatcctagctttggattccctcagaaagttgcttcagctcagagatatccggttctaaacatgtctgatacactgattggtaatgctcagaagcaagggtatcttggagatagattgcagtttgaaagcaattctagatttgactcagggtgcgggaattccagtcggttaaaccacaatatgttttacaatgagtgttccacttcatcaaaatcgaaagtcgctgggactggctataattatcctaacggaggaagaagtgattacagctcggagaggaagtttgtgagggatttgaacttaaatgtgacactttcaaacacttctgttgttgaagtcagaaaggatgaagaacacctggctactttaccatggcttaataaacccaagtctgtttgtaactctgagttagctgatgggaaatggagtctgaagagtaatgatgctgttccaagttcttctttgaaaccattggatatcagagatgaggcaggagacaaagttcagaatattatgtggctagagaggttaaagtctggttcttgttccaataatccggtgactgagaagatcgatgctaacaaggaaattcctggattggcttataaagatcaatccaatgtagagaaaggtaaagtccattacgttaggatgctagacatgaacgaaccgtgtgatcctctttgggatgaagatcagcaaacagaggaacagactgagacaagggtttcagctagtaataggtgtcagattgatttgaacattttgggcagtgatgatgaaggcgaaaattgctctgttcctgccagttcaagactgaattcaaaggctcctatgatagatttggaaactgttcctgagtctgatgatgaagaagaagatggtaatatctctggagaaaagcgatcagaagtaaaatcaattgaggaaaaaactctagagaaaccgcctgagtttgaaaaattagcagcagaaacaatagttgccatctattcagcttgcctagatagagaggttgaagttgttgcttcgtcagaagtttctgaaaccatcatccttcactggtttgcagaaacagtaaatactcacaaagagaatctggacaaaaagctcgatactttttcaaggaatcaatcgcgttctatcgaagatattgattactttgagtcaatgaccctgcaactacctgatatctcagaacaagagtatatgcctaagccattggttcctgaaaacctcaaattggaggaaactacaggaaccgctctggtcacaagccaaagaccgagaagaggaaacgcgagaaaagggaaacagagacgagacttccaaagagacattctccctggacttctgtctctttcgaaacacgaagtaacagaagacattcaaatgtttgatgggttcatgagagcaacaggaagatcttggactccaaccggtttaacaaggaagaaaaccggttcaagaggaagaccacgacgagccataacaatccctgctgaaccggtctattgtccggttccagctccagctcctcctcctccctcagttcaacaacatgtgagcaatcaaagcaacaatggtgaaactgaaatgtgtttagaagatagaagctttgcaggttggggtaagatgacaagaaggcctagaagacaacgatgtccttcagcttcaactacaactgcaactacaagtaaccaacgttcatcatcacacgcgcctttcacgtga

SEQ ID NO: 1754 - protein, 2973 aa, Arabidopsis thaliana
  misc_feature: PFam Name: TMPIT; PFam Description: TMPIT-like protein
  misc_feature: GI Number: 50758114; NR Description: PREDICTED: similar to transmembrane protein induced by tumor necrosis factor alpha
  misc_feature: GI Number: 34871732; NR Description: similar to transmembrane
  misc_feature: GI Number: 57870649; NR Description: Transmembrane protein induced by tumor necrosis factor alpha [Rattus norvegicus] gi|58219512|ref|NP_001010945.1| transmembrane protein induced by
  misc_feature: GI Number: 29789387; NR Description: transmembrane protein induced by tumor necrosis factor alpha [Mus musculus] >gi|28436931|gb|AAH46757.1| Transmembrane protein induced by tumor
  misc_feature: GI Number: 58701915; NR Description: Unknown (protein for
ATGGGAACAAAGGTGCACTGTGAAAGCTTATTTGGTGGATATCATCATTCTATGGGAGATCTCAACAAAGAATCTAATAACGGTTGTAGATGGCCATTGTTCTACGGTGACAATAAAACCTCTGCATCAAACAACGATCAATGCTACAATAATGGGTTCACGTCTCAGACTACATTTGGGTTTGACAAAGATGTGGTTTTGGAACTTCACCGGGTATATAGGACACAGAAGGATATGATGGATGAATTGAAAAGGAAACAGTTTAATAAAGAATGGGTTCAGATTGAGGCATCACTTTCTTCTCAAGCTACGAATGATGATGTTCGTAAATGGAAAATCCCTAGCTTCCCTTTGGCGAACTCGGTTTACGATAGACCATCCATGTCGGTTGTTGAGGATAATGGCCATTCTCCCATGAAAGGAAGCAATTCTCAAGGTCCAGTTTCATGGCAAAATGGAGCTAGTTCCAAAAGTGTTGAAGTGTCCGAGGTTAGACCGACGAAAATCAGAAGAAAGATGATAGATCTTTGCCTTCCAGCTGATGAGTACATTGATGACAATGAAGAAGTTGTTGAGTTAAAGGATCACAGGGTCTGCAGTACATCGAGTCAGCTTCCTAATGGAGATGTGAAGACTGAATCTCGCATAGATGGTGTGAGAATTGGCTATGGGTCTAGTAGAAGCAATGGTTTGGCTGACTTAAATGAACCAGTTGATGCTCAAGAAGCAAACGAATTTGCTTATGGCCACTCCCGTGACTTGCGTAATGGGGAGTTTCAAGGCCATATTCGTGACTACGGAAAATCTCTAAACTCAGGTAGTGTAAGGGAGCATATTCCTGTTATCCCTCTGCAGCCAGATTTGAACGGCAAACCAAAAGTTTGGTCACACCAACCCCTAAGAACTGATCATTATAATGGCACACACAAGTCTGCTGCTCCATTTTTTCAACCGGCTAAACCACTGGATTCTTTGTCTCAGCCTATGCAAGTTTTGATGAACAGTTCACAAAGAGTTATGAGTTTACCTAATTCAGGTCCACCAAGTAAGGCAGTCGTCTGGAGAGAAAGAACGTTTATTGACCTAGAGGCTGATACTGATACCAATAGTAGTCATGAAGCCGTCATTCATCAAAATCACTTGGATTCAAGTTTAACTTCTCACCAACAGCGCCCCTTGTATCCATATATTCGTCCAGATTCTGCTGTCTCCTGGAACCATTTGCACTCTTCTTGGCAAAATCCTAGCTTTGGATTCCCTCAGAAAGTTGCTTCAGCTCAGAGATATCCGGTTCTAAACATGTCTGATACACTGATTGGTAATGCTCAGAAGCAAGGGTATCTTGGAGATAGATTGCAGTTTGAAAGCAATTCTAGATTTGACTCAGGGTGCGGGAATTCCAGTCGGTTAAACCACAATATGTTTTACAATGAGTGTTCCACTTCATCAAAATCGAAAGTCGCTGGGACTGGCTATAATTATCCTAACGGAGGAAGAAGTGATTACAGCTCGGAGAGGAAGTTTGTGAGGGATTTGAACTTAAATGTGACACTTTCAAACACTTCTGTTGTTGAAGTCAGAAAGGATGAAGAACACCTGGCTACTTTACCATGGCTTAATAAACCCAAGTCTGTTTGTAACTCTGAGTTAGCTGATGGGAAATGGAGTCTGAAGAGTAATGATGCTGTTCCAAGTTCTTCTTTGAAACCATTGGATATCAGAGATGAGGCAGGAGACAAAGTTCAGAATATTATGTGGCTAGAGAGGTTAAAGTCTGGTTCTTGTTCCAATAATCCGGTGACTGAGAAGATCGATGCTAACAAGGAAATTCCTGGATTGGCTTATAAAGATCAATCCAATGTAGAGAAAGGTAAAGTCCATTACGTTAGGATGCTAGACATGAACGAACCGTGTGATCCTCTTTGGGATGAAGATCAGCAAACAGAGGAACAGACTGAGACAAGGGTTTCAGCTAGTAATAGGTGTCAGATTGATTTGAACATTTTGGGCAGTGATGATGAAGGCGAAAATTGCTCTGTTCCTGCCAGTTCAAGACTGAATTCAAAGGCTCCTATGATAGATTTGGAAACTGTTCCTGAGTCTGATGATGAAGAAGAAGATGGTAATATCTCTGGAGAAAAGCGATCAGAAGTAAAATCAATTGAGGAAAAAACTCTAGAGAAACCGCCTGAGTTTGAAAAATTAGCAGCAGAAACAATAGTTGCCATCTATTCAGCTTGCCTAGATAGAGAGGTTGAAGTTGTTGCTTCGTCAGAAGTTTCTGAAACCATCATCCTTCACTGGTTTGCAGAAACAGTAAATACTCACAAAGAGAATCTGGACAAAAAGCTCGATACTTTTTCAAGGAATCAATCGCGTTCTATCGAAGATATTGATTACTTTGAGTCAATGACCCTGCAACTACCTGATATCTCAGAACAAGAGTATATGCCTAAGCCATTGGTTCCTGAAAACCTCAAATTGGAGGAAACTACAGGAACCGCTCTGGTCACAAGCCAAAGACCGAGAAGAGGAAACGCGAGAAAAGGGAAACAGAGACGAGACTTCCAAAGAGACATTCTCCCTGGACTTCTGTCTCTTTCGAAACACGAAGTAACAGAAGACATTCAAATGTTTGATGGGTTCATGAGAGCAACAGGAAGATCTTGGACTCCAACCGGTTTAACAAGGAAGAAAACCGGTTCAAGAGGAAGACCACGACGAGCCATAACAATCCCTGCTGAACCGGTCTATTGTCCGGTTCCAGCTCCAGCTCCTCCTCCTCCCTCAGTTCAACAACATGTGAGCAATCAAAGCAACAATGGTGAAACTGAAATGTGTTTAGAAGATAGAAGCTTTGCAGGTTGGGGTAAGATGACAAGAAGGCCTAGAAGACAACGATGTCCTTCAGCTTCAACTACAACTGCAACTACAAGTAACCAACGTTCATCATCACACGCGCCTTTCACGTGA

SEQ ID NO: 1755 - DNA, 1883 bp, Arabidopsis thaliana
  misc_feature (1)..(1883): Ceres cDNA ID no. 12679405
  misc_feature (1)..(1883): Also known as  Ceres CDNA ID no. 23360388
attcttctccgtctgccaaaatccccacttcacgaatcgcaaaagatcaaggtttattgatctattgcgaaattagggtttgtgaattcgaatcggagattaataatagattttgtgatggagtgttcatcacgcatagaagaatcttgatttcgatctcgatgaaattaggaatcgagggattttatttataattgagatggtgaatattaaaagccctttacggctattcatagaggagtcgattaaggaattaattaggggtttcaggagacaaaggatcaaatggagaaatgcgtttcttcttggttctataatgactaccattgttgttctgcttcatacaccaacgttttcagtcttctctgatgaagaagaaaccgagtcttcttcttcttcgcctatttacttgaatggttctctgcatttgaatatccatattgttagtagtgaagcaaaagttgaaaattttcatactcttagaacaagaactcctattgtgcaattgaatgcttctgaagcaagtgaagctgttctttcgagaaaaaggcgaaaaaggaagaaaagaaagaagacaaaagatgatctgattctcactgatcctccaccagcaccacgacatgttctatcttcctcagagagacgtgctctttccttgccaccgaagaaagctcttacttatgcaaaactggagattcagcgtgccccggaggtcataaatgatacagatctgtttgccccattgtttcgaaatctctctgttttcaaaaggagctatgagcttatggaactaatactaaaggtctacatatatcctgacggagacaaacccatcttccacgaaccgcatttaaatggtatatatgcttcagaaggttggtttatgaagctaatggagtcaaacaaacagtttgtcacaaagaaccctgagagggctcacttgttctacatgccatatagtgtgaaacagcttcagaaaagtatctttgttcctggatcacataacatcaaacctttatcgatctttcttagagactacgtcaacatgctctccatcaaataccccttctggaaccgcactcatgggtcagatcatttccttgtcgcttgccacgattggggtccttacacagtgaacgagcacccagagctaaaacgaaacgctattaaagctctctgcaatgcagacttatcagatggaatcttcgtcccggggaaagacgtttctctccctgaaacatccataagaaacgcaggtagaccactacgcaacataggaaacggaaacagagtttctcaacgtcccatcctcgctttcttcgctggaaacctccacggtcgtgtccgtccaaagcttctaaaacactggagaaacaaagacgaggacatgaaaatctacggtccgcttccacacaacgtagctaggaaaatgacttacgtacaacacatgaaatcaagcaagtactgtctttgtccaatgggttacgaagtgaacagtccacgtatcgttgaagctatatactatgaatgcgtccctgtagtgatcgctgataacttcatgttaccgttcagcgatgtgctagattggtcagcgttctcagtggttgtaccggagaaggagattccacggctgaaggagatactattggagattcctatgaggagatatttgaagatgcagagtaacgtgaagatggttcagagacatttcttgtggagccctaaacctagaaagtacgatgtgtttcatatgatacttcactccatttggtttaaccttctcaatcaaaaccaaacttcttttgatgatcatattcccgattcctgacatcatccttaattatgtctgtacattatatatattaagaaaactatttccattg

SEQ ID NO: 1756 - protein, 1883 aa, Arabidopsis thaliana
  misc_feature: PFam Name: TMPIT; PFam Description: TMPIT-like protein
  misc_feature: GI Number: 50758114; NR Description: PREDICTED: similar to transmembrane protein induced by tumor necrosis factor alpha
  misc_feature: GI Number: 34871732; NR Description: similar to transmembrane
  misc_feature: GI Number: 57870649; NR Description: Transmembrane protein induced by tumor necrosis factor alpha [Rattus norvegicus] gi|58219512|ref|NP_001010945.1| transmembrane protein induced by
  misc_feature: GI Number: 29789387; NR Description: transmembrane protein induced by tumor necrosis factor alpha [Mus musculus] >gi|28436931|gb|AAH46757.1| Transmembrane protein induced by tumor
  misc_feature: GI Number: 58701915; NR Description: Unknown (protein for
ATTCTTCTCCGTCTGCCAAAATCCCCACTTCACGAATCGCAAAAGATCAAGGTTTATTGATCTATTGCGAAATTAGGGTTTGTGAATTCGAATCGGAGATTAATAATAGATTTTGTGATGGAGTGTTCATCACGCATAGAAGAATCTTGATTTCGATCTCGATGAAATTAGGAATCGAGGGATTTTATTTATAATTGAGATGGTGAATATTAAAAGCCCTTTACGGCTATTCATAGAGGAGTCGATTAAGGAATTAATTAGGGGTTTCAGGAGACAAAGGATCAAATGGAGAAATGCGTTTCTTCTTGGTTCTATAATGACTACCATTGTTGTTCTGCTTCATACACCAACGTTTTCAGTCTTCTCTGATGAAGAAGAAACCGAGTCTTCTTCTTCTTCGCCTATTTACTTGAATGGTTCTCTGCATTTGAATATCCATATTGTTAGTAGTGAAGCAAAAGTTGAAAATTTTCATACTCTTAGAACAAGAACTCCTATTGTGCAATTGAATGCTTCTGAAGCAAGTGAAGCTGTTCTTTCGAGAAAAAGGCGAAAAAGGAAGAAAAGAAAGAAGACAAAAGATGATCTGATTCTCACTGATCCTCCACCAGCACCACGACATGTTCTATCTTCCTCAGAGAGACGTGCTCTTTCCTTGCCACCGAAGAAAGCTCTTACTTATGCAAAACTGGAGATTCAGCGTGCCCCGGAGGTCATAAATGATACAGATCTGTTTGCCCCATTGTTTCGAAATCTCTCTGTTTTCAAAAGGAGCTATGAGCTTATGGAACTAATACTAAAGGTCTACATATATCCTGACGGAGACAAACCCATCTTCCACGAACCGCATTTAAATGGTATATATGCTTCAGAAGGTTGGTTTATGAAGCTAATGGAGTCAAACAAACAGTTTGTCACAAAGAACCCTGAGAGGGCTCACTTGTTCTACATGCCATATAGTGTGAAACAGCTTCAGAAAAGTATCTTTGTTCCTGGATCACATAACATCAAACCTTTATCGATCTTTCTTAGAGACTACGTCAACATGCTCTCCATCAAATACCCCTTCTGGAACCGCACTCATGGGTCAGATCATTTCCTTGTCGCTTGCCACGATTGGGGTCCTTACACAGTGAACGAGCACCCAGAGCTAAAACGAAACGCTATTAAAGCTCTCTGCAATGCAGACTTATCAGATGGAATCTTCGTCCCGGGGAAAGACGTTTCTCTCCCTGAAACATCCATAAGAAACGCAGGTAGACCACTACGCAACATAGGAAACGGAAACAGAGTTTCTCAACGTCCCATCCTCGCTTTCTTCGCTGGAAACCTCCACGGTCGTGTCCGTCCAAAGCTTCTAAAACACTGGAGAAACAAAGACGAGGACATGAAAATCTACGGTCCGCTTCCACACAACGTAGCTAGGAAAATGACTTACGTACAACACATGAAATCAAGCAAGTACTGTCTTTGTCCAATGGGTTACGAAGTGAACAGTCCACGTATCGTTGAAGCTATATACTATGAATGCGTCCCTGTAGTGATCGCTGATAACTTCATGTTACCGTTCAGCGATGTGCTAGATTGGTCAGCGTTCTCAGTGGTTGTACCGGAGAAGGAGATTCCACGGCTGAAGGAGATACTATTGGAGATTCCTATGAGGAGATATTTGAAGATGCAGAGTAACGTGAAGATGGTTCAGAGACATTTCTTGTGGAGCCCTAAACCTAGAAAGTACGATGTGTTTCATATGATACTTCACTCCATTTGGTTTAACCTTCTCAATCAAAACCAAACTTCTTTTGATGATCATATTCCCGATTCCTGACATCATCCTTAATTATGTCTGTACATTATATATATTAAGAAAACTATTTCCATTG

SEQ ID NO: 1757 - DNA, 1669 bp, Arabidopsis thaliana
  misc_feature (1)..(1669): Ceres cDNA ID no. 12680146
  misc_feature (1)..(1669): Also known as  Ceres CDNA ID no. 23360388
gggtttctcagctgaaatcaaaatgggtattatcagatttcaaatcctgaatccgacgaggatttgtaggtctactatatattatatgtcttgccgttatctgccatcatcatcatcatcatcatcaccactccgagtatcttcttcttcatcgcaaaaacctagtttcgatttctccagaaggtggcattttggtcaccctgatcatcaccagcaatatcaaaagcctggagaagaaggggagaagatattccggctaggtctcaccgcagatataggtttatctgtcgcaaaagctctcaccggttatctctgcggcagcaccgccattatcgccgatgctgctcattccgtttccgatgtggttctaagtggtgttgctctagtgtcttacagagctgcaaatgttcccaaggacaaagaacatccttatggtcatggtaaatttgaaacgcttggagcacttggcatctctgccatgcttttggctactggctctggtattgcctggcatgctttagaccttttatctattgcactgtccgcagctcctgaggtaattcatagtggacatcatcacggcattgatatgaatcatcccattctcgctttgactgttactattgcttccatttctatcaaagaagggctttattggatcacaaaacgagcaggtgaaaaacaagggagtggtttgatgatggcaaatgcttggcatcatcgatcagatgctatttcttctctagttgcacttgttggagttggaggttctattctcggagttaattttttagatcctctagctggccttgttgtctcgacaatgattgtcaatgccggactgaaaacaggacaccaaagtatcttggaactcgtggatgctgctataccagctcagcaattagagccaataagacaaaccatattacaggttgaaggagtgaagggatgtcatcggctaaggggtaggagagctggttcatcgttgtatcttgatgtacacattgtggtagatcctttttccagtgtgagtgtcgcacatgaggtaggagaatatgtacggagacagattaatttgaaccatcctgaagtgtccgaagtttttattcatatagatccagcctttttacagttttcttgtagcaccaaggatcatgacagtataacgaaggaaagtaacatctgccaagagattaaacatgttgaagccactgtctcagacattttttcgtcgcagttgtctgagaaattgacgatcaaacgaattacaccccacttgttacatagcaagatcttgctccaaatcgtagtcgccatgccatcaaccatgtccatacaggacgtcatgatagctgctgaacatgcagagaaagagattctgaaggcagccccaaatgtggctcgtgtcagcattcagcttagtcttaactccgaataactttgaaggaaataacaagagaagacccctctgcaatggctgcaacaactataatttttaaaaaaagaaatacagtgcgctaactatgttcatactgattgtcaatattttgttgatatttctggctttctttacactgctcatcgaagttgtttctttctgatgagcaatttaatctcgaaaatttgcaacttgatgattccaaagctgagaaaagttttgggaatgtaa

SEQ ID NO: 1758 - protein, 1669 aa, Arabidopsis thaliana
  misc_feature: PFam Name: TMPIT; PFam Description: TMPIT-like protein
  misc_feature: GI Number: 50758114; NR Description: PREDICTED: similar to transmembrane protein induced by tumor necrosis factor alpha
  misc_feature: GI Number: 34871732; NR Description: similar to transmembrane
  misc_feature: GI Number: 57870649; NR Description: Transmembrane protein induced by tumor necrosis factor alpha [Rattus norvegicus] gi|58219512|ref|NP_001010945.1| transmembrane protein induced by
  misc_feature: GI Number: 29789387; NR Description: transmembrane protein induced by tumor necrosis factor alpha [Mus musculus] >gi|28436931|gb|AAH46757.1| Transmembrane protein induced by tumor
  misc_feature: GI Number: 58701915; NR Description: Unknown (protein for
GGGTTTCTCAGCTGAAATCAAAATGGGTATTATCAGATTTCAAATCCTGAATCCGACGAGGATTTGTAGGTCTACTATATATTATATGTCTTGCCGTTATCTGCCATCATCATCATCATCATCATCACCACTCCGAGTATCTTCTTCTTCATCGCAAAAACCTAGTTTCGATTTCTCCAGAAGGTGGCATTTTGGTCACCCTGATCATCACCAGCAATATCAAAAGCCTGGAGAAGAAGGGGAGAAGATATTCCGGCTAGGTCTCACCGCAGATATAGGTTTATCTGTCGCAAAAGCTCTCACCGGTTATCTCTGCGGCAGCACCGCCATTATCGCCGATGCTGCTCATTCCGTTTCCGATGTGGTTCTAAGTGGTGTTGCTCTAGTGTCTTACAGAGCTGCAAATGTTCCCAAGGACAAAGAACATCCTTATGGTCATGGTAAATTTGAAACGCTTGGAGCACTTGGCATCTCTGCCATGCTTTTGGCTACTGGCTCTGGTATTGCCTGGCATGCTTTAGACCTTTTATCTATTGCACTGTCCGCAGCTCCTGAGGTAATTCATAGTGGACATCATCACGGCATTGATATGAATCATCCCATTCTCGCTTTGACTGTTACTATTGCTTCCATTTCTATCAAAGAAGGGCTTTATTGGATCACAAAACGAGCAGGTGAAAAACAAGGGAGTGGTTTGATGATGGCAAATGCTTGGCATCATCGATCAGATGCTATTTCTTCTCTAGTTGCACTTGTTGGAGTTGGAGGTTCTATTCTCGGAGTTAATTTTTTAGATCCTCTAGCTGGCCTTGTTGTCTCGACAATGATTGTCAATGCCGGACTGAAAACAGGACACCAAAGTATCTTGGAACTCGTGGATGCTGCTATACCAGCTCAGCAATTAGAGCCAATAAGACAAACCATATTACAGGTTGAAGGAGTGAAGGGATGTCATCGGCTAAGGGGTAGGAGAGCTGGTTCATCGTTGTATCTTGATGTACACATTGTGGTAGATCCTTTTTCCAGTGTGAGTGTCGCACATGAGGTAGGAGAATATGTACGGAGACAGATTAATTTGAACCATCCTGAAGTGTCCGAAGTTTTTATTCATATAGATCCAGCCTTTTTACAGTTTTCTTGTAGCACCAAGGATCATGACAGTATAACGAAGGAAAGTAACATCTGCCAAGAGATTAAACATGTTGAAGCCACTGTCTCAGACATTTTTTCGTCGCAGTTGTCTGAGAAATTGACGATCAAACGAATTACACCCCACTTGTTACATAGCAAGATCTTGCTCCAAATCGTAGTCGCCATGCCATCAACCATGTCCATACAGGACGTCATGATAGCTGCTGAACATGCAGAGAAAGAGATTCTGAAGGCAGCCCCAAATGTGGCTCGTGTCAGCATTCAGCTTAGTCTTAACTCCGAATAACTTTGAAGGAAATAACAAGAGAAGACCCCTCTGCAATGGCTGCAACAACTATAATTTTTAAAAAAAGAAATACAGTGCGCTAACTATGTTCATACTGATTGTCAATATTTTGTTGATATTTCTGGCTTTCTTTACACTGCTCATCGAAGTTGTTTCTTTCTGATGAGCAATTTAATCTCGAAAATTTGCAACTTGATGATTCCAAAGCTGAGAAAAGTTTTGGGAATGTAA

SEQ ID NO: 1759 - DNA, 1305 bp, Arabidopsis thaliana
  misc_feature (1)..(1305): Ceres cDNA ID no. 12680186
  misc_feature (1)..(1305): Also known as  Ceres CDNA ID no. 23360388
ataaatacacatatctcactctctctgatctccgcttctcttcgccaacaaatgtcgaccgctcctctctccggcttctttctcacttcactttctccttctcaatcttctctccagaaactctctcttcgtacttcttccaccgtcgcttgcctcccacccgcctcttcttcttcctcatcttcctcctcctcgtcttcccgttccgttccaacgcttatccgtaacgagccagtttttgccgctcctgctcctatcattgccccttattggagtgaagagatgggaaccgaagcatacgacgaggctattgaagctctcaagaagcttctcatcgagaaggaagagctaaagacggttgcagcggcaaaggtggagcagatcacagcggctcttcagacaggtacttcatccgacaagaaagctttcgaccccgtcgaaaccattaagcagggcttcatcaaattcaagaaggagaaatacgaaaccaaccctgctttgtacggtgagctcgcaaagggtcaaagtcctaagtacatggtgtttgcttgttcagactcacgtgtgtgtccatcacacgttctggactttcagccaggagatgccttcgtggtccgtaacatagccaacatggttcctcctttcgacaaggtcaaatacggtggcgttggagcagccattgaatacgcggtcttacaccttaaggtggagaacattgtggtgataggacacagtgcatgtggtgggatcaaagggcttatgtctttccccttagatggaaacaactccactgacttcatagaggactgggtcaaaatctgtttaccagccaagtcaaaggttatatcagaacttggagattcagcctttgaagatcaatgtggccgatgtgaaagggaggcggtgaatgtttcactagcaaacctattgacatatccatttgtgagagaaggacttgtgaagggaacacttgctttgaagggaggctactatgacttcgtcaagggtgcttttgagctttggggacttgaatttggcctctccgaaactagctctgtatgaaccaatccatcatcatcatcatcatcatgaccatccatcatcatcatcattattatcatcgtatataatatatatctaccccatatgtaatttgtaatgtgcctttgactgtgatgagttatctctccctctctaccaactttcttcatatatataaaacaaaaaggaaaagcagatgatatagatctttcgtggtttaattatgaacaattgtctttattatttgtgtatcaaatcggttgt

SEQ ID NO: 1760 - protein, 1305 aa, Arabidopsis thaliana
  misc_feature: PFam Name: TMPIT; PFam Description: TMPIT-like protein
  misc_feature: GI Number: 50758114; NR Description: PREDICTED: similar to transmembrane protein induced by tumor necrosis factor alpha
  misc_feature: GI Number: 34871732; NR Description: similar to transmembrane
  misc_feature: GI Number: 57870649; NR Description: Transmembrane protein induced by tumor necrosis factor alpha [Rattus norvegicus] gi|58219512|ref|NP_001010945.1| transmembrane protein induced by
  misc_feature: GI Number: 29789387; NR Description: transmembrane protein induced by tumor necrosis factor alpha [Mus musculus] >gi|28436931|gb|AAH46757.1| Transmembrane protein induced by tumor
  misc_feature: GI Number: 58701915; NR Description: Unknown (protein for
ATAAATACACATATCTCACTCTCTCTGATCTCCGCTTCTCTTCGCCAACAAATGTCGACCGCTCCTCTCTCCGGCTTCTTTCTCACTTCACTTTCTCCTTCTCAATCTTCTCTCCAGAAACTCTCTCTTCGTACTTCTTCCACCGTCGCTTGCCTCCCACCCGCCTCTTCTTCTTCCTCATCTTCCTCCTCCTCGTCTTCCCGTTCCGTTCCAACGCTTATCCGTAACGAGCCAGTTTTTGCCGCTCCTGCTCCTATCATTGCCCCTTATTGGAGTGAAGAGATGGGAACCGAAGCATACGACGAGGCTATTGAAGCTCTCAAGAAGCTTCTCATCGAGAAGGAAGAGCTAAAGACGGTTGCAGCGGCAAAGGTGGAGCAGATCACAGCGGCTCTTCAGACAGGTACTTCATCCGACAAGAAAGCTTTCGACCCCGTCGAAACCATTAAGCAGGGCTTCATCAAATTCAAGAAGGAGAAATACGAAACCAACCCTGCTTTGTACGGTGAGCTCGCAAAGGGTCAAAGTCCTAAGTACATGGTGTTTGCTTGTTCAGACTCACGTGTGTGTCCATCACACGTTCTGGACTTTCAGCCAGGAGATGCCTTCGTGGTCCGTAACATAGCCAACATGGTTCCTCCTTTCGACAAGGTCAAATACGGTGGCGTTGGAGCAGCCATTGAATACGCGGTCTTACACCTTAAGGTGGAGAACATTGTGGTGATAGGACACAGTGCATGTGGTGGGATCAAAGGGCTTATGTCTTTCCCCTTAGATGGAAACAACTCCACTGACTTCATAGAGGACTGGGTCAAAATCTGTTTACCAGCCAAGTCAAAGGTTATATCAGAACTTGGAGATTCAGCCTTTGAAGATCAATGTGGCCGATGTGAAAGGGAGGCGGTGAATGTTTCACTAGCAAACCTATTGACATATCCATTTGTGAGAGAAGGACTTGTGAAGGGAACACTTGCTTTGAAGGGAGGCTACTATGACTTCGTCAAGGGTGCTTTTGAGCTTTGGGGACTTGAATTTGGCCTCTCCGAAACTAGCTCTGTATGAACCAATCCATCATCATCATCATCATCATGACCATCCATCATCATCATCATTATTATCATCGTATATAATATATATCTACCCCATATGTAATTTGTAATGTGCCTTTGACTGTGATGAGTTATCTCTCCCTCTCTACCAACTTTCTTCATATATATAAAACAAAAAGGAAAAGCAGATGATATAGATCTTTCGTGGTTTAATTATGAACAATTGTCTTTATTATTTGTGTATCAAATCGGTTGT

SEQ ID NO: 1761 - DNA, 1415 bp, Arabidopsis thaliana
  misc_feature (1)..(1415): Ceres cDNA ID no. 12680363
  misc_feature (1)..(1415): Also known as  Ceres CDNA ID no. 23360388
acacacatataacaatctcttcttctctgacattacacaatggtggtttgagtttacagaagataataatggggaaaactagcaaatggtttcgaagtctcttaaccggaaagaaagagagaacaaaggaacatatcattcaaagcgagtgtgtattcacttcttccattccaggcactcctaaggagaaacgtcgatggagttttcgacgttcttcagcaactggaccaccgccaccagcttgtgctattacactgaaagattcaccaccaccgccgccaccaccacctccacctccaccgctacaacaaccatttgtggtcgaaatcgtggacaatgaagatgaacaaatcaagaacgtttcagctgaagagattgaagaatttgcagcaataaagattcaagcgtgctatcgttctcatttggcgaggaaagcattaagagcattaaaagggttagtgaaattacaagcactagtgagaggtcatttagtaaggaaacaagcaacagctacacttagatgtatgcaagcattaataacacttcaagccaaagctcgagaacagaggattcgtatgatcggaggagattcaacaaatccaagaacatcgattcacaaaaccaggatcaataacttttaccacgagaatgaagaaaacatcaagattgtggaaatggacattcaatcgaaaatgtactctccggctccttcggctttaaccgagatgagtcctcgcgcgtatagtagccatttcgaggattgtaactcattcaacacagctcaaagtagtccacaatgtttcagcagattcaaagagtattacaatggagatactttgtcttcttatgattaccctctcttccctaattacatggctaatactcagtcttctaaagccaaggctcggtctcaaagtgcgccgaagcagagacctcctgagatctatgagaagcagatgagtgggaggagaagatcttcgatggaagcaccgaggaataacggtgtcccgagagctgtaaggatgcagagatcttcatctcaactagggtcaaacacagccaaggaaagtcaacaacatcatcatcatcagtactatccgtggatggcgataaagctcgatagatctaatatttcgcttatggagagcgaatgcggatctacaagtaccgttatgactaataccaactacggtagacatgttgatgttcagggaaacaacaacatgtactgaacactgtgctttagaatttgagagattgctggaaaaataggcaagcctaaaaaacgaagaggacaggtttataggagttttttttatgatgatggagatttaacaatctctatatgtaaagcaaaaaatgtagtagactgtagaagtgactcatctcgtcttaaattttgatttttccttttt

SEQ ID NO: 1762 - protein, 1415 aa, Arabidopsis thaliana
  misc_feature: PFam Name: TMPIT; PFam Description: TMPIT-like protein
  misc_feature: GI Number: 50758114; NR Description: PREDICTED: similar to transmembrane protein induced by tumor necrosis factor alpha
  misc_feature: GI Number: 34871732; NR Description: similar to transmembrane
  misc_feature: GI Number: 57870649; NR Description: Transmembrane protein induced by tumor necrosis factor alpha [Rattus norvegicus] gi|58219512|ref|NP_001010945.1| transmembrane protein induced by
  misc_feature: GI Number: 29789387; NR Description: transmembrane protein induced by tumor necrosis factor alpha [Mus musculus] >gi|28436931|gb|AAH46757.1| Transmembrane protein induced by tumor
  misc_feature: GI Number: 58701915; NR Description: Unknown (protein for
ACACACATATAACAATCTCTTCTTCTCTGACATTACACAATGGTGGTTTGAGTTTACAGAAGATAATAATGGGGAAAACTAGCAAATGGTTTCGAAGTCTCTTAACCGGAAAGAAAGAGAGAACAAAGGAACATATCATTCAAAGCGAGTGTGTATTCACTTCTTCCATTCCAGGCACTCCTAAGGAGAAACGTCGATGGAGTTTTCGACGTTCTTCAGCAACTGGACCACCGCCACCAGCTTGTGCTATTACACTGAAAGATTCACCACCACCGCCGCCACCACCACCTCCACCTCCACCGCTACAACAACCATTTGTGGTCGAAATCGTGGACAATGAAGATGAACAAATCAAGAACGTTTCAGCTGAAGAGATTGAAGAATTTGCAGCAATAAAGATTCAAGCGTGCTATCGTTCTCATTTGGCGAGGAAAGCATTAAGAGCATTAAAAGGGTTAGTGAAATTACAAGCACTAGTGAGAGGTCATTTAGTAAGGAAACAAGCAACAGCTACACTTAGATGTATGCAAGCATTAATAACACTTCAAGCCAAAGCTCGAGAACAGAGGATTCGTATGATCGGAGGAGATTCAACAAATCCAAGAACATCGATTCACAAAACCAGGATCAATAACTTTTACCACGAGAATGAAGAAAACATCAAGATTGTGGAAATGGACATTCAATCGAAAATGTACTCTCCGGCTCCTTCGGCTTTAACCGAGATGAGTCCTCGCGCGTATAGTAGCCATTTCGAGGATTGTAACTCATTCAACACAGCTCAAAGTAGTCCACAATGTTTCAGCAGATTCAAAGAGTATTACAATGGAGATACTTTGTCTTCTTATGATTACCCTCTCTTCCCTAATTACATGGCTAATACTCAGTCTTCTAAAGCCAAGGCTCGGTCTCAAAGTGCGCCGAAGCAGAGACCTCCTGAGATCTATGAGAAGCAGATGAGTGGGAGGAGAAGATCTTCGATGGAAGCACCGAGGAATAACGGTGTCCCGAGAGCTGTAAGGATGCAGAGATCTTCATCTCAACTAGGGTCAAACACAGCCAAGGAAAGTCAACAACATCATCATCATCAGTACTATCCGTGGATGGCGATAAAGCTCGATAGATCTAATATTTCGCTTATGGAGAGCGAATGCGGATCTACAAGTACCGTTATGACTAATACCAACTACGGTAGACATGTTGATGTTCAGGGAAACAACAACATGTACTGAACACTGTGCTTTAGAATTTGAGAGATTGCTGGAAAAATAGGCAAGCCTAAAAAACGAAGAGGACAGGTTTATAGGAGTTTTTTTTATGATGATGGAGATTTAACAATCTCTATATGTAAAGCAAAAAATGTAGTAGACTGTAGAAGTGACTCATCTCGTCTTAAATTTTGATTTTTCCTTTTT

SEQ ID NO: 1763 - DNA, 1276 bp, Arabidopsis thaliana
  misc_feature (1)..(1276): Ceres cDNA ID no. 12680700
  misc_feature (1)..(1276): Also known as  Ceres CDNA ID no. 23360388
atctgaaaccaatctgttcatatgatgaagaagtttctctcgttctcctccaacgcgtagaaaattctgacggcttaacgatgtggcgaagatctgttgtttatcgtttctcttcaagaatctctgtttcttcttcgttaccaaaccctagactgattccttggtcccgcgaattatgtgccgttaatagcttctcccagcctccggtctcgacggaatcaactgctaagttagggatcactggtgttagatctgatgccaatcgagtttttgccactgctactgccgccgctacagctacagctaccaccggtgagatttcgtctagagttgcggctttggctggattagggcatcactacgctcgttgttattgggagctttctaaagctaaacttagtatgcttgtggttgcaacttctggaactgggtatattctgggtacgggaaatgctgcaattagcttcccggggctttgttacacatgtgcaggaaccatgatgattgctgcatctgctaattccttgaatcagatttttgagataagcaatgattctaagatgaaaagaacgatgctaaggccattgccttcaggacgtattagtgttccacacgctgttgcatgggctactattgctggtgcttctggtgcttgtttgttggccagcaagactaatatgttggctgctggacttgcatctgccaatcttgtactttatgcgtttgtttatactccgttgaagcaacttcaccctatcaatacatgggttggcgctgttgttggtgctatcccacccttgcttgggtgggcggcagcgtctggtcagatttcatacaattcgatgattcttccagctgctctttacttttggcagatacctcattttatggcccttgcacatctctgccgcaatgattatgcagctggaggttacaagatgttgtcactctttgatccgtcagggaagagaatagcagcagtggctctaaggaactgcttttacatgatccctctcggtttcatcgcctatgactgggggttaacctcaagttggttttgcctcgaatcaacacttctcacactagcaatcgctgcaacagcattttcattctactctccatgataacctttaagcaagctattgaatttttggaaacagaaattaaaaaaaaaatctgaaaagttcttaagtttaatctttggttaataatgaagtggagaacgcatacaagtttatgtattttttctcatctccacataattgtattttttctc

SEQ ID NO: 1764 - protein, 1276 aa, Arabidopsis thaliana
  misc_feature: PFam Name: TMPIT; PFam Description: TMPIT-like protein
  misc_feature: GI Number: 50758114; NR Description: PREDICTED: similar to transmembrane protein induced by tumor necrosis factor alpha
  misc_feature: GI Number: 34871732; NR Description: similar to transmembrane
  misc_feature: GI Number: 57870649; NR Description: Transmembrane protein induced by tumor necrosis factor alpha [Rattus norvegicus] gi|58219512|ref|NP_001010945.1| transmembrane protein induced by
  misc_feature: GI Number: 29789387; NR Description: transmembrane protein induced by tumor necrosis factor alpha [Mus musculus] >gi|28436931|gb|AAH46757.1| Transmembrane protein induced by tumor
  misc_feature: GI Number: 58701915; NR Description: Unknown (protein for
ATCTGAAACCAATCTGTTCATATGATGAAGAAGTTTCTCTCGTTCTCCTCCAACGCGTAGAAAATTCTGACGGCTTAACGATGTGGCGAAGATCTGTTGTTTATCGTTTCTCTTCAAGAATCTCTGTTTCTTCTTCGTTACCAAACCCTAGACTGATTCCTTGGTCCCGCGAATTATGTGCCGTTAATAGCTTCTCCCAGCCTCCGGTCTCGACGGAATCAACTGCTAAGTTAGGGATCACTGGTGTTAGATCTGATGCCAATCGAGTTTTTGCCACTGCTACTGCCGCCGCTACAGCTACAGCTACCACCGGTGAGATTTCGTCTAGAGTTGCGGCTTTGGCTGGATTAGGGCATCACTACGCTCGTTGTTATTGGGAGCTTTCTAAAGCTAAACTTAGTATGCTTGTGGTTGCAACTTCTGGAACTGGGTATATTCTGGGTACGGGAAATGCTGCAATTAGCTTCCCGGGGCTTTGTTACACATGTGCAGGAACCATGATGATTGCTGCATCTGCTAATTCCTTGAATCAGATTTTTGAGATAAGCAATGATTCTAAGATGAAAAGAACGATGCTAAGGCCATTGCCTTCAGGACGTATTAGTGTTCCACACGCTGTTGCATGGGCTACTATTGCTGGTGCTTCTGGTGCTTGTTTGTTGGCCAGCAAGACTAATATGTTGGCTGCTGGACTTGCATCTGCCAATCTTGTACTTTATGCGTTTGTTTATACTCCGTTGAAGCAACTTCACCCTATCAATACATGGGTTGGCGCTGTTGTTGGTGCTATCCCACCCTTGCTTGGGTGGGCGGCAGCGTCTGGTCAGATTTCATACAATTCGATGATTCTTCCAGCTGCTCTTTACTTTTGGCAGATACCTCATTTTATGGCCCTTGCACATCTCTGCCGCAATGATTATGCAGCTGGAGGTTACAAGATGTTGTCACTCTTTGATCCGTCAGGGAAGAGAATAGCAGCAGTGGCTCTAAGGAACTGCTTTTACATGATCCCTCTCGGTTTCATCGCCTATGACTGGGGGTTAACCTCAAGTTGGTTTTGCCTCGAATCAACACTTCTCACACTAGCAATCGCTGCAACAGCATTTTCATTCTACTCTCCATGATAACCTTTAAGCAAGCTATTGAATTTTTGGAAACAGAAATTAAAAAAAAAATCTGAAAAGTTCTTAAGTTTAATCTTTGGTTAATAATGAAGTGGAGAACGCATACAAGTTTATGTATTTTTTCTCATCTCCACATAATTGTATTTTTTCTC

SEQ ID NO: 1765 - DNA, 1607 bp, Arabidopsis thaliana
  misc_feature (1)..(1607): Ceres cDNA ID no. 12680916
agaagattcttaaatctcatttctgcggcgtaggtgaagtcttagcgataagctttgtttcttcttcttcttcttctttacccatggatttttaacgaacaagagaagagaagaaccaagttttcttcgaaaggattgaactttgtttctttctcttcagctacaacaaccaaaaaatgatcaagctttgcttcatgacttctcatggttattcaatccctggccttggtcttcctcaagacctctgcaacaccgaaatcatcaagcagaatagccggtctcatctggtgaatcccggagcaagacaagagatcatacctgcaagctccttcaatctgaatacagaactcttggaaccatggaaaccggtttcttcatttagccaattcgtggagattgattcagccatgatgaaacctctgctcatggatgttcatgagacggcaccagaatctctgattttgagctttggaatcgctgataagtttgcaagacaagaaaaggtgatggagtttcttctgtctcagtcagaggagttcaaggaaaaaggattcgatatgtcgctgttaaatgaattgatggagtttgagtctatgaaatccagttctcagctacgaccgtatgatacttcctctgttctttacttgaatcaagaattagggaaaccggttttggatctcgttagggatatgatggagaatccagagttctctgtgcgatcgaatggtcatgttctgttctcttcaagtagcaatcctgagttgaatgatctactttctattgcttccgagttcaatttgtcaaggaattcaacaacaaaatggagacagctctcaccgcttatcccacactttcagaggtttgaaagtgacgtatttacaccggctaagctgaaagcagttacagtgctagcacctttgaagagtcctgagaaaagcaggctcaagtcaccaaggaaacacaacacgaagcgaaaagctaaagagagggacctatacaaaagaaatcatctccacgcttacgagagccttctctctttaatgataggcaatgatcatcgacacaaacacacaacagtactctctttacagaaatcatgtggagagctctcagagcttctgactcagttctctatcactgctgctggaactggaatcgctgtgctcttttctgtcgtatgtagccttgcttcaaggcgtgtacccttttgcgcaaataagttcttcgacactgggcttggtttgagtttggtaatactgtcatgggctgtgaatagactcagggaggtgattgttcatgtcaataggaaagcgaacaagccatgttcaagtttgaaagatgacgaaatcataaacagtgtggagagaagtatgaaggaggtttactacagagctgcaacggtaatcgcggtgtttgcgcttaggtttgcatgttgaaaaatcggggtgagaggtaaaaatcttgatttactactccatggaaagcttctaaaaggtcgtttgtaaatgactaaaacttgtttagtagctgtaaatgtgaaagatgatattatgtggtagaacctaagattaagaggtgaagaattttgaagagaataaatgttttgc

SEQ ID NO: 1766 - protein, 413 aa, Arabidopsis thaliana
  misc_feature: GI Number: 21594458; NR Description: unknown [Arabidopsis thaliana]
MTSHGYSIPGLGLPQDLCNTEIIKQNSRSHLVNPGARQEIIPASSFNLNTELLEPWKPVSSFSQFVEIDSAMMKPLLMDVHETAPESLILSFGIADKFARQEKVMEFLLSQSEEFKEKGFDMSLLNELMEFESMKSSSQLRPYDTSSVLYLNQELGKPVLDLVRDMMENPEFSVRSNGHVLFSSSSNPELNDLLSIASEFNLSRNSTTKWRQLSPLIPHFQRFESDVFTPAKLKAVTVLAPLKSPEKSRLKSPRKHNTKRKAKERDLYKRNHLHAYESLLSLMIGNDHRHKHTTVLSLQKSCGELSELLTQFSITAAGTGIAVLFSVVCSLASRRVPFCANKFFDTGLGLSLVILSWAVNRLREVIVHVNRKANKPCSSLKDDEIINSVERSMKEVYYRAATVIAVFALRFAC

SEQ ID NO: 1767 - DNA, 1941 bp, Arabidopsis thaliana
  misc_feature (1)..(1941): Ceres cDNA ID no. 12681211
  misc_feature (1)..(1941): Also known as  Ceres CDNA ID no. 23360388
ctgcaaattcgaagctccgttgagctcgaatcagagaagtagctatttcgtacaaccccagaacgatatatttttttctgggtttccttgaacataccacactcacggtcacgggatccataccaagcttccgtagccatggggtttgatcccgagaaccaatcgatctcttccgttggacaggttgttggtgattcttcttcaggtgggattactgctgaaaaggaacctttgttaaaggaaaaccacagcccagagaactactctgttcttgcagccattcctccgtttctctttccagctcttggagcattgctttttggttatgaaattggtgcaacatcttgtgctatcatgtctcttaagtcgcctactctaagtggaatttcatggtacgacttgtcttcagtggatgttggtataattaccagtggctcactgtatggtgccttaattggctccattgttgcatttagtgttgccgacattataggaaggagaaaggagctgattttggctgcattcttgtatcttgttggagccattgtgactgtagtagcacctgtcttttccatactgataattggacgagttacgtatggcatggggattggactgaccatgcacgcggctccaatgtacattgcagagactgctccaagtcaaatacgtggacggatgatatcactaaaggaattctccactgtccttgggatggttgggggttatggaatcggtagcctttggattacggttatttctggttggcgttacatgtacgcaacaattctcccttttccagttattatgggaactggaatgtgttggctaccagcatctccgaggtggcttttactgcgcgctctccagggacaaggaaatggggagaatcttcaacaggctgcgattagatctctttgtcgccttagagggtctgtcatagctgactcagcagctgaacaagtaaacgaaatattggctgaactttcccttgtgggtgaagacaaagaagctacatttggtgaattatttcgaggcaaatgcttgaaagctctcactatagcaggagggttagtcttgttccaacagataactgggcaaccaagtgtactatattatgcaccatcaatactacagactgccggcttttctgctgcagctgatgcaactcggatctcaattctgctcggcctattgaagttggttatgacaggagtttctgtgatagttatcgacagagttggaaggagacctttacttctttgtggtgttagcggaatggtgatctcattgttcctcctgggatcctactacatgttttataaaaatgtaccagctgttgctgtagctgcattgctactgtatgtaggctgttaccagctgtcctttggccctattggttggctgatgatttcagagatatttcccttaaaattaagaggtagaggaatcagtctagcagtgcttgtgaattttggcgcaaacgcacttgtgacattcgctttctcaccgctaaaggagctgttaggagctggaatactgttctgtgcatttggagtgatatgtgtcgtgtctctcttcttcatatactacattgtgccagagacaaagggtctcactcttgaagaaattgaagccaaatgtctctaaaaggttactcatcttagctccactttctgtgctgcttcattgcttgaggatctaaatcgcaaacgcaccagccgcatgtgtagtcactagtcagccatttatcgcggaattttcactgtttggatatcttttaaagaatggttgtatctagcggcaaaatttggtgcgttggaaaagttttaaaattcgaaagtttgcttaatttgtattttaaaacacgcattcaaaattttgtgattgtatgaaaataatgtgagattcaaaattttatgaaacaatattgtaacgtcg

SEQ ID NO: 1768 - protein, 1941 aa, Arabidopsis thaliana
  misc_feature: PFam Name: TMPIT; PFam Description: TMPIT-like protein
  misc_feature: GI Number: 50758114; NR Description: PREDICTED: similar to transmembrane protein induced by tumor necrosis factor alpha
  misc_feature: GI Number: 34871732; NR Description: similar to transmembrane
  misc_feature: GI Number: 57870649; NR Description: Transmembrane protein induced by tumor necrosis factor alpha [Rattus norvegicus] gi|58219512|ref|NP_001010945.1| transmembrane protein induced by
  misc_feature: GI Number: 29789387; NR Description: transmembrane protein induced by tumor necrosis factor alpha [Mus musculus] >gi|28436931|gb|AAH46757.1| Transmembrane protein induced by tumor
  misc_feature: GI Number: 58701915; NR Description: Unknown (protein for
CTGCAAATTCGAAGCTCCGTTGAGCTCGAATCAGAGAAGTAGCTATTTCGTACAACCCCAGAACGATATATTTTTTTCTGGGTTTCCTTGAACATACCACACTCACGGTCACGGGATCCATACCAAGCTTCCGTAGCCATGGGGTTTGATCCCGAGAACCAATCGATCTCTTCCGTTGGACAGGTTGTTGGTGATTCTTCTTCAGGTGGGATTACTGCTGAAAAGGAACCTTTGTTAAAGGAAAACCACAGCCCAGAGAACTACTCTGTTCTTGCAGCCATTCCTCCGTTTCTCTTTCCAGCTCTTGGAGCATTGCTTTTTGGTTATGAAATTGGTGCAACATCTTGTGCTATCATGTCTCTTAAGTCGCCTACTCTAAGTGGAATTTCATGGTACGACTTGTCTTCAGTGGATGTTGGTATAATTACCAGTGGCTCACTGTATGGTGCCTTAATTGGCTCCATTGTTGCATTTAGTGTTGCCGACATTATAGGAAGGAGAAAGGAGCTGATTTTGGCTGCATTCTTGTATCTTGTTGGAGCCATTGTGACTGTAGTAGCACCTGTCTTTTCCATACTGATAATTGGACGAGTTACGTATGGCATGGGGATTGGACTGACCATGCACGCGGCTCCAATGTACATTGCAGAGACTGCTCCAAGTCAAATACGTGGACGGATGATATCACTAAAGGAATTCTCCACTGTCCTTGGGATGGTTGGGGGTTATGGAATCGGTAGCCTTTGGATTACGGTTATTTCTGGTTGGCGTTACATGTACGCAACAATTCTCCCTTTTCCAGTTATTATGGGAACTGGAATGTGTTGGCTACCAGCATCTCCGAGGTGGCTTTTACTGCGCGCTCTCCAGGGACAAGGAAATGGGGAGAATCTTCAACAGGCTGCGATTAGATCTCTTTGTCGCCTTAGAGGGTCTGTCATAGCTGACTCAGCAGCTGAACAAGTAAACGAAATATTGGCTGAACTTTCCCTTGTGGGTGAAGACAAAGAAGCTACATTTGGTGAATTATTTCGAGGCAAATGCTTGAAAGCTCTCACTATAGCAGGAGGGTTAGTCTTGTTCCAACAGATAACTGGGCAACCAAGTGTACTATATTATGCACCATCAATACTACAGACTGCCGGCTTTTCTGCTGCAGCTGATGCAACTCGGATCTCAATTCTGCTCGGCCTATTGAAGTTGGTTATGACAGGAGTTTCTGTGATAGTTATCGACAGAGTTGGAAGGAGACCTTTACTTCTTTGTGGTGTTAGCGGAATGGTGATCTCATTGTTCCTCCTGGGATCCTACTACATGTTTTATAAAAATGTACCAGCTGTTGCTGTAGCTGCATTGCTACTGTATGTAGGCTGTTACCAGCTGTCCTTTGGCCCTATTGGTTGGCTGATGATTTCAGAGATATTTCCCTTAAAATTAAGAGGTAGAGGAATCAGTCTAGCAGTGCTTGTGAATTTTGGCGCAAACGCACTTGTGACATTCGCTTTCTCACCGCTAAAGGAGCTGTTAGGAGCTGGAATACTGTTCTGTGCATTTGGAGTGATATGTGTCGTGTCTCTCTTCTTCATATACTACATTGTGCCAGAGACAAAGGGTCTCACTCTTGAAGAAATTGAAGCCAAATGTCTCTAAAAGGTTACTCATCTTAGCTCCACTTTCTGTGCTGCTTCATTGCTTGAGGATCTAAATCGCAAACGCACCAGCCGCATGTGTAGTCACTAGTCAGCCATTTATCGCGGAATTTTCACTGTTTGGATATCTTTTAAAGAATGGTTGTATCTAGCGGCAAAATTTGGTGCGTTGGAAAAGTTTTAAAATTCGAAAGTTTGCTTAATTTGTATTTTAAAACACGCATTCAAAATTTTGTGATTGTATGAAAATAATGTGAGATTCAAAATTTTATGAAACAATATTGTAACGTCG

SEQ ID NO: 1769 - DNA, 1614 bp, Arabidopsis thaliana
  misc_feature (1)..(1614): Ceres cDNA ID no. 12681472
  misc_feature (1)..(1614): Also known as  Ceres CDNA ID no. 23360388
atggcgacagtaggatccctgaaacctctgcaccattcctcatgttcatcgagtttccctcggaatccgatcgtaaaccggaaagcccttcttggttttgtgtttgattctgcccggaaaaaccagattcgatgtgagaatttacgatattcatcggaaagcgatgggaagagaagaaatgcggcggcgaagaagaggaatcaatccccggaaagatgtgcggcggagggagtactgaccggaggaggggggtcggaggcgattgcggaggtgaggacgatgatgcctgagaggattaaggtagtgatattgacggcgtgcatgatgtgtctatgtaacgccgacagagttgttatgtccgtcgcggtggttccactcgccgataagcttggctggtcgagttctttcttaggggtagttcagtcctccttcctatggggttacattttttcatccgttatcggaggggcattggtggatcggtatggaggaaaaagagtgttggcttggggtgtggcattgtggtccttagccactctactcactccttgggcagctgcacactcgaccttagccttattgtgtgtccgcgccttttttggcctcgctgaaggcgttgcaatgccctccatgaccaccctactctctcggtggtttccaatggatgaacgagcgagtgcggttggtatatctatggccgggtttcacatgggaaatgttgtgggacttctgttgacgccactcatgttatcttccataggaatctctggtccatttattctttttgcatccttaggtctattgtgggtatccacttggtcaagcggagttacaaacaaccctcaggacagtcctttcatcactaggtcagaactcaggcttatccaggctggaaaaccagttcaaccgtcaaccatttcgccgaaaccaaacccatctttgcgacttcttttgtcgaaattgcctacttgggcgatcatttttgctaatgtgactaacaactggggatactttgttcttctctcatggatgcctgtttacttccagacggtgtttaatgtgaatttgaagcaagcagcttggtttagcgctcttccatgggcgacaatggcgatctcaggttactatgcaggagcagcatcggacttcttgataagaactggtcactctgtaacctcagtacgaaagatcatgcaatctattggatttatgggtcccgggctgtctctgctctgcctcaacttcgcaaagtcgccttcttgtgcagcggttttcatgaccattgcattgagcttgagttcctttagccaagctggatttctcctcaatatgcaagacatcgcaccgcaatatgctgatggtggatcttttcttcttcttcttttgcatcgattttgtttcttgctgaaaaagttagggtttgtatatctggtgtgcgagacaggtatttcgaattgtgcgggtacgttggctgcgatcgtaagtacaatagggacgggatattttgtgcagtggctcggctcttttcaggcgttcttgacggttacggcctttctttactttgcaaccaccgtgttttggctcctctttgcaaccggagaacgagtcttctag

SEQ ID NO: 1770 - protein, 1614 aa, Arabidopsis thaliana
  misc_feature: PFam Name: TMPIT; PFam Description: TMPIT-like protein
  misc_feature: GI Number: 50758114; NR Description: PREDICTED: similar to transmembrane protein induced by tumor necrosis factor alpha
  misc_feature: GI Number: 34871732; NR Description: similar to transmembrane
  misc_feature: GI Number: 57870649; NR Description: Transmembrane protein induced by tumor necrosis factor alpha [Rattus norvegicus] gi|58219512|ref|NP_001010945.1| transmembrane protein induced by
  misc_feature: GI Number: 29789387; NR Description: transmembrane protein induced by tumor necrosis factor alpha [Mus musculus] >gi|28436931|gb|AAH46757.1| Transmembrane protein induced by tumor
  misc_feature: GI Number: 58701915; NR Description: Unknown (protein for
ATGGCGACAGTAGGATCCCTGAAACCTCTGCACCATTCCTCATGTTCATCGAGTTTCCCTCGGAATCCGATCGTAAACCGGAAAGCCCTTCTTGGTTTTGTGTTTGATTCTGCCCGGAAAAACCAGATTCGATGTGAGAATTTACGATATTCATCGGAAAGCGATGGGAAGAGAAGAAATGCGGCGGCGAAGAAGAGGAATCAATCCCCGGAAAGATGTGCGGCGGAGGGAGTACTGACCGGAGGAGGGGGGTCGGAGGCGATTGCGGAGGTGAGGACGATGATGCCTGAGAGGATTAAGGTAGTGATATTGACGGCGTGCATGATGTGTCTATGTAACGCCGACAGAGTTGTTATGTCCGTCGCGGTGGTTCCACTCGCCGATAAGCTTGGCTGGTCGAGTTCTTTCTTAGGGGTAGTTCAGTCCTCCTTCCTATGGGGTTACATTTTTTCATCCGTTATCGGAGGGGCATTGGTGGATCGGTATGGAGGAAAAAGAGTGTTGGCTTGGGGTGTGGCATTGTGGTCCTTAGCCACTCTACTCACTCCTTGGGCAGCTGCACACTCGACCTTAGCCTTATTGTGTGTCCGCGCCTTTTTTGGCCTCGCTGAAGGCGTTGCAATGCCCTCCATGACCACCCTACTCTCTCGGTGGTTTCCAATGGATGAACGAGCGAGTGCGGTTGGTATATCTATGGCCGGGTTTCACATGGGAAATGTTGTGGGACTTCTGTTGACGCCACTCATGTTATCTTCCATAGGAATCTCTGGTCCATTTATTCTTTTTGCATCCTTAGGTCTATTGTGGGTATCCACTTGGTCAAGCGGAGTTACAAACAACCCTCAGGACAGTCCTTTCATCACTAGGTCAGAACTCAGGCTTATCCAGGCTGGAAAACCAGTTCAACCGTCAACCATTTCGCCGAAACCAAACCCATCTTTGCGACTTCTTTTGTCGAAATTGCCTACTTGGGCGATCATTTTTGCTAATGTGACTAACAACTGGGGATACTTTGTTCTTCTCTCATGGATGCCTGTTTACTTCCAGACGGTGTTTAATGTGAATTTGAAGCAAGCAGCTTGGTTTAGCGCTCTTCCATGGGCGACAATGGCGATCTCAGGTTACTATGCAGGAGCAGCATCGGACTTCTTGATAAGAACTGGTCACTCTGTAACCTCAGTACGAAAGATCATGCAATCTATTGGATTTATGGGTCCCGGGCTGTCTCTGCTCTGCCTCAACTTCGCAAAGTCGCCTTCTTGTGCAGCGGTTTTCATGACCATTGCATTGAGCTTGAGTTCCTTTAGCCAAGCTGGATTTCTCCTCAATATGCAAGACATCGCACCGCAATATGCTGATGGTGGATCTTTTCTTCTTCTTCTTTTGCATCGATTTTGTTTCTTGCTGAAAAAGTTAGGGTTTGTATATCTGGTGTGCGAGACAGGTATTTCGAATTGTGCGGGTACGTTGGCTGCGATCGTAAGTACAATAGGGACGGGATATTTTGTGCAGTGGCTCGGCTCTTTTCAGGCGTTCTTGACGGTTACGGCCTTTCTTTACTTTGCAACCACCGTGTTTTGGCTCCTCTTTGCAACCGGAGAACGAGTCTTCTAG

SEQ ID NO: 1771 - DNA, 1362 bp, Arabidopsis thaliana
  misc_feature (1)..(1362): Ceres cDNA ID no. 12681815
  misc_feature (1)..(1362): Also known as  Ceres CDNA ID no. 23360388
atgagagaaggatctcatgttattgttttgcctttcccagcacaaggccacataactccaatgtcccaattctgtaaacgcttagcctcaaaaagtcttaagatcactcttgtcctcgtctccgacaagccctctccgccgtacaaaacagagcacgacacaatcactgtcgtccccatctccaatggtttccaagaaggccaggaacgatcagaagacctagatgagtacatggaaagagtagaatccagcatcaaaaaccgcttaccgaagttgatagaagacatgaaactatcgggaaatcctcctagggctcttgtgtacgactccaccatgccgtggcttctggatgtagctcatagttatggtttgagcggtgccgtgtttttcacgcagccttggcttgtctcagctatttactatcatgtattcaagggctcgttctctgtaccgtctacaaagtatggtcactcgacgttagcatctttcccttcgttaccgattctgaatgcgaatgatttgccgtctttcctctgtgaatcttcctcttacccatatattctaaggactgtgatcgatcagctctcaaacattgatcgagttgatatagttttgtgcaacactttcgataaattggaagaaaagttgctgaaatggattaaaagcgtgtggcctgtcctgaacataggaccaactgttccatcaatgtatttagataagcgactggctgaagacaaaaactacggattcagcctcttcggtgcgaaaatcgctgaatgcatggagtggctcaactcaaagcagcctagttcagttgtttatgtatcatttgggagcttggtggttctaaaaaaagatcaactgatagaactagcggcgggtctgaaacagagcggacatttctttttgtgggttgtgagagagacggagagaagaaaacttccagaaaactatatagaggaaattggtgagaaaggactgaccgtgagctggagtccacaacttgaagttcttacacataaatcgatcggttgtttcgtgacacattgtggatggaactcgacgttagagggattgagtttgggagttccaatgattggtatgcctcattgggcagatcagcctacaaatgctaagttcatggaggatgtgtggaaagttggagttagggttaaagcagacagtgatgggttcgtgagaagagaagagtttgtgagacgtgtggaagaagttatggaggcagagcaaggtaaagagattagaaagaatgctgagaaatggaaagtgttggctcaagaggctgtttctgaaggaggtagttctgataagaacatcaatgagtttgtttctatgttttgttga

SEQ ID NO: 1772 - protein, 1362 aa, Arabidopsis thaliana
  misc_feature: PFam Name: TMPIT; PFam Description: TMPIT-like protein
  misc_feature: GI Number: 50758114; NR Description: PREDICTED: similar to transmembrane protein induced by tumor necrosis factor alpha
  misc_feature: GI Number: 34871732; NR Description: similar to transmembrane
  misc_feature: GI Number: 57870649; NR Description: Transmembrane protein induced by tumor necrosis factor alpha [Rattus norvegicus] gi|58219512|ref|NP_001010945.1| transmembrane protein induced by
  misc_feature: GI Number: 29789387; NR Description: transmembrane protein induced by tumor necrosis factor alpha [Mus musculus] >gi|28436931|gb|AAH46757.1| Transmembrane protein induced by tumor
  misc_feature: GI Number: 58701915; NR Description: Unknown (protein for
ATGAGAGAAGGATCTCATGTTATTGTTTTGCCTTTCCCAGCACAAGGCCACATAACTCCAATGTCCCAATTCTGTAAACGCTTAGCCTCAAAAAGTCTTAAGATCACTCTTGTCCTCGTCTCCGACAAGCCCTCTCCGCCGTACAAAACAGAGCACGACACAATCACTGTCGTCCCCATCTCCAATGGTTTCCAAGAAGGCCAGGAACGATCAGAAGACCTAGATGAGTACATGGAAAGAGTAGAATCCAGCATCAAAAACCGCTTACCGAAGTTGATAGAAGACATGAAACTATCGGGAAATCCTCCTAGGGCTCTTGTGTACGACTCCACCATGCCGTGGCTTCTGGATGTAGCTCATAGTTATGGTTTGAGCGGTGCCGTGTTTTTCACGCAGCCTTGGCTTGTCTCAGCTATTTACTATCATGTATTCAAGGGCTCGTTCTCTGTACCGTCTACAAAGTATGGTCACTCGACGTTAGCATCTTTCCCTTCGTTACCGATTCTGAATGCGAATGATTTGCCGTCTTTCCTCTGTGAATCTTCCTCTTACCCATATATTCTAAGGACTGTGATCGATCAGCTCTCAAACATTGATCGAGTTGATATAGTTTTGTGCAACACTTTCGATAAATTGGAAGAAAAGTTGCTGAAATGGATTAAAAGCGTGTGGCCTGTCCTGAACATAGGACCAACTGTTCCATCAATGTATTTAGATAAGCGACTGGCTGAAGACAAAAACTACGGATTCAGCCTCTTCGGTGCGAAAATCGCTGAATGCATGGAGTGGCTCAACTCAAAGCAGCCTAGTTCAGTTGTTTATGTATCATTTGGGAGCTTGGTGGTTCTAAAAAAAGATCAACTGATAGAACTAGCGGCGGGTCTGAAACAGAGCGGACATTTCTTTTTGTGGGTTGTGAGAGAGACGGAGAGAAGAAAACTTCCAGAAAACTATATAGAGGAAATTGGTGAGAAAGGACTGACCGTGAGCTGGAGTCCACAACTTGAAGTTCTTACACATAAATCGATCGGTTGTTTCGTGACACATTGTGGATGGAACTCGACGTTAGAGGGATTGAGTTTGGGAGTTCCAATGATTGGTATGCCTCATTGGGCAGATCAGCCTACAAATGCTAAGTTCATGGAGGATGTGTGGAAAGTTGGAGTTAGGGTTAAAGCAGACAGTGATGGGTTCGTGAGAAGAGAAGAGTTTGTGAGACGTGTGGAAGAAGTTATGGAGGCAGAGCAAGGTAAAGAGATTAGAAAGAATGCTGAGAAATGGAAAGTGTTGGCTCAAGAGGCTGTTTCTGAAGGAGGTAGTTCTGATAAGAACATCAATGAGTTTGTTTCTATGTTTTGTTGA

SEQ ID NO: 1773 - DNA, 1785 bp, Arabidopsis thaliana
  misc_feature (1)..(1785): Ceres cDNA ID no. 12682045
  misc_feature (1)..(1785): Also known as  Ceres CDNA ID no. 23360388
atggagcaaggaggaggtggtggtggtaatgaagttgtggaggaagcttcacctattagttcaagacctcctgctaacaacttagaagagcttatgagattctcagccgccgcggatgacggtggattaggaggtggaggtggaggaggaggaggaggaagtgcttcttcttcatcgggaaatcgatggccgagagaagaaactttagctcttcttcggatccgatccgatatggattctacttttcgtgatgctactctcaaagctcctctttgggaacatgtttccaggaagctattggagttaggttacaaacgaagttcaaagaaatgcaaagagaaattcgaaaacgttcagaaatattacaaacgtactaaagaaactcgcggtggtcgtcatgatggtaaagcttacaagttcttctctcagcttgaagctctcaacactactcctccttcatcttccctcgacgttactcctctctccgtcgctaatcccattctcatgccttcttcttcttcttctccatttcccgtattctctcaaccgcaaccgcaaacgcaaacgcaaccgcctcaaacgcataatgtctcttttactcctactccaccacctcttccacttccttcaatgggtccgatatttaccggtgttactttctcgtctcatagctcatcgacggcttcaggaatggggtctgatgatgatgacgacgatatggacgttgatcaggctaacattgcgggttctagtagccgaaaacgcaaacgtggaaaccgcggtggaggcggtaaaatgatggaattgtttgaaggtttggtgagacaagtaatgcaaaagcaagcggctatgcaaaggagtttcttggaagctcttgagaagagagagcaagaacgtcttgatcgtgaagaagcttggaaacgtcaagaaatggctcggttagctcgagaacacgaggtcatgtctcaagaacgagccgcctctgcttctcgtgacgccgcaatcatttcattgattcagaaaattactggccataccattcagttacctccttctttgtcatctcaaccgcctccaccgtatcaaccgccacccgcggtcactaaacgtgtggcggaaccaccattatcaacagctcaatctcaatcacaacaaccaataatggcgattccacaacaacaaattcttcctcctcctcctccttctcatcctcacgctcatcaaccagaacagaaacaacaacaacaaccacaacaagagatggtcatgagctcggaacaatcatcattaccatcatcatcaagatggccaaaggcagagattctagcgcttataaacctgagaagtggaatggaaccaaggtaccaagataatgtacctaaaggacttctatgggaagagatctcaacttcaatgaagagaatgggatacaacagaaacgctaagagatgtaaagagaaatgggaaaacataaacaaatactacaagaaagttaaagaaagcaacaagaaacgtcctcaagatgctaagacttgtccttactttcaccgcctcgatcttctttaccgcaacaaagtactcggtagtggcggtggttctagcacttctggtctacctcaagaccaaaaacagagtccggtcactgcgatgaaaccgccacaagaaggacttgttaatgttcaacaaactcatgggtcagcttcaactgaggaagaagagcctatagaggaaagtccacaaggaacagaaaaggtacaaactttgcttttccttgtcaaaatgtga

SEQ ID NO: 1774 - protein, 1785 aa, Arabidopsis thaliana
  misc_feature: PFam Name: TMPIT; PFam Description: TMPIT-like protein
  misc_feature: GI Number: 50758114; NR Description: PREDICTED: similar to transmembrane protein induced by tumor necrosis factor alpha
  misc_feature: GI Number: 34871732; NR Description: similar to transmembrane
  misc_feature: GI Number: 57870649; NR Description: Transmembrane protein induced by tumor necrosis factor alpha [Rattus norvegicus] gi|58219512|ref|NP_001010945.1| transmembrane protein induced by
  misc_feature: GI Number: 29789387; NR Description: transmembrane protein induced by tumor necrosis factor alpha [Mus musculus] >gi|28436931|gb|AAH46757.1| Transmembrane protein induced by tumor
  misc_feature: GI Number: 58701915; NR Description: Unknown (protein for
ATGGAGCAAGGAGGAGGTGGTGGTGGTAATGAAGTTGTGGAGGAAGCTTCACCTATTAGTTCAAGACCTCCTGCTAACAACTTAGAAGAGCTTATGAGATTCTCAGCCGCCGCGGATGACGGTGGATTAGGAGGTGGAGGTGGAGGAGGAGGAGGAGGAAGTGCTTCTTCTTCATCGGGAAATCGATGGCCGAGAGAAGAAACTTTAGCTCTTCTTCGGATCCGATCCGATATGGATTCTACTTTTCGTGATGCTACTCTCAAAGCTCCTCTTTGGGAACATGTTTCCAGGAAGCTATTGGAGTTAGGTTACAAACGAAGTTCAAAGAAATGCAAAGAGAAATTCGAAAACGTTCAGAAATATTACAAACGTACTAAAGAAACTCGCGGTGGTCGTCATGATGGTAAAGCTTACAAGTTCTTCTCTCAGCTTGAAGCTCTCAACACTACTCCTCCTTCATCTTCCCTCGACGTTACTCCTCTCTCCGTCGCTAATCCCATTCTCATGCCTTCTTCTTCTTCTTCTCCATTTCCCGTATTCTCTCAACCGCAACCGCAAACGCAAACGCAACCGCCTCAAACGCATAATGTCTCTTTTACTCCTACTCCACCACCTCTTCCACTTCCTTCAATGGGTCCGATATTTACCGGTGTTACTTTCTCGTCTCATAGCTCATCGACGGCTTCAGGAATGGGGTCTGATGATGATGACGACGATATGGACGTTGATCAGGCTAACATTGCGGGTTCTAGTAGCCGAAAACGCAAACGTGGAAACCGCGGTGGAGGCGGTAAAATGATGGAATTGTTTGAAGGTTTGGTGAGACAAGTAATGCAAAAGCAAGCGGCTATGCAAAGGAGTTTCTTGGAAGCTCTTGAGAAGAGAGAGCAAGAACGTCTTGATCGTGAAGAAGCTTGGAAACGTCAAGAAATGGCTCGGTTAGCTCGAGAACACGAGGTCATGTCTCAAGAACGAGCCGCCTCTGCTTCTCGTGACGCCGCAATCATTTCATTGATTCAGAAAATTACTGGCCATACCATTCAGTTACCTCCTTCTTTGTCATCTCAACCGCCTCCACCGTATCAACCGCCACCCGCGGTCACTAAACGTGTGGCGGAACCACCATTATCAACAGCTCAATCTCAATCACAACAACCAATAATGGCGATTCCACAACAACAAATTCTTCCTCCTCCTCCTCCTTCTCATCCTCACGCTCATCAACCAGAACAGAAACAACAACAACAACCACAACAAGAGATGGTCATGAGCTCGGAACAATCATCATTACCATCATCATCAAGATGGCCAAAGGCAGAGATTCTAGCGCTTATAAACCTGAGAAGTGGAATGGAACCAAGGTACCAAGATAATGTACCTAAAGGACTTCTATGGGAAGAGATCTCAACTTCAATGAAGAGAATGGGATACAACAGAAACGCTAAGAGATGTAAAGAGAAATGGGAAAACATAAACAAATACTACAAGAAAGTTAAAGAAAGCAACAAGAAACGTCCTCAAGATGCTAAGACTTGTCCTTACTTTCACCGCCTCGATCTTCTTTACCGCAACAAAGTACTCGGTAGTGGCGGTGGTTCTAGCACTTCTGGTCTACCTCAAGACCAAAAACAGAGTCCGGTCACTGCGATGAAACCGCCACAAGAAGGACTTGTTAATGTTCAACAAACTCATGGGTCAGCTTCAACTGAGGAAGAAGAGCCTATAGAGGAAAGTCCACAAGGAACAGAAAAGGTACAAACTTTGCTTTTCCTTGTCAAAATGTGA

SEQ ID NO: 1775 - DNA, 1056 bp, Arabidopsis thaliana
  misc_feature (1)..(1056): Ceres cDNA ID no. 12682731
  misc_feature (1)..(1056): Also known as  Ceres CDNA ID no. 23360388
atgtctggttatcctccatcaagccaaggttacggttacggcggtaatccaccacctcctcagccaccgtacggatcaaccggcaataaccctcctccgtacggatcatccggcagcaatcctcctcctccgtacggatcatcagcctcctcaccgtacgcagttccctacggagctcagcccgctccttacggtgcaccaccgtcagcaccgtacgcgtctcttccaggagaccataataagccgcacaaagagaaacctcacggcgcctcctacggatctccatctcccggtggctacggtgctcatccatcgtctggaccttccgactacggtggttacggaggagcgccgcagcagtctggacatggaggaggttacggaggagcgccgcagcagtctggacatggaggaggttacggagctcctcctccgcaagcttcttatggaagtccgtttgcgtctctggttccgtcggcgtttcctcccggaacagatccgaacattgtggcttgtttccaagctgcggatcgggacaatagtggattcatcgatgataaggagcttcaaggagctctatcttcgtataatcagagcttcagcataagaactgttcatctccttatgtatctattcaccaacagcaatgtcaggaagattggaccaaaagagtttacttcacttttctttagtcttcagaattggaggtctatctttgagaggtttgataaggacagaagcggtagaatagatacaaacgagctgagagatgcactcatgagccttgggttttctgtttctcctgtgattttggatctgctggtttcaaagtttgacaaaagcggaggcaggaacagggctatcgaatatgacaatttcatcgagtatgttcattcgtttcaacccccttaccttttcttactctgtaacaagtgttgtttgactgtaaaggggctcaccgagaagttcaaggagaaggatacggcgttatcaggctcagctattttcaattacgagaacttcatgctcactgttttaccattcctcgtcgcttga

SEQ ID NO: 1776 - protein, 1056 aa, Arabidopsis thaliana
  misc_feature: PFam Name: TMPIT; PFam Description: TMPIT-like protein
  misc_feature: GI Number: 50758114; NR Description: PREDICTED: similar to transmembrane protein induced by tumor necrosis factor alpha
  misc_feature: GI Number: 34871732; NR Description: similar to transmembrane
  misc_feature: GI Number: 57870649; NR Description: Transmembrane protein induced by tumor necrosis factor alpha [Rattus norvegicus] gi|58219512|ref|NP_001010945.1| transmembrane protein induced by
  misc_feature: GI Number: 29789387; NR Description: transmembrane protein induced by tumor necrosis factor alpha [Mus musculus] >gi|28436931|gb|AAH46757.1| Transmembrane protein induced by tumor
  misc_feature: GI Number: 58701915; NR Description: Unknown (protein for
ATGTCTGGTTATCCTCCATCAAGCCAAGGTTACGGTTACGGCGGTAATCCACCACCTCCTCAGCCACCGTACGGATCAACCGGCAATAACCCTCCTCCGTACGGATCATCCGGCAGCAATCCTCCTCCTCCGTACGGATCATCAGCCTCCTCACCGTACGCAGTTCCCTACGGAGCTCAGCCCGCTCCTTACGGTGCACCACCGTCAGCACCGTACGCGTCTCTTCCAGGAGACCATAATAAGCCGCACAAAGAGAAACCTCACGGCGCCTCCTACGGATCTCCATCTCCCGGTGGCTACGGTGCTCATCCATCGTCTGGACCTTCCGACTACGGTGGTTACGGAGGAGCGCCGCAGCAGTCTGGACATGGAGGAGGTTACGGAGGAGCGCCGCAGCAGTCTGGACATGGAGGAGGTTACGGAGCTCCTCCTCCGCAAGCTTCTTATGGAAGTCCGTTTGCGTCTCTGGTTCCGTCGGCGTTTCCTCCCGGAACAGATCCGAACATTGTGGCTTGTTTCCAAGCTGCGGATCGGGACAATAGTGGATTCATCGATGATAAGGAGCTTCAAGGAGCTCTATCTTCGTATAATCAGAGCTTCAGCATAAGAACTGTTCATCTCCTTATGTATCTATTCACCAACAGCAATGTCAGGAAGATTGGACCAAAAGAGTTTACTTCACTTTTCTTTAGTCTTCAGAATTGGAGGTCTATCTTTGAGAGGTTTGATAAGGACAGAAGCGGTAGAATAGATACAAACGAGCTGAGAGATGCACTCATGAGCCTTGGGTTTTCTGTTTCTCCTGTGATTTTGGATCTGCTGGTTTCAAAGTTTGACAAAAGCGGAGGCAGGAACAGGGCTATCGAATATGACAATTTCATCGAGTATGTTCATTCGTTTCAACCCCCTTACCTTTTCTTACTCTGTAACAAGTGTTGTTTGACTGTAAAGGGGCTCACCGAGAAGTTCAAGGAGAAGGATACGGCGTTATCAGGCTCAGCTATTTTCAATTACGAGAACTTCATGCTCACTGTTTTACCATTCCTCGTCGCTTGA

SEQ ID NO: 1777 - DNA, 1317 bp, Arabidopsis thaliana
  misc_feature (1)..(1317): Ceres cDNA ID no. 12682737
  misc_feature (1)..(1317): Also known as  Ceres CDNA ID no. 23360388
atggcgactctgtcttcctatctgttatcttctcctcctctatgcaaatcccgattctcggcaacaagtctcgtctcaggaattgatttcatctctttctctcctcgaacaactctctcctcgtcatccactgtcttgccggcgattctttctctttccgttaaacataatcgccggagaaactcgcttcaaggttcgaattctaaagttttcctttttcttaatctgaaacaggattggattagcttagcttctcttgattttgattttgatttctgggtttcagtgaaatcagtagctagcccaacggagacgatttcagaattcgatgagatggtctccggcacgaaacgaaagtattacatgctcggtgggaaaggaggagtgggcaaaactagttgtgctgcttctttagctgtgagattcgccaacaatggacacccaactctggttgtatctacagatccagcacattccttgagcgattcttttgctcaggacttgactggaggaatgcttgtccctgtagaaggacccgaagctcctttatttgctttagaaataaaccctgagaaggctagggaagagtttcgtagtgcctcgcagatgaatggaggaactggggtgaaagattttatggatggtatgggacttggaatgcttgtagaacagttgggggagcttaaacttggagaattgctcgacacaccgcctcctggattggatgaagccatagtcattcaattcttggaatcaccagagtataacatgttcaccagaatcgtatttgatactgcaccaacgggtcatacgctaaggctactctctttacctgatttcttggatgcatccattggtaaaatcttgaagcttagacagaaaataacctcggctacttcagcgatcaaatcagtttttgggaaagaagaaaaggggcctgatgctgccgacaaattggaaaaactaagagaaaggatggttaaagttcgcgagcttttccgtgacacagagtcaacagaattcgtcattgtcactatcccaacggtaatggctgtcagcgagtcttctaggttaagtgcttccttgaagaaggaaagtgttcccgtcaaaagactcattgttaatcagcttctcccgccatcctcctcagattgcaaattttgctctattaagagaaaggaccaaatgcgggctcttgatatgatccgggaggattcagaactctctgctttgacactgatggaggctccgctggttgatatggagatcagaggtgtccctgctctgcgcttcttgggcgatatcatttggaaataa

SEQ ID NO: 1778 - protein, 1317 aa, Arabidopsis thaliana
  misc_feature: PFam Name: TMPIT; PFam Description: TMPIT-like protein
  misc_feature: GI Number: 50758114; NR Description: PREDICTED: similar to transmembrane protein induced by tumor necrosis factor alpha
  misc_feature: GI Number: 34871732; NR Description: similar to transmembrane
  misc_feature: GI Number: 57870649; NR Description: Transmembrane protein induced by tumor necrosis factor alpha [Rattus norvegicus] gi|58219512|ref|NP_001010945.1| transmembrane protein induced by
  misc_feature: GI Number: 29789387; NR Description: transmembrane protein induced by tumor necrosis factor alpha [Mus musculus] >gi|28436931|gb|AAH46757.1| Transmembrane protein induced by tumor
  misc_feature: GI Number: 58701915; NR Description: Unknown (protein for
ATGGCGACTCTGTCTTCCTATCTGTTATCTTCTCCTCCTCTATGCAAATCCCGATTCTCGGCAACAAGTCTCGTCTCAGGAATTGATTTCATCTCTTTCTCTCCTCGAACAACTCTCTCCTCGTCATCCACTGTCTTGCCGGCGATTCTTTCTCTTTCCGTTAAACATAATCGCCGGAGAAACTCGCTTCAAGGTTCGAATTCTAAAGTTTTCCTTTTTCTTAATCTGAAACAGGATTGGATTAGCTTAGCTTCTCTTGATTTTGATTTTGATTTCTGGGTTTCAGTGAAATCAGTAGCTAGCCCAACGGAGACGATTTCAGAATTCGATGAGATGGTCTCCGGCACGAAACGAAAGTATTACATGCTCGGTGGGAAAGGAGGAGTGGGCAAAACTAGTTGTGCTGCTTCTTTAGCTGTGAGATTCGCCAACAATGGACACCCAACTCTGGTTGTATCTACAGATCCAGCACATTCCTTGAGCGATTCTTTTGCTCAGGACTTGACTGGAGGAATGCTTGTCCCTGTAGAAGGACCCGAAGCTCCTTTATTTGCTTTAGAAATAAACCCTGAGAAGGCTAGGGAAGAGTTTCGTAGTGCCTCGCAGATGAATGGAGGAACTGGGGTGAAAGATTTTATGGATGGTATGGGACTTGGAATGCTTGTAGAACAGTTGGGGGAGCTTAAACTTGGAGAATTGCTCGACACACCGCCTCCTGGATTGGATGAAGCCATAGTCATTCAATTCTTGGAATCACCAGAGTATAACATGTTCACCAGAATCGTATTTGATACTGCACCAACGGGTCATACGCTAAGGCTACTCTCTTTACCTGATTTCTTGGATGCATCCATTGGTAAAATCTTGAAGCTTAGACAGAAAATAACCTCGGCTACTTCAGCGATCAAATCAGTTTTTGGGAAAGAAGAAAAGGGGCCTGATGCTGCCGACAAATTGGAAAAACTAAGAGAAAGGATGGTTAAAGTTCGCGAGCTTTTCCGTGACACAGAGTCAACAGAATTCGTCATTGTCACTATCCCAACGGTAATGGCTGTCAGCGAGTCTTCTAGGTTAAGTGCTTCCTTGAAGAAGGAAAGTGTTCCCGTCAAAAGACTCATTGTTAATCAGCTTCTCCCGCCATCCTCCTCAGATTGCAAATTTTGCTCTATTAAGAGAAAGGACCAAATGCGGGCTCTTGATATGATCCGGGAGGATTCAGAACTCTCTGCTTTGACACTGATGGAGGCTCCGCTGGTTGATATGGAGATCAGAGGTGTCCCTGCTCTGCGCTTCTTGGGCGATATCATTTGGAAATAA

SEQ ID NO: 1779 - DNA, 2001 bp, Arabidopsis thaliana
  misc_feature (1)..(2001): Ceres cDNA ID no. 12683284
  misc_feature (1)..(2001): Also known as  Ceres CDNA ID no. 23360388
atgggttcgaagcaattcctcgaattttgtcttcttccttcttttgcctcatacccttcttctccttcttattcttcaagtagacaagtatcttccgtttctagaagatttcgaccagttttggcctcgagacctgtgtccaaaaacagtccttattaccaaaggaccaatggtttatcatcttacaattcaatccccagagtcccaactcctgttgatactgaagtagaagcagataagagggttgttctatctagattagtgactttgaggcgtaaattggcggaacagggagttgatgctgaaaactgccccccaggacaacatagtggcttgatatgtccgacgtgtgaaggtggaaactctggagaaaaaagcttgtctctttttatagcccctgatggttcatcagctacatggaattgctttagggggaagtgtgggttaaaaggtggagttcgggcggatggtgggttggcatctgctgatcctatagagaaggttgaaagaaaaattacggtggagggtatagagctagaacctctctgtgatgagattcaagattatttcgctgcaagagcgatttcacggaaaacactcgagagaaatcgggttatgcagaaaagaataggtgacgagattgtaattgcgtttacttattggcaaagaggggagcttgtgagttgcaagtaccggtctctaactaagatgttctttcaggttcacatcatacaaattcccttctcaatagcagatgaaaggaagacacggaggatcttatatggtcttgatgacatagaaaaaacatctgaagtcattatagttgaaggggagatagataaacttgcaatggaagaagctggttttctcaattgtgtatccgttcctgatggagctccagcgaaggtttcttcgaaggaaatcccatcggaagacaaggcgtctcgaattgttattgctactgacggagatggacctggtcaagctatggcggaagaaattgcacggcgtttgggtaaagaaagatgttggcgtgtcaagtggccgaagaaaagtgaggatgaacattttaaagatgcaaacgaggttcttatgtctaagggacctcatttactcaaggaagctattttagatgctgagccatatcctatactaggattattctccttcaaagatttctttgatgaaattgatgcctactatgatagaacacatgggcacgagtatggtgtttcaacagggtggaaaaatttggacaacttgtatagtgttgtgccaggggagttgacagttgtgacagggatccctaattctggaaagagtgaatggattgatgctatgttgtgcaatcttaaccatagtgttggctggaaatttgcactctgttcaatggagaataagtccaatagctgctatgggagatctgtccaacggatgagcgttgaggagaaggatgaagggaaaaagtggttgaatgacaccttctatcccataagatgtgagatggattcacttccaagtattgattgggttctggaacgtgcaaaagcagctgttcttcggtatgggattcgaggacttgttatagatccttacaatgagctcgatcatcaacgtactccacgccagacggagacagagtatgtcagccagatgcttacaaaaatcaaacgcttttcccaacaccactcctgccatgtctggtttgtcgctcatccaaaacagttgcaacattgggatggcggtgcaccaaacctttacgatattagtggcagcgcacattttataaacaaatgtgacaatggtattatagttcacagaaaccgcgacgaaaatgctggacctcttgatctagttcaaattggtgtgaggaaagtacgaaacaaggtggcaggacaaattggtgatgcatacttgtgttatgacaggacaactggttcctactcggattctccagtgacgcctggaatgccagagaggagatcacccaagcggtactga

SEQ ID NO: 1780 - protein, 2001 aa, Arabidopsis thaliana
  misc_feature: PFam Name: TMPIT; PFam Description: TMPIT-like protein
  misc_feature: GI Number: 50758114; NR Description: PREDICTED: similar to transmembrane protein induced by tumor necrosis factor alpha
  misc_feature: GI Number: 34871732; NR Description: similar to transmembrane
  misc_feature: GI Number: 57870649; NR Description: Transmembrane protein induced by tumor necrosis factor alpha [Rattus norvegicus] gi|58219512|ref|NP_001010945.1| transmembrane protein induced by
  misc_feature: GI Number: 29789387; NR Description: transmembrane protein induced by tumor necrosis factor alpha [Mus musculus] >gi|28436931|gb|AAH46757.1| Transmembrane protein induced by tumor
  misc_feature: GI Number: 58701915; NR Description: Unknown (protein for
ATGGGTTCGAAGCAATTCCTCGAATTTTGTCTTCTTCCTTCTTTTGCCTCATACCCTTCTTCTCCTTCTTATTCTTCAAGTAGACAAGTATCTTCCGTTTCTAGAAGATTTCGACCAGTTTTGGCCTCGAGACCTGTGTCCAAAAACAGTCCTTATTACCAAAGGACCAATGGTTTATCATCTTACAATTCAATCCCCAGAGTCCCAACTCCTGTTGATACTGAAGTAGAAGCAGATAAGAGGGTTGTTCTATCTAGATTAGTGACTTTGAGGCGTAAATTGGCGGAACAGGGAGTTGATGCTGAAAACTGCCCCCCAGGACAACATAGTGGCTTGATATGTCCGACGTGTGAAGGTGGAAACTCTGGAGAAAAAAGCTTGTCTCTTTTTATAGCCCCTGATGGTTCATCAGCTACATGGAATTGCTTTAGGGGGAAGTGTGGGTTAAAAGGTGGAGTTCGGGCGGATGGTGGGTTGGCATCTGCTGATCCTATAGAGAAGGTTGAAAGAAAAATTACGGTGGAGGGTATAGAGCTAGAACCTCTCTGTGATGAGATTCAAGATTATTTCGCTGCAAGAGCGATTTCACGGAAAACACTCGAGAGAAATCGGGTTATGCAGAAAAGAATAGGTGACGAGATTGTAATTGCGTTTACTTATTGGCAAAGAGGGGAGCTTGTGAGTTGCAAGTACCGGTCTCTAACTAAGATGTTCTTTCAGGTTCACATCATACAAATTCCCTTCTCAATAGCAGATGAAAGGAAGACACGGAGGATCTTATATGGTCTTGATGACATAGAAAAAACATCTGAAGTCATTATAGTTGAAGGGGAGATAGATAAACTTGCAATGGAAGAAGCTGGTTTTCTCAATTGTGTATCCGTTCCTGATGGAGCTCCAGCGAAGGTTTCTTCGAAGGAAATCCCATCGGAAGACAAGGCGTCTCGAATTGTTATTGCTACTGACGGAGATGGACCTGGTCAAGCTATGGCGGAAGAAATTGCACGGCGTTTGGGTAAAGAAAGATGTTGGCGTGTCAAGTGGCCGAAGAAAAGTGAGGATGAACATTTTAAAGATGCAAACGAGGTTCTTATGTCTAAGGGACCTCATTTACTCAAGGAAGCTATTTTAGATGCTGAGCCATATCCTATACTAGGATTATTCTCCTTCAAAGATTTCTTTGATGAAATTGATGCCTACTATGATAGAACACATGGGCACGAGTATGGTGTTTCAACAGGGTGGAAAAATTTGGACAACTTGTATAGTGTTGTGCCAGGGGAGTTGACAGTTGTGACAGGGATCCCTAATTCTGGAAAGAGTGAATGGATTGATGCTATGTTGTGCAATCTTAACCATAGTGTTGGCTGGAAATTTGCACTCTGTTCAATGGAGAATAAGTCCAATAGCTGCTATGGGAGATCTGTCCAACGGATGAGCGTTGAGGAGAAGGATGAAGGGAAAAAGTGGTTGAATGACACCTTCTATCCCATAAGATGTGAGATGGATTCACTTCCAAGTATTGATTGGGTTCTGGAACGTGCAAAAGCAGCTGTTCTTCGGTATGGGATTCGAGGACTTGTTATAGATCCTTACAATGAGCTCGATCATCAACGTACTCCACGCCAGACGGAGACAGAGTATGTCAGCCAGATGCTTACAAAAATCAAACGCTTTTCCCAACACCACTCCTGCCATGTCTGGTTTGTCGCTCATCCAAAACAGTTGCAACATTGGGATGGCGGTGCACCAAACCTTTACGATATTAGTGGCAGCGCACATTTTATAAACAAATGTGACAATGGTATTATAGTTCACAGAAACCGCGACGAAAATGCTGGACCTCTTGATCTAGTTCAAATTGGTGTGAGGAAAGTACGAAACAAGGTGGCAGGACAAATTGGTGATGCATACTTGTGTTATGACAGGACAACTGGTTCCTACTCGGATTCTCCAGTGACGCCTGGAATGCCAGAGAGGAGATCACCCAAGCGGTACTGA

SEQ ID NO: 1781 - DNA, 1383 bp, Arabidopsis thaliana
  misc_feature (1)..(1383): Ceres cDNA ID no. 12683542
  misc_feature (1)..(1383): Also known as  Ceres CDNA ID no. 23360388
atgacagttgttggagatgttgctccaattccaaggaggaacagttctacttgctctaatgatatcgctgctccgttattaccagagtgtcatggagatgaagttgctcatgatgaattcaatggagcttcttttagtggcgcggtttttaacctcgccacgactataattggtgctggtatcatggctttgcctgctacaatgaagattcttggacttggacttggaatcacgatgattgttgttatggctttcttgactgatgcgtcgattgagttcttgcttaggtttagtaaagctgggaagaatcgatcttacggtggtttaatgggtggttcttttggtaatcctggaaggattttgcttcaagtcgcggttttagttaataacatcggtgttttgattgtatacatgatcattataggtgatgtgttggctggaaagacggaagatggtatccatcatttcggtgttctcgaaggatggtttggtcaccattggtggaatggaagagctgctattcttctgattactactcttggtgtgtttgctccattggcttgcttcaagcgaatcgattctttgaaatttacatcggccttatccgtggctctggcggttgtgtttctcattattactgcgggaatttcaattatgaagttgatcagtggcggtgtggcgatgccaagattgttaccagatgttactgacttaacatctttctggaatctcttcacagtcgtacctgttcttgtcacagcattcatttgccattacaatgttcacagtatacagaacgagctcgaagacccctctcagataagacctgttgttcgatcagcacttatgctctgctcatctgtttacataatgacaagtattttcgggttcctcttgtttggtgatgatactcttgatgatgtccttgcaaactttgacactgatcttggaatcccttttggttctatccttaatgatgcggttcgagttagctacgcgcttcatttgatgctcgtgttcccgattgttttctaccctcttcggattaacattgacgggctcttgttcccttccgctcgatcattatctacctcaaatgtgaggttcggttgcctcactgccggtctcatctctgtaatcttcttgggtgcaaacttcatcccaagcatttgggatgctttccaattcactggagcaaccgccgctgtttgtctcggcttcatcttcccagcttctatcatactaaaggatcgtcatgacaaagcaacaaacagggacacaaccttagctattttcatgattgttcttgcggtattgtccaatgcaatcgccatttacagcgatgcttatgcgctattcaagaagaacgctcctcgtgagtaa

SEQ ID NO: 1782 - protein, 1383 aa, Arabidopsis thaliana
  misc_feature: PFam Name: TMPIT; PFam Description: TMPIT-like protein
  misc_feature: GI Number: 50758114; NR Description: PREDICTED: similar to transmembrane protein induced by tumor necrosis factor alpha
  misc_feature: GI Number: 34871732; NR Description: similar to transmembrane
  misc_feature: GI Number: 57870649; NR Description: Transmembrane protein induced by tumor necrosis factor alpha [Rattus norvegicus] gi|58219512|ref|NP_001010945.1| transmembrane protein induced by
  misc_feature: GI Number: 29789387; NR Description: transmembrane protein induced by tumor necrosis factor alpha [Mus musculus] >gi|28436931|gb|AAH46757.1| Transmembrane protein induced by tumor
  misc_feature: GI Number: 58701915; NR Description: Unknown (protein for
ATGACAGTTGTTGGAGATGTTGCTCCAATTCCAAGGAGGAACAGTTCTACTTGCTCTAATGATATCGCTGCTCCGTTATTACCAGAGTGTCATGGAGATGAAGTTGCTCATGATGAATTCAATGGAGCTTCTTTTAGTGGCGCGGTTTTTAACCTCGCCACGACTATAATTGGTGCTGGTATCATGGCTTTGCCTGCTACAATGAAGATTCTTGGACTTGGACTTGGAATCACGATGATTGTTGTTATGGCTTTCTTGACTGATGCGTCGATTGAGTTCTTGCTTAGGTTTAGTAAAGCTGGGAAGAATCGATCTTACGGTGGTTTAATGGGTGGTTCTTTTGGTAATCCTGGAAGGATTTTGCTTCAAGTCGCGGTTTTAGTTAATAACATCGGTGTTTTGATTGTATACATGATCATTATAGGTGATGTGTTGGCTGGAAAGACGGAAGATGGTATCCATCATTTCGGTGTTCTCGAAGGATGGTTTGGTCACCATTGGTGGAATGGAAGAGCTGCTATTCTTCTGATTACTACTCTTGGTGTGTTTGCTCCATTGGCTTGCTTCAAGCGAATCGATTCTTTGAAATTTACATCGGCCTTATCCGTGGCTCTGGCGGTTGTGTTTCTCATTATTACTGCGGGAATTTCAATTATGAAGTTGATCAGTGGCGGTGTGGCGATGCCAAGATTGTTACCAGATGTTACTGACTTAACATCTTTCTGGAATCTCTTCACAGTCGTACCTGTTCTTGTCACAGCATTCATTTGCCATTACAATGTTCACAGTATACAGAACGAGCTCGAAGACCCCTCTCAGATAAGACCTGTTGTTCGATCAGCACTTATGCTCTGCTCATCTGTTTACATAATGACAAGTATTTTCGGGTTCCTCTTGTTTGGTGATGATACTCTTGATGATGTCCTTGCAAACTTTGACACTGATCTTGGAATCCCTTTTGGTTCTATCCTTAATGATGCGGTTCGAGTTAGCTACGCGCTTCATTTGATGCTCGTGTTCCCGATTGTTTTCTACCCTCTTCGGATTAACATTGACGGGCTCTTGTTCCCTTCCGCTCGATCATTATCTACCTCAAATGTGAGGTTCGGTTGCCTCACTGCCGGTCTCATCTCTGTAATCTTCTTGGGTGCAAACTTCATCCCAAGCATTTGGGATGCTTTCCAATTCACTGGAGCAACCGCCGCTGTTTGTCTCGGCTTCATCTTCCCAGCTTCTATCATACTAAAGGATCGTCATGACAAAGCAACAAACAGGGACACAACCTTAGCTATTTTCATGATTGTTCTTGCGGTATTGTCCAATGCAATCGCCATTTACAGCGATGCTTATGCGCTATTCAAGAAGAACGCTCCTCGTGAGTAA

SEQ ID NO: 1783 - DNA, 1291 bp, Arabidopsis thaliana
  misc_feature (1)..(1291): Ceres cDNA ID no. 12683979
  misc_feature (1)..(1291): Ceres CLONE  ID no. 1358009
  misc_feature (1)..(1291): Also known as  Ceres CDNA ID no. 12683979
gaaaaaaaacaaatcagattctcaaatactgaaaataaaaagaagaagagagaaatctacggtggtgggtgattcgccggagttcaatttcgtagctagatttctcctccttttccccccgacgagctgtgcgagagagggaggggaatcatgcagaaacggagaacggtgaaggaatctacgaagataagaaatggtaaaggtatggattccggcgaaaagaagagatctgagaagagattgatgaagttcgaggagttacctaggtatttgaaagataacgagttcatacacaatcattatcgatgtgagtggtcaatcaaagaaactttcctcagcgctttctcatggcacaatgagactctcaacatctggacgcatttgtgtggatttgcgatatttacttggatgatggttgtgagttcaatggagacgacggagcttggcctcgccggctttgttagccttctctccggagcaacaattcgctggccatggccgtcaatggcaatgtcaaaagatgtttacttctccagcgatcaaactctgcatcacgacttaaacgtgacacacactcgctcgctcctgaattctcaaggagatgttaactacgaagccattccgaaatggccatggcttgtgttcttgaccggagcaatgggctgcttgatctgcagttccatgtcacacctcttcgcctgtcactccagacggttcaacctcttcttctggcgtctagactacgctggaatctccctcatgatcgtctgttcattcttcgcacctatctactatgcattctcatgccacacttactggcgactcttctacctctcatcgatctcaatcctcggtctcctcgccatcttcactctcctctctccatcactctcagctccacgtttcagatctttcagagcagctctgttcctaacaatgggattttctggcgtaataccagccacacatgtgctttaccttcataaggatcacccaaacgtgcttatagctctcgtatatgaacttgcgatggctgtgttgtatgcaacaggagcagcgttttatgttacccgcatacctgaaagatggaagcctggggcttttgatattgcaggacatagccatcagatattccatgtgtttgtagtcttaggagctcttgctcatagtgttgccagtcttcttatcatggattttcgacgggcttctccttcttgtgccttttaactcgaaaacacattgtaaaacatttagtaatacttcattcaatgtatcaatgtatgtttgtccc

SEQ ID NO: 1784 - protein, 1291 aa, Arabidopsis thaliana
GAAAAAAAACAAATCAGATTCTCAAATACTGAAAATAAAAAGAAGAAGAGAGAAATCTACGGTGGTGGGTGATTCGCCGGAGTTCAATTTCGTAGCTAGATTTCTCCTCCTTTTCCCCCCGACGAGCTGTGCGAGAGAGGGAGGGGAATCATGCAGAAACGGAGAACGGTGAAGGAATCTACGAAGATAAGAAATGGTAAAGGTATGGATTCCGGCGAAAAGAAGAGATCTGAGAAGAGATTGATGAAGTTCGAGGAGTTACCTAGGTATTTGAAAGATAACGAGTTCATACACAATCATTATCGATGTGAGTGGTCAATCAAAGAAACTTTCCTCAGCGCTTTCTCATGGCACAATGAGACTCTCAACATCTGGACGCATTTGTGTGGATTTGCGATATTTACTTGGATGATGGTTGTGAGTTCAATGGAGACGACGGAGCTTGGCCTCGCCGGCTTTGTTAGCCTTCTCTCCGGAGCAACAATTCGCTGGCCATGGCCGTCAATGGCAATGTCAAAAGATGTTTACTTCTCCAGCGATCAAACTCTGCATCACGACTTAAACGTGACACACACTCGCTCGCTCCTGAATTCTCAAGGAGATGTTAACTACGAAGCCATTCCGAAATGGCCATGGCTTGTGTTCTTGACCGGAGCAATGGGCTGCTTGATCTGCAGTTCCATGTCACACCTCTTCGCCTGTCACTCCAGACGGTTCAACCTCTTCTTCTGGCGTCTAGACTACGCTGGAATCTCCCTCATGATCGTCTGTTCATTCTTCGCACCTATCTACTATGCATTCTCATGCCACACTTACTGGCGACTCTTCTACCTCTCATCGATCTCAATCCTCGGTCTCCTCGCCATCTTCACTCTCCTCTCTCCATCACTCTCAGCTCCACGTTTCAGATCTTTCAGAGCAGCTCTGTTCCTAACAATGGGATTTTCTGGCGTAATACCAGCCACACATGTGCTTTACCTTCATAAGGATCACCCAAACGTGCTTATAGCTCTCGTATATGAACTTGCGATGGCTGTGTTGTATGCAACAGGAGCAGCGTTTTATGTTACCCGCATACCTGAAAGATGGAAGCCTGGGGCTTTTGATATTGCAGGACATAGCCATCAGATATTCCATGTGTTTGTAGTCTTAGGAGCTCTTGCTCATAGTGTTGCCAGTCTTCTTATCATGGATTTTCGACGGGCTTCTCCTTCTTGTGCCTTTTAACTCGAAAACACATTGTAAAACATTTAGTAATACTTCATTCAATGTATCAATGTATGTTTGTCCC

SEQ ID NO: 1785 - DNA, 2670 bp, Arabidopsis thaliana
  misc_feature (1)..(2670): Ceres cDNA ID no. 12684208
  misc_feature (1)..(2670): Also known as  Ceres CDNA ID no. 12683979
atgaagtctcttcatttttgtttgctctttatgatcgtatcttttacagtttcgagacccgtcgaagctcaagatcaagcaggattcatcagcttggattgtgggttggtgcctaaggaaaccacttatgtggaaacgtcgacgaatataacatacaaatcagacgcaaattacaccgacagcggattggtcgggaagatcaatgatgcacacaagacactggttcaacaaccgctttgggccttgagaagcttccctgagggtgaaagaaactgttacaacttcaaccttaccgtgaacagcacatatttgatcagaggaacttttttgtatgggaattatgacggcttgaatcaatccccaagctttgaccttcacattggtgctagcaaatggacctctgttaacatagtaggagtaacagataccgtaatgcccgagataatccatgtcttaacacaaaaacgtcttcaagtctgtcttgttaagacaggaaagacgacaccgttcatttcgtcattggaattgcgtccgttgataaataacatttacatcgcggaaagtggatcaatggtcttgcaaaatagagtatattttccatctgattcaacatctatcgtcaggtacgatgaggacatacacgaccgagtatggaatccagtttcagatgatgattcctcatcgataagcacggacctccaggtccaaacaaataacttatatgacgtgcctcaattcgtaatgaagactgctgctatccctaaagatgctagtgcgccatggagcttagtgtggactatagataacaccactgctctgtcatatgtatatatgcatttcgcagaaattcaggatttaaaagccaatgaccttagagaattcgacattacttacaatggtggcaagctttggttttcccagtttaggcctaacaaactcagcattctaacgatgttcagtcaagtccccttgacttcatcaaatggcgagtataatttcactttcgaaatgactagtaactcaactcttccaccccttatcaacgccctcgagatatatacaggtctagaaattctacagcttcagacagacaaggatgaagtttctgctatgatgaacatcaaaacgacttatgatttgagcaaaaagataagctggcagggagatccatgtgctcctcagctgtatcggtgggaaggtctagattgtagttatccggacaccgaggcatcacggattatatccttgaacttgaatgcgagcgggttgaacggtaccataacatctgacataaccaagctaacacagttgagcgagctagatttatcaaataatgatttatcaggagagattccggaattttttacggatatgaagttgttgaaactcataaacttaagcggaaatccgaagctcaatctcacagttccagactctcttcagcaaagggtaaacaacaaatctttaacactaattttgggtgaaaaggttaaaatgaatcccacagccaaaaaagagagtaaaaaggttcccatagttcctatcgcagcatcagtggctggcgtgtttgctctgatagttatattggccatctttttcattgttaaaggaaaaaaagggaaaagtgctgaaggaccacccttatcagtcactagtggtacagctaaaagtgagacaagatcatccaatccatcaatcatgagaaaagatcgcaagatcacatatcctcaggtattgaagatgactaataacttcgagagagttcttggtaaaggagggtttggaacagtatatcatggaaacatggaagatgctcaagtagctgtgaaaatgctctcgcactcatcggctcaaggttataaagagttcaaagcagaggttgaacttcttttaagagttcaccacagacatttggtgggacttgtgggttactgtgatgatggagataacttggctctgatttatgaatatatggcaaatggagacctgagggagaatatgttaggaaaacgtggaggcaatgtccttacctgggaaaacaggatgcaaatagctgtagaggctgcacaaggactggagtatctgcacaatggatgtacgcctccaatggtccatagagatgttaaaactactaacatcttattgaatgcacagtgtggagcgaaactagccgactttgggctctctagatcttttccaatcgatggtgaatgtcatgtctcaacagtcgttgcgggtacacctgggtacctagaccctgagtattacagaacaaactggctaagcgagaagagtgacgtgtacagcttcggtgtagtgctattagagatagtcacaaaccagcctgttataaatcaaacaagagagagacctcacatcaatgaatgggttggcttcatgctcagtaaaggagacatcaagagcatcgtcgacccaaaactgatgggggactatgacacaaacggtgcatggaagattgtggagctgggtcttgcctgtgtgaacccgtcttcgaacctaagaccaacaatggcacacgttgtgattgagctaaacgagtgtgtggcctttgaaaatgcaaggcgacaaggtagtgaagagatgtacacaagaagttctactaactttagtcacacgtctgcttccgaattttcccccggggcaagataa

SEQ ID NO: 1786 - protein, 2670 aa, Arabidopsis thaliana
ATGAAGTCTCTTCATTTTTGTTTGCTCTTTATGATCGTATCTTTTACAGTTTCGAGACCCGTCGAAGCTCAAGATCAAGCAGGATTCATCAGCTTGGATTGTGGGTTGGTGCCTAAGGAAACCACTTATGTGGAAACGTCGACGAATATAACATACAAATCAGACGCAAATTACACCGACAGCGGATTGGTCGGGAAGATCAATGATGCACACAAGACACTGGTTCAACAACCGCTTTGGGCCTTGAGAAGCTTCCCTGAGGGTGAAAGAAACTGTTACAACTTCAACCTTACCGTGAACAGCACATATTTGATCAGAGGAACTTTTTTGTATGGGAATTATGACGGCTTGAATCAATCCCCAAGCTTTGACCTTCACATTGGTGCTAGCAAATGGACCTCTGTTAACATAGTAGGAGTAACAGATACCGTAATGCCCGAGATAATCCATGTCTTAACACAAAAACGTCTTCAAGTCTGTCTTGTTAAGACAGGAAAGACGACACCGTTCATTTCGTCATTGGAATTGCGTCCGTTGATAAATAACATTTACATCGCGGAAAGTGGATCAATGGTCTTGCAAAATAGAGTATATTTTCCATCTGATTCAACATCTATCGTCAGGTACGATGAGGACATACACGACCGAGTATGGAATCCAGTTTCAGATGATGATTCCTCATCGATAAGCACGGACCTCCAGGTCCAAACAAATAACTTATATGACGTGCCTCAATTCGTAATGAAGACTGCTGCTATCCCTAAAGATGCTAGTGCGCCATGGAGCTTAGTGTGGACTATAGATAACACCACTGCTCTGTCATATGTATATATGCATTTCGCAGAAATTCAGGATTTAAAAGCCAATGACCTTAGAGAATTCGACATTACTTACAATGGTGGCAAGCTTTGGTTTTCCCAGTTTAGGCCTAACAAACTCAGCATTCTAACGATGTTCAGTCAAGTCCCCTTGACTTCATCAAATGGCGAGTATAATTTCACTTTCGAAATGACTAGTAACTCAACTCTTCCACCCCTTATCAACGCCCTCGAGATATATACAGGTCTAGAAATTCTACAGCTTCAGACAGACAAGGATGAAGTTTCTGCTATGATGAACATCAAAACGACTTATGATTTGAGCAAAAAGATAAGCTGGCAGGGAGATCCATGTGCTCCTCAGCTGTATCGGTGGGAAGGTCTAGATTGTAGTTATCCGGACACCGAGGCATCACGGATTATATCCTTGAACTTGAATGCGAGCGGGTTGAACGGTACCATAACATCTGACATAACCAAGCTAACACAGTTGAGCGAGCTAGATTTATCAAATAATGATTTATCAGGAGAGATTCCGGAATTTTTTACGGATATGAAGTTGTTGAAACTCATAAACTTAAGCGGAAATCCGAAGCTCAATCTCACAGTTCCAGACTCTCTTCAGCAAAGGGTAAACAACAAATCTTTAACACTAATTTTGGGTGAAAAGGTTAAAATGAATCCCACAGCCAAAAAAGAGAGTAAAAAGGTTCCCATAGTTCCTATCGCAGCATCAGTGGCTGGCGTGTTTGCTCTGATAGTTATATTGGCCATCTTTTTCATTGTTAAAGGAAAAAAAGGGAAAAGTGCTGAAGGACCACCCTTATCAGTCACTAGTGGTACAGCTAAAAGTGAGACAAGATCATCCAATCCATCAATCATGAGAAAAGATCGCAAGATCACATATCCTCAGGTATTGAAGATGACTAATAACTTCGAGAGAGTTCTTGGTAAAGGAGGGTTTGGAACAGTATATCATGGAAACATGGAAGATGCTCAAGTAGCTGTGAAAATGCTCTCGCACTCATCGGCTCAAGGTTATAAAGAGTTCAAAGCAGAGGTTGAACTTCTTTTAAGAGTTCACCACAGACATTTGGTGGGACTTGTGGGTTACTGTGATGATGGAGATAACTTGGCTCTGATTTATGAATATATGGCAAATGGAGACCTGAGGGAGAATATGTTAGGAAAACGTGGAGGCAATGTCCTTACCTGGGAAAACAGGATGCAAATAGCTGTAGAGGCTGCACAAGGACTGGAGTATCTGCACAATGGATGTACGCCTCCAATGGTCCATAGAGATGTTAAAACTACTAACATCTTATTGAATGCACAGTGTGGAGCGAAACTAGCCGACTTTGGGCTCTCTAGATCTTTTCCAATCGATGGTGAATGTCATGTCTCAACAGTCGTTGCGGGTACACCTGGGTACCTAGACCCTGAGTATTACAGAACAAACTGGCTAAGCGAGAAGAGTGACGTGTACAGCTTCGGTGTAGTGCTATTAGAGATAGTCACAAACCAGCCTGTTATAAATCAAACAAGAGAGAGACCTCACATCAATGAATGGGTTGGCTTCATGCTCAGTAAAGGAGACATCAAGAGCATCGTCGACCCAAAACTGATGGGGGACTATGACACAAACGGTGCATGGAAGATTGTGGAGCTGGGTCTTGCCTGTGTGAACCCGTCTTCGAACCTAAGACCAACAATGGCACACGTTGTGATTGAGCTAAACGAGTGTGTGGCCTTTGAAAATGCAAGGCGACAAGGTAGTGAAGAGATGTACACAAGAAGTTCTACTAACTTTAGTCACACGTCTGCTTCCGAATTTTCCCCCGGGGCAAGATAA

SEQ ID NO: 1787 - DNA, 1808 bp, Arabidopsis thaliana
  misc_feature (1)..(1808): Ceres cDNA ID no. 12684929
  misc_feature (1)..(1808): Also known as  Ceres CDNA ID no. 12683979
attttccattttgcttcttcttccttcttctcctctctctgacaccaacaatggcgagacttaccttgagaccccacaatcacttcttctcatctcctatctacgcacataaacaacctttcctctccgtatacaccatcttcccccaccaccaccaaaatcctcttatcaaatcaagggttaagtgctccgccagtggtactgaacgagtcagagagagtaagaagcttcctccaaaggatcctatcgaagaccctaaaccccagcttccgattcctgaagttctcagtacggaaacgggttttgaacagaattggcctccatggaaaaatatacctcagagatataagcttatcggcgctacttctctcgcctttgttatctgcaatatggacaaggtgaacttgagtattgctataataccaatgtcacaccagtttggatggagctcatctgtggctgggttggtccagtcttccttcttttggggttatgccttgagccagttgcctggaggttggctttccaagatttttggcggaagaaaagtgcttgagattggtgtctttacatggtctttcgctacagctcttgttccactacttgctggatttatgcccggtttgatcttttctcgaattttgagatttgtaactccaggtgggaataggagaaggtgtttccccatcggctgcgacagaccttattgccaggacaatacctgttaaggagcgctcaagagcggtaggctttgtttttggaggactgagtttggggagtgtaatggggcttctcttggctcctcccatcatcgaaacctttaattgggaatctgtcttttacttgtttggtctccttggtgttggctggttcgtcgggtttcagtttcttaatgaagaagaagtttcatataaaggtaatgagatctctacttcgcataaatcagaaaacgctacaaaggaagagttggggagctcattgaaggagattccatggaagtcatttttccaaagcccggctgtttgggcaatgatatacactcacttttgtggaagttggggtcactatacctgtttatcttggctaccaacttatttcagtgaggctctgagtctaaatttgacagaagctgcttgggtttccatccttcctccactggcttcgattgtcgtgacaagtcttgcttcacaatttgctgattacttaattacaaatggagttgatactaccacggtccgaaagatttgtcaaacgattgcgtttgtggcaccagcgatctgcatgacactttcatctgtggacattggattgccaccatgggaaattgtaggaattttgacagcaggcttggccctatcaagttttgctttatcaggactttattgtactcatcaggacatttcacccgaatatgcaagcatactcctgggtattacaaacacagtcggggcagtacctggaattgtaggagtggccctaactggttttctcctagactcgacccattcctggactatgtctctattcgtgccatcaatattcttctacttgacggggacggttgtatggttggcatttgcaagcagtgagcctcagacgttcagaaaggaagactcataagttttgttattgaggcacaaaaacatggagaaacttttgttattgtataggtaaaaaagaaatggtaaaaaattttctgttgtgaaagcaaaaacaaagagcagtggtaattttgttcactgccttatcctggtttttgcatagatgcaaattaaactcagtgttaatgggtaaaaggtggagtattg

SEQ ID NO: 1788 - protein, 1808 aa, Arabidopsis thaliana
ATTTTCCATTTTGCTTCTTCTTCCTTCTTCTCCTCTCTCTGACACCAACAATGGCGAGACTTACCTTGAGACCCCACAATCACTTCTTCTCATCTCCTATCTACGCACATAAACAACCTTTCCTCTCCGTATACACCATCTTCCCCCACCACCACCAAAATCCTCTTATCAAATCAAGGGTTAAGTGCTCCGCCAGTGGTACTGAACGAGTCAGAGAGAGTAAGAAGCTTCCTCCAAAGGATCCTATCGAAGACCCTAAACCCCAGCTTCCGATTCCTGAAGTTCTCAGTACGGAAACGGGTTTTGAACAGAATTGGCCTCCATGGAAAAATATACCTCAGAGATATAAGCTTATCGGCGCTACTTCTCTCGCCTTTGTTATCTGCAATATGGACAAGGTGAACTTGAGTATTGCTATAATACCAATGTCACACCAGTTTGGATGGAGCTCATCTGTGGCTGGGTTGGTCCAGTCTTCCTTCTTTTGGGGTTATGCCTTGAGCCAGTTGCCTGGAGGTTGGCTTTCCAAGATTTTTGGCGGAAGAAAAGTGCTTGAGATTGGTGTCTTTACATGGTCTTTCGCTACAGCTCTTGTTCCACTACTTGCTGGATTTATGCCCGGTTTGATCTTTTCTCGAATTTTGAGATTTGTAACTCCAGGTGGGAATAGGAGAAGGTGTTTCCCCATCGGCTGCGACAGACCTTATTGCCAGGACAATACCTGTTAAGGAGCGCTCAAGAGCGGTAGGCTTTGTTTTTGGAGGACTGAGTTTGGGGAGTGTAATGGGGCTTCTCTTGGCTCCTCCCATCATCGAAACCTTTAATTGGGAATCTGTCTTTTACTTGTTTGGTCTCCTTGGTGTTGGCTGGTTCGTCGGGTTTCAGTTTCTTAATGAAGAAGAAGTTTCATATAAAGGTAATGAGATCTCTACTTCGCATAAATCAGAAAACGCTACAAAGGAAGAGTTGGGGAGCTCATTGAAGGAGATTCCATGGAAGTCATTTTTCCAAAGCCCGGCTGTTTGGGCAATGATATACACTCACTTTTGTGGAAGTTGGGGTCACTATACCTGTTTATCTTGGCTACCAACTTATTTCAGTGAGGCTCTGAGTCTAAATTTGACAGAAGCTGCTTGGGTTTCCATCCTTCCTCCACTGGCTTCGATTGTCGTGACAAGTCTTGCTTCACAATTTGCTGATTACTTAATTACAAATGGAGTTGATACTACCACGGTCCGAAAGATTTGTCAAACGATTGCGTTTGTGGCACCAGCGATCTGCATGACACTTTCATCTGTGGACATTGGATTGCCACCATGGGAAATTGTAGGAATTTTGACAGCAGGCTTGGCCCTATCAAGTTTTGCTTTATCAGGACTTTATTGTACTCATCAGGACATTTCACCCGAATATGCAAGCATACTCCTGGGTATTACAAACACAGTCGGGGCAGTACCTGGAATTGTAGGAGTGGCCCTAACTGGTTTTCTCCTAGACTCGACCCATTCCTGGACTATGTCTCTATTCGTGCCATCAATATTCTTCTACTTGACGGGGACGGTTGTATGGTTGGCATTTGCAAGCAGTGAGCCTCAGACGTTCAGAAAGGAAGACTCATAAGTTTTGTTATTGAGGCACAAAAACATGGAGAAACTTTTGTTATTGTATAGGTAAAAAAGAAATGGTAAAAAATTTTCTGTTGTGAAAGCAAAAACAAAGAGCAGTGGTAATTTTGTTCACTGCCTTATCCTGGTTTTTGCATAGATGCAAATTAAACTCAGTGTTAATGGGTAAAAGGTGGAGTATTG

SEQ ID NO: 1789 - DNA, 2436 bp, Arabidopsis thaliana
  misc_feature (1)..(2436): Ceres cDNA ID no. 12685438
  misc_feature (1)..(2436): Also known as  Ceres CDNA ID no. 12683979
atgggtactttggtcaacggtactattccggcgatgaagtgtcccaagaatgtggcgatgatgaagacaacgtctaacggagtgttcgatggagagagtccattagatttcgcttttcctcttgtcattcttcagatttgccttgtcgtcgccgtcactcgctctttggccttccttctccgtcccatgagacaaccacgtgttgtcgccgagatcattggcgggattcttcttggcccgtcggctctcggtagaatcacgtcgtacaagaattcaattttcccggcgagaagtctaacggtgctcgacactctagcaaacctcggcctccttctcttccttttcctcgtcggactcgagatcgatctgacatctctccgacgtaccggcaaaaaagcgatttccatcgccgccgccggaatgcttctccccttcggtatgggcattgtcacctccttcgctttccctgaagcttcttcttctggcgacaatagcaaagtacttccgttcatcattttcatgggagtcgcgctctcgatcactgctttcggagttttggcgagaatactcgctgaattaaagctactcacaaccgatctcggccggatttcaatgaacgccgccgcaattaacgacgtcgcggcttgggttctcctagctctcgctgtatctctctccggcgataggaattctccgcttgttcctctctgggttctgttaagtggaatcgcgtttgtgatcgcgtgttttttaatcgtaccgcgaattttcaaattcatctctcggcgttgcccagaaggcgaacccataggcgaaatgtacgtttgcgtcgccctttgcgcggttctactcgcgggtttcgcgacagacgccattgggattcacgcgattttcggtgcgtttgtgatgggcgttttgtttcccaaaggacatttctcagacgcgattgtggagaagattgaagatcttgtaatgggtcttcttctaccactgtacttcgttatgagcggtttgaaaacggatataactacgattcaaggtgtgaaatcgtggggacgactcgcgttggtgattgttacggcttgttttggcaaaatcgttgggactgtgagtgttgccttgttatgcaaggtaaggctccgtgaatcggttgttcttggggttttaatgaacacaaagggtttagtggagctaattgttctcaacattggcaaagacagaaaggttttgagcgatcagacttttgcaattatggttctcatggcgatattcacaacattcatcacaacgccaatagtcttggcgttatacaaaccaagcgagacaacacaaacacatagtagcgtcagctacaagaaccgcaaacatagacgcaagattgagaatgatgaagaaggcgagaagatgcagcagcttaaggttttggtatgtcttcaaagcagtaaagatattgatcccatgatgaaaataatggaagctactcgtggaagcaacgaaaccaaagaaagattttgcgtttacgttatgcatttaactcaactctccgagagaccttcttctattcgaatggttcaaaaggtgagaagcaacggtttgcccttttggaacaagaaaagagagaattctagtgccgttacggtcgcgttcgaggcgtctagtaagctaagtagcgtttcggtgcgttctgtgaccgcgatttcaccgttgtcaacaattcatgaggatatatgtagctctgctgatagtaaatgcacagcgtttgtgattttgccgttccataagcaatggagatctctggagaaagaatttgaaacggtgagatcggagtatcaggggattaacaaaagagttcttgagaattcaccgtgttctgttggaattttggttgatcgtggtctcggcgacaacaattctccggtagcttcgagcaacttttcactttccgtcaatgttctgttctttggcggttgcgatgatcgtgaagctttggtttacgggttacgaatggctgaacatccgggcgttaacttgaccgttgtggttatctctggtccggagagcgcaaggtttgataggcttgaagcgcaagaaacatcactatgttccttagacgagcaattccttgcagcaatcaagaaaagggccaatgcagctagatttgaagagaggacggtgaattcaacggaggaagtggttgagattatccgccaattttacgagtgcgatattttattggtgggaaaatcttccaaaggacctatggtttcaagattaccggttatgaagatagagtgtccagaactgggaccggtcggaaacttgatcgtgtcaaatgagatttctacttcagtgtctgttttggtggttcaacaatacaccgggaaaggtccttctgtggtgggttccgtctctgtcccggtggtggagacgccatga

SEQ ID NO: 1790 - protein, 2436 aa, Arabidopsis thaliana
ATGGGTACTTTGGTCAACGGTACTATTCCGGCGATGAAGTGTCCCAAGAATGTGGCGATGATGAAGACAACGTCTAACGGAGTGTTCGATGGAGAGAGTCCATTAGATTTCGCTTTTCCTCTTGTCATTCTTCAGATTTGCCTTGTCGTCGCCGTCACTCGCTCTTTGGCCTTCCTTCTCCGTCCCATGAGACAACCACGTGTTGTCGCCGAGATCATTGGCGGGATTCTTCTTGGCCCGTCGGCTCTCGGTAGAATCACGTCGTACAAGAATTCAATTTTCCCGGCGAGAAGTCTAACGGTGCTCGACACTCTAGCAAACCTCGGCCTCCTTCTCTTCCTTTTCCTCGTCGGACTCGAGATCGATCTGACATCTCTCCGACGTACCGGCAAAAAAGCGATTTCCATCGCCGCCGCCGGAATGCTTCTCCCCTTCGGTATGGGCATTGTCACCTCCTTCGCTTTCCCTGAAGCTTCTTCTTCTGGCGACAATAGCAAAGTACTTCCGTTCATCATTTTCATGGGAGTCGCGCTCTCGATCACTGCTTTCGGAGTTTTGGCGAGAATACTCGCTGAATTAAAGCTACTCACAACCGATCTCGGCCGGATTTCAATGAACGCCGCCGCAATTAACGACGTCGCGGCTTGGGTTCTCCTAGCTCTCGCTGTATCTCTCTCCGGCGATAGGAATTCTCCGCTTGTTCCTCTCTGGGTTCTGTTAAGTGGAATCGCGTTTGTGATCGCGTGTTTTTTAATCGTACCGCGAATTTTCAAATTCATCTCTCGGCGTTGCCCAGAAGGCGAACCCATAGGCGAAATGTACGTTTGCGTCGCCCTTTGCGCGGTTCTACTCGCGGGTTTCGCGACAGACGCCATTGGGATTCACGCGATTTTCGGTGCGTTTGTGATGGGCGTTTTGTTTCCCAAAGGACATTTCTCAGACGCGATTGTGGAGAAGATTGAAGATCTTGTAATGGGTCTTCTTCTACCACTGTACTTCGTTATGAGCGGTTTGAAAACGGATATAACTACGATTCAAGGTGTGAAATCGTGGGGACGACTCGCGTTGGTGATTGTTACGGCTTGTTTTGGCAAAATCGTTGGGACTGTGAGTGTTGCCTTGTTATGCAAGGTAAGGCTCCGTGAATCGGTTGTTCTTGGGGTTTTAATGAACACAAAGGGTTTAGTGGAGCTAATTGTTCTCAACATTGGCAAAGACAGAAAGGTTTTGAGCGATCAGACTTTTGCAATTATGGTTCTCATGGCGATATTCACAACATTCATCACAACGCCAATAGTCTTGGCGTTATACAAACCAAGCGAGACAACACAAACACATAGTAGCGTCAGCTACAAGAACCGCAAACATAGACGCAAGATTGAGAATGATGAAGAAGGCGAGAAGATGCAGCAGCTTAAGGTTTTGGTATGTCTTCAAAGCAGTAAAGATATTGATCCCATGATGAAAATAATGGAAGCTACTCGTGGAAGCAACGAAACCAAAGAAAGATTTTGCGTTTACGTTATGCATTTAACTCAACTCTCCGAGAGACCTTCTTCTATTCGAATGGTTCAAAAGGTGAGAAGCAACGGTTTGCCCTTTTGGAACAAGAAAAGAGAGAATTCTAGTGCCGTTACGGTCGCGTTCGAGGCGTCTAGTAAGCTAAGTAGCGTTTCGGTGCGTTCTGTGACCGCGATTTCACCGTTGTCAACAATTCATGAGGATATATGTAGCTCTGCTGATAGTAAATGCACAGCGTTTGTGATTTTGCCGTTCCATAAGCAATGGAGATCTCTGGAGAAAGAATTTGAAACGGTGAGATCGGAGTATCAGGGGATTAACAAAAGAGTTCTTGAGAATTCACCGTGTTCTGTTGGAATTTTGGTTGATCGTGGTCTCGGCGACAACAATTCTCCGGTAGCTTCGAGCAACTTTTCACTTTCCGTCAATGTTCTGTTCTTTGGCGGTTGCGATGATCGTGAAGCTTTGGTTTACGGGTTACGAATGGCTGAACATCCGGGCGTTAACTTGACCGTTGTGGTTATCTCTGGTCCGGAGAGCGCAAGGTTTGATAGGCTTGAAGCGCAAGAAACATCACTATGTTCCTTAGACGAGCAATTCCTTGCAGCAATCAAGAAAAGGGCCAATGCAGCTAGATTTGAAGAGAGGACGGTGAATTCAACGGAGGAAGTGGTTGAGATTATCCGCCAATTTTACGAGTGCGATATTTTATTGGTGGGAAAATCTTCCAAAGGACCTATGGTTTCAAGATTACCGGTTATGAAGATAGAGTGTCCAGAACTGGGACCGGTCGGAAACTTGATCGTGTCAAATGAGATTTCTACTTCAGTGTCTGTTTTGGTGGTTCAACAATACACCGGGAAAGGTCCTTCTGTGGTGGGTTCCGTCTCTGTCCCGGTGGTGGAGACGCCATGA

SEQ ID NO: 1791 - DNA, 1661 bp, Arabidopsis thaliana
  misc_feature (1)..(1661): Ceres cDNA ID no. 12685518
  misc_feature (1)..(1661): Also known as  Ceres CDNA ID no. 12683979
ttttgtctttgcaacatcaccaccatacatacatacaacttacatacatacacgtcttccacaagactcaaactccacagcatgggattctcacggtcgctcaaccgcaccgtgggcgtcttcgtcttcttcatcctcgacattgttgatttcctgctttgctttacctacaagactcttgatttcttcttcgagtccgagtggaaaccctgctactgctgtccgccgcccgaggccaaaccaatctcggctggagggaacagaggcggtaagatgatagtgtcggaaagatcaggagactactcgaaggtggtctcactcacaaggacaaagatctatctggatgagatctccgacacactctactctcgcccttcactcctcaccaagctcactaagctggtgaagtgcttcaagaaagatgttgttaaatgctgtgatgagtccaagaagagatcaccgtcaactaaaaagacattactcactgtcaactccacggtggtcgagaagttgcaaagaacaccaagatggtctgattgccattgcactttctgcacttcttggctttcctcttccaaccaatctctctttgtcaatgtccaacagcccacagacaacaaggcacaagagaacgtagtgttcattcatgggttcttatcatcatccacgttttggacggagactctgttcccaaacttctcagactcagccaaatcgaattacaggtttctcgcagtggacctgttgggttatgggaaaagtccaaagccgaacgattcattgtatacattaaaagagcatttagagatgatagagagatcggtgatttctcagttcagactcaagacattccatttagtggctcactccctaggctgcattttggctcttgcgctcgcggttaaacacccaggagccatcaagtcactcactctattggctcctccatattattcggtgccaaaaggtgtgcaagggacgcaatatgtgatgagaagactggcccccaaggaagtgtggcctccgatggccttcggagcctcagtggctagctggtacgagcacattagccgcacagtcagtctagtgctttgcaagaatcatcacttgttggaatttctcaccaggctactcaccagaaacaggatgcgaacgtacttgatagaagggttcttgtgtcacacacataacgcgtcatggcacacactacacaacatcattttcggatcggggagcaaagtagaggcttatttggaccatgtccgtgacaacgtggactgtgaggtcgcagtcttccacggcggtagggacgagctgatccccgtggagtgcagctacggcgtcaagaggaaagtgccacgtgcaaggatccacgtcgtccccgacaaagaccacatcaccattgttgttgggaggcagaaggagttcgctcgtgagcttgagctcatttggcgcagatccactactcctcaacttcattcaataaattaacccttctttattttaagctaagtatatatatattaataccaaccactattattcaaaccatcattttatacccattcacttttgcatatttcggtgactcctatgtagaaaaaaaaaaaacagaacatgtttcttttgtggttgccatttcattatgatttcgaattttg

SEQ ID NO: 1792 - protein, 1661 aa, Arabidopsis thaliana
TTTTGTCTTTGCAACATCACCACCATACATACATACAACTTACATACATACACGTCTTCCACAAGACTCAAACTCCACAGCATGGGATTCTCACGGTCGCTCAACCGCACCGTGGGCGTCTTCGTCTTCTTCATCCTCGACATTGTTGATTTCCTGCTTTGCTTTACCTACAAGACTCTTGATTTCTTCTTCGAGTCCGAGTGGAAACCCTGCTACTGCTGTCCGCCGCCCGAGGCCAAACCAATCTCGGCTGGAGGGAACAGAGGCGGTAAGATGATAGTGTCGGAAAGATCAGGAGACTACTCGAAGGTGGTCTCACTCACAAGGACAAAGATCTATCTGGATGAGATCTCCGACACACTCTACTCTCGCCCTTCACTCCTCACCAAGCTCACTAAGCTGGTGAAGTGCTTCAAGAAAGATGTTGTTAAATGCTGTGATGAGTCCAAGAAGAGATCACCGTCAACTAAAAAGACATTACTCACTGTCAACTCCACGGTGGTCGAGAAGTTGCAAAGAACACCAAGATGGTCTGATTGCCATTGCACTTTCTGCACTTCTTGGCTTTCCTCTTCCAACCAATCTCTCTTTGTCAATGTCCAACAGCCCACAGACAACAAGGCACAAGAGAACGTAGTGTTCATTCATGGGTTCTTATCATCATCCACGTTTTGGACGGAGACTCTGTTCCCAAACTTCTCAGACTCAGCCAAATCGAATTACAGGTTTCTCGCAGTGGACCTGTTGGGTTATGGGAAAAGTCCAAAGCCGAACGATTCATTGTATACATTAAAAGAGCATTTAGAGATGATAGAGAGATCGGTGATTTCTCAGTTCAGACTCAAGACATTCCATTTAGTGGCTCACTCCCTAGGCTGCATTTTGGCTCTTGCGCTCGCGGTTAAACACCCAGGAGCCATCAAGTCACTCACTCTATTGGCTCCTCCATATTATTCGGTGCCAAAAGGTGTGCAAGGGACGCAATATGTGATGAGAAGACTGGCCCCCAAGGAAGTGTGGCCTCCGATGGCCTTCGGAGCCTCAGTGGCTAGCTGGTACGAGCACATTAGCCGCACAGTCAGTCTAGTGCTTTGCAAGAATCATCACTTGTTGGAATTTCTCACCAGGCTACTCACCAGAAACAGGATGCGAACGTACTTGATAGAAGGGTTCTTGTGTCACACACATAACGCGTCATGGCACACACTACACAACATCATTTTCGGATCGGGGAGCAAAGTAGAGGCTTATTTGGACCATGTCCGTGACAACGTGGACTGTGAGGTCGCAGTCTTCCACGGCGGTAGGGACGAGCTGATCCCCGTGGAGTGCAGCTACGGCGTCAAGAGGAAAGTGCCACGTGCAAGGATCCACGTCGTCCCCGACAAAGACCACATCACCATTGTTGTTGGGAGGCAGAAGGAGTTCGCTCGTGAGCTTGAGCTCATTTGGCGCAGATCCACTACTCCTCAACTTCATTCAATAAATTAACCCTTCTTTATTTTAAGCTAAGTATATATATATTAATACCAACCACTATTATTCAAACCATCATTTTATACCCATTCACTTTTGCATATTTCGGTGACTCCTATGTAGAAAAAAAAAAAACAGAACATGTTTCTTTTGTGGTTGCCATTTCATTATGATTTCGAATTTTG

SEQ ID NO: 1793 - DNA, 1260 bp, Arabidopsis thaliana
  misc_feature (1)..(1260): Ceres cDNA ID no. 12686275
  misc_feature (1)..(1260): Also known as  Ceres CDNA ID no. 12683979
atggctcctctccctttcataccggaacaaacccgttcgcaaacgcgtttatcttcagacacaaagaagaagaacagaaacaagaaaacgtcccaaccaccgcctcaaacgcaaaagataaagcagaagacggtaccatcaacatcatcatcgtcgtcatggagccagataaagaaccttttgagttgcaaacaaatcgaagggccacgagtgcacgaaccatcaaagattacgtcatcatcttgtggctcctctctttgtaagtttagtgatgttatttacggtaatgcccgtgtgattcaccgctccgatcactcccctgagagtagcaatcttggacaagatacccggttgttgacccgaaaacccattagtacccgtggatcttcttcatcggttagatccaacggttgtggcgcttacacgtcatattcaacttccaaagctatgcacttcagaaacctctcaggttgctatgagtgtcacatgattgttgatccaagcaggtatccaatagcaccaagaatatgtgcatgtccacagtgtggggaggtcttccctaagcttgaatcattggagcatcatcaagcagttcgtcacgctgtgtcggagttggggccagaggattcagggagaaacatagtggacatcatcttcaaatctagctggttacgtaaagacagtcccatctacaagatcgaacggatattaaaagtccacaacactcaacgaacgatccaacggtttgaagattgtcgcgacgcagtcaagtcccatgcacatgcctctaccagaaaagaggctcggtccgccgccgacggcaacgagcttctccgcttccactgcaccacagtttcttgctccctcggctcacgcggctcgacctccatttgctccgccatccctggctgccgcgtttgcaccattatccgccatggcttccacgccaaaacggtacgtgtaggcaatggtgaaggaaaagaggagattaagggcgtgaggaccactgcaagcagtggaagagcacacgatgcgttgaggtgttttgaccagcggagggcgatgcttgtttgccgtgtgatcgcgggaagagtgaggcgcgtgcagagtgatgtgccggaagatgaaagtggttctggctcgtatgattcggttgcgggggccgctggggtctacacaaaccttgacgacttggttgtgtataatccaaaagctatacttccttgctttgtagttatctacaaagtctccgagccttaa

SEQ ID NO: 1794 - protein, 1260 aa, Arabidopsis thaliana
ATGGCTCCTCTCCCTTTCATACCGGAACAAACCCGTTCGCAAACGCGTTTATCTTCAGACACAAAGAAGAAGAACAGAAACAAGAAAACGTCCCAACCACCGCCTCAAACGCAAAAGATAAAGCAGAAGACGGTACCATCAACATCATCATCGTCGTCATGGAGCCAGATAAAGAACCTTTTGAGTTGCAAACAAATCGAAGGGCCACGAGTGCACGAACCATCAAAGATTACGTCATCATCTTGTGGCTCCTCTCTTTGTAAGTTTAGTGATGTTATTTACGGTAATGCCCGTGTGATTCACCGCTCCGATCACTCCCCTGAGAGTAGCAATCTTGGACAAGATACCCGGTTGTTGACCCGAAAACCCATTAGTACCCGTGGATCTTCTTCATCGGTTAGATCCAACGGTTGTGGCGCTTACACGTCATATTCAACTTCCAAAGCTATGCACTTCAGAAACCTCTCAGGTTGCTATGAGTGTCACATGATTGTTGATCCAAGCAGGTATCCAATAGCACCAAGAATATGTGCATGTCCACAGTGTGGGGAGGTCTTCCCTAAGCTTGAATCATTGGAGCATCATCAAGCAGTTCGTCACGCTGTGTCGGAGTTGGGGCCAGAGGATTCAGGGAGAAACATAGTGGACATCATCTTCAAATCTAGCTGGTTACGTAAAGACAGTCCCATCTACAAGATCGAACGGATATTAAAAGTCCACAACACTCAACGAACGATCCAACGGTTTGAAGATTGTCGCGACGCAGTCAAGTCCCATGCACATGCCTCTACCAGAAAAGAGGCTCGGTCCGCCGCCGACGGCAACGAGCTTCTCCGCTTCCACTGCACCACAGTTTCTTGCTCCCTCGGCTCACGCGGCTCGACCTCCATTTGCTCCGCCATCCCTGGCTGCCGCGTTTGCACCATTATCCGCCATGGCTTCCACGCCAAAACGGTACGTGTAGGCAATGGTGAAGGAAAAGAGGAGATTAAGGGCGTGAGGACCACTGCAAGCAGTGGAAGAGCACACGATGCGTTGAGGTGTTTTGACCAGCGGAGGGCGATGCTTGTTTGCCGTGTGATCGCGGGAAGAGTGAGGCGCGTGCAGAGTGATGTGCCGGAAGATGAAAGTGGTTCTGGCTCGTATGATTCGGTTGCGGGGGCCGCTGGGGTCTACACAAACCTTGACGACTTGGTTGTGTATAATCCAAAAGCTATACTTCCTTGCTTTGTAGTTATCTACAAAGTCTCCGAGCCTTAA

SEQ ID NO: 1795 - DNA, 1197 bp, Arabidopsis thaliana
  misc_feature (1)..(1197): Ceres cDNA ID no. 12686551
  misc_feature (1)..(1197): Also known as  Ceres CDNA ID no. 12683979
atgatgggattgagttccttggtctttaccgagtttcacagcctcggcttctctgaccttatagtttttgttgcgccactctggattgctgtggctgccggtgttttggttggttgggtttggaggcccaagtgggcttatctcgattctaaactcttgtccaattcacctaaattcctcaatcttcagcttcccacttccatcctcaaaacttcttctcaccacgttaaccccagcctttcttccaaagagaaaactgggtttgtaacggacgatgattttaggcatctatggaagttggttgaggtcaaagatggcggtccttgttggattcaaatgatggaccgatcaaccccaaccttctcatatcaagcttggaggcgagatcctgagaatgggcctccccagtaccgtagcagaactgtgtttgaggatgccactcccgagatggtcagggacttcttttgggatgatgagttccgttccaagtgggatgatatgcttttgtattcttctactctcgagcgttgcaaggacacgggcactatggttgtgcaatgggtgcgaaagttccccttcttttgtagcgacagggagtatattataggccgtcgtatatgggatgctggccgagtcttttactgcattactaagggagtacaatacccgtctgtacctagacaaaacaagccaaggcgagtcgacttgtactattcaagctggtgtatccgtgcagttgaatcaaaaagaggcgatggtgagatgacatcatgtgaggtactactatttcaccatgaagatatgggaataccgtgggagattgcaaagcttggggtgagacagggtatgtggggtgcagtcaagaagattgagccaggcctacgtgcatatcagagggctaaagcagcgggagcaggtttatccccgagtgccataatggctcacatcaacaccaaagtgagtgcagaggagttcatgaatgagaggggttcgatagcagaggttacaggagacaagccgacggggaaaaacataccaaagatactagtggtaggaggggcgattgcacttgcatgtacattggacaaagggctgttgacaaaggcggtgatattcggagtagccagaagatttgcaagaatgggaaaaaggatgtaggagagagtgtacatgtaagtagacagagaacgaatgagg

SEQ ID NO: 1796 - protein, 1197 aa, Arabidopsis thaliana
ATGATGGGATTGAGTTCCTTGGTCTTTACCGAGTTTCACAGCCTCGGCTTCTCTGACCTTATAGTTTTTGTTGCGCCACTCTGGATTGCTGTGGCTGCCGGTGTTTTGGTTGGTTGGGTTTGGAGGCCCAAGTGGGCTTATCTCGATTCTAAACTCTTGTCCAATTCACCTAAATTCCTCAATCTTCAGCTTCCCACTTCCATCCTCAAAACTTCTTCTCACCACGTTAACCCCAGCCTTTCTTCCAAAGAGAAAACTGGGTTTGTAACGGACGATGATTTTAGGCATCTATGGAAGTTGGTTGAGGTCAAAGATGGCGGTCCTTGTTGGATTCAAATGATGGACCGATCAACCCCAACCTTCTCATATCAAGCTTGGAGGCGAGATCCTGAGAATGGGCCTCCCCAGTACCGTAGCAGAACTGTGTTTGAGGATGCCACTCCCGAGATGGTCAGGGACTTCTTTTGGGATGATGAGTTCCGTTCCAAGTGGGATGATATGCTTTTGTATTCTTCTACTCTCGAGCGTTGCAAGGACACGGGCACTATGGTTGTGCAATGGGTGCGAAAGTTCCCCTTCTTTTGTAGCGACAGGGAGTATATTATAGGCCGTCGTATATGGGATGCTGGCCGAGTCTTTTACTGCATTACTAAGGGAGTACAATACCCGTCTGTACCTAGACAAAACAAGCCAAGGCGAGTCGACTTGTACTATTCAAGCTGGTGTATCCGTGCAGTTGAATCAAAAAGAGGCGATGGTGAGATGACATCATGTGAGGTACTACTATTTCACCATGAAGATATGGGAATACCGTGGGAGATTGCAAAGCTTGGGGTGAGACAGGGTATGTGGGGTGCAGTCAAGAAGATTGAGCCAGGCCTACGTGCATATCAGAGGGCTAAAGCAGCGGGAGCAGGTTTATCCCCGAGTGCCATAATGGCTCACATCAACACCAAAGTGAGTGCAGAGGAGTTCATGAATGAGAGGGGTTCGATAGCAGAGGTTACAGGAGACAAGCCGACGGGGAAAAACATACCAAAGATACTAGTGGTAGGAGGGGCGATTGCACTTGCATGTACATTGGACAAAGGGCTGTTGACAAAGGCGGTGATATTCGGAGTAGCCAGAAGATTTGCAAGAATGGGAAAAAGGATGTAGGAGAGAGTGTACATGTAAGTAGACAGAGAACGAATGAGG

SEQ ID NO: 1797 - DNA, 1077 bp, Arabidopsis thaliana
  misc_feature (1)..(1077): Ceres cDNA ID no. 12686922
  misc_feature (1)..(1077): Also known as  Ceres CDNA ID no. 12683979
atggtgaagaagcaatcgccattacacgttgtcggtgtgtctgttttgatggtgttgttatgcagtgttaattacagtctctgtgaaaagatcaaaacgtataagctcacaagaggaagcttaagtgttactttcactaactatggtgctgtcatgacctctcttctcctccctgacagacatggaaaacaagacgatgttgttcttggatttgatactgttgatggttacaagaatgatacaacatattttggagcaattgtgggaagagtggctaatagaataggaggtgctaaattcaagttaaatggtcatctctacaaaaccgatcccaacgaaggccgtaacactctccatggtggttcaaagggatttagtgatgtgatttggtcagtccaaaagtatgttcccactagtcacattactttcacatacgatagcttcgacggtgaagaaggttttccgggcaatgtgacggtgaaagtgacgtacatgttgatcggagaaaacaaactcggtgtaaaaatggaagcaaagccactcaacaaacctacaccaatcaacttagctctccacacttactggaacctccacagccacaactccgggaacatcctctcccacaaaattcaactcctcgccggaaaaatcactcccgtcgacgacaaactcattcccaccggagaaatcacctccattaccggaactccttacgatttcctcgagccacgtgagatcggtagccggatccacgaattacccggcggttacgacatcaattacgtgatcgacggaccgatcgggaaacatctgaggaaaactgcggttgtgacggagcaagtcaccgggaggaagatggagctgtggacgaatcagcctggtgttcagttttacacgagtaatatgatgaaacgtgtcgtcggtaaaggtaaagccgtttatgagaaatacggtggcttgtgtttggagactcaaggcttcccagattccgtcaatcacaagaactttccgtcgcagattgttaatcccggcgagagttatttgcatgttatgctcttcagattcactgctcactaa

SEQ ID NO: 1798 - protein, 1077 aa, Arabidopsis thaliana
ATGGTGAAGAAGCAATCGCCATTACACGTTGTCGGTGTGTCTGTTTTGATGGTGTTGTTATGCAGTGTTAATTACAGTCTCTGTGAAAAGATCAAAACGTATAAGCTCACAAGAGGAAGCTTAAGTGTTACTTTCACTAACTATGGTGCTGTCATGACCTCTCTTCTCCTCCCTGACAGACATGGAAAACAAGACGATGTTGTTCTTGGATTTGATACTGTTGATGGTTACAAGAATGATACAACATATTTTGGAGCAATTGTGGGAAGAGTGGCTAATAGAATAGGAGGTGCTAAATTCAAGTTAAATGGTCATCTCTACAAAACCGATCCCAACGAAGGCCGTAACACTCTCCATGGTGGTTCAAAGGGATTTAGTGATGTGATTTGGTCAGTCCAAAAGTATGTTCCCACTAGTCACATTACTTTCACATACGATAGCTTCGACGGTGAAGAAGGTTTTCCGGGCAATGTGACGGTGAAAGTGACGTACATGTTGATCGGAGAAAACAAACTCGGTGTAAAAATGGAAGCAAAGCCACTCAACAAACCTACACCAATCAACTTAGCTCTCCACACTTACTGGAACCTCCACAGCCACAACTCCGGGAACATCCTCTCCCACAAAATTCAACTCCTCGCCGGAAAAATCACTCCCGTCGACGACAAACTCATTCCCACCGGAGAAATCACCTCCATTACCGGAACTCCTTACGATTTCCTCGAGCCACGTGAGATCGGTAGCCGGATCCACGAATTACCCGGCGGTTACGACATCAATTACGTGATCGACGGACCGATCGGGAAACATCTGAGGAAAACTGCGGTTGTGACGGAGCAAGTCACCGGGAGGAAGATGGAGCTGTGGACGAATCAGCCTGGTGTTCAGTTTTACACGAGTAATATGATGAAACGTGTCGTCGGTAAAGGTAAAGCCGTTTATGAGAAATACGGTGGCTTGTGTTTGGAGACTCAAGGCTTCCCAGATTCCGTCAATCACAAGAACTTTCCGTCGCAGATTGTTAATCCCGGCGAGAGTTATTTGCATGTTATGCTCTTCAGATTCACTGCTCACTAA

SEQ ID NO: 1799 - DNA, 1545 bp, Arabidopsis thaliana
  misc_feature (1)..(1545): Ceres cDNA ID no. 12688276
  misc_feature (1)..(1545): Also known as  Ceres CDNA ID no. 12683979
atggccacaagcgaagctctcaacctcgtcgacgacgaaaacgatggtgtctctgtgagagcattctgcgatttgaaggaaggagatgttgttgccaatatctcaaaaactgcttgtctcactatcaaaaccagtggagctcgtgagatgatcgaatctgctgatttagatggaagtttaggtctctctgtggctctcatgtacgagagaagcttaggtgaagaatctccttgggctggttatcttcagattcttcctattcaagaagatttgcctcttgtttggtctcttgaagacttagattctctcttatctggaactgagcttcataagttggtgaaggaagatcatgttcttatatatgaggattggaaagaaaacattttgccgcttacctcttcactgcctcagaatgttgattctgattcgtttggaatcaaagagtatcttgctgctaagagtttaattgcttcacggtctttcgaaatcgatgattaccatggatccgggatggttcctcttgcagacctctttaatcataaaactggggcagaagacgttcacttcactcatgaatccgattctgaagctgatgaatctgacaacgatgatgctgcaaatgagaccactgatgaagacgagccttccagtaaaatttcttcctcgcctgagcagtcttttgaggaagttcctggtgaaaacactgatgacgaagccaaagaagaagaagaagaagaagaagaagaagaagaaggagaagaagaagaagaaggagaagaggaagaagaaaactcttcaatgctgcaaaatgatcaatccggtctaaaaatgattatggtgaaggatgtctcagctggagctgaggtattcaatacatacggtttgatgggtaatgctgcattactccacaggtacggatttacagagctcgataatccatatgacatagtaaacatagatctagaattagtaaccgaatggagcacatcctcattcacaagccggtacactcgagctagactggccttgtggagaaaactaggttacacaggatgcgagagtcaaaactcagaatactttgaggtatcttcaaccggagaaccccaaaccgagctcctgatcctactctatatactgctcttaccagacgacacatacaataaactggatctagctgaatcaacaacaggagcttctccctcgaaagaaggaaaaagatcttcttcttacgagataacaattgggaaacacaagtttgtgtatggagaaagcggaaatgatattcttctgacagatggtgtttgtgaagctcttctaactattgtggataagcgagagagtttatatggatcattgagctcattggaagatgacattgttagggtgaagacttgttgtcttccgagagacaggagactatatcattcgcttgtgttgcgtgtgagtgagaggaagattctaaagaagcttaggagctacatccatacccagaccaatgagtcttccagcggaaagcgccggaagaagatggttccaaaatcctag

SEQ ID NO: 1800 - protein, 1545 aa, Arabidopsis thaliana
ATGGCCACAAGCGAAGCTCTCAACCTCGTCGACGACGAAAACGATGGTGTCTCTGTGAGAGCATTCTGCGATTTGAAGGAAGGAGATGTTGTTGCCAATATCTCAAAAACTGCTTGTCTCACTATCAAAACCAGTGGAGCTCGTGAGATGATCGAATCTGCTGATTTAGATGGAAGTTTAGGTCTCTCTGTGGCTCTCATGTACGAGAGAAGCTTAGGTGAAGAATCTCCTTGGGCTGGTTATCTTCAGATTCTTCCTATTCAAGAAGATTTGCCTCTTGTTTGGTCTCTTGAAGACTTAGATTCTCTCTTATCTGGAACTGAGCTTCATAAGTTGGTGAAGGAAGATCATGTTCTTATATATGAGGATTGGAAAGAAAACATTTTGCCGCTTACCTCTTCACTGCCTCAGAATGTTGATTCTGATTCGTTTGGAATCAAAGAGTATCTTGCTGCTAAGAGTTTAATTGCTTCACGGTCTTTCGAAATCGATGATTACCATGGATCCGGGATGGTTCCTCTTGCAGACCTCTTTAATCATAAAACTGGGGCAGAAGACGTTCACTTCACTCATGAATCCGATTCTGAAGCTGATGAATCTGACAACGATGATGCTGCAAATGAGACCACTGATGAAGACGAGCCTTCCAGTAAAATTTCTTCCTCGCCTGAGCAGTCTTTTGAGGAAGTTCCTGGTGAAAACACTGATGACGAAGCCAAAGAAGAAGAAGAAGAAGAAGAAGAAGAAGAAGAAGGAGAAGAAGAAGAAGAAGGAGAAGAGGAAGAAGAAAACTCTTCAATGCTGCAAAATGATCAATCCGGTCTAAAAATGATTATGGTGAAGGATGTCTCAGCTGGAGCTGAGGTATTCAATACATACGGTTTGATGGGTAATGCTGCATTACTCCACAGGTACGGATTTACAGAGCTCGATAATCCATATGACATAGTAAACATAGATCTAGAATTAGTAACCGAATGGAGCACATCCTCATTCACAAGCCGGTACACTCGAGCTAGACTGGCCTTGTGGAGAAAACTAGGTTACACAGGATGCGAGAGTCAAAACTCAGAATACTTTGAGGTATCTTCAACCGGAGAACCCCAAACCGAGCTCCTGATCCTACTCTATATACTGCTCTTACCAGACGACACATACAATAAACTGGATCTAGCTGAATCAACAACAGGAGCTTCTCCCTCGAAAGAAGGAAAAAGATCTTCTTCTTACGAGATAACAATTGGGAAACACAAGTTTGTGTATGGAGAAAGCGGAAATGATATTCTTCTGACAGATGGTGTTTGTGAAGCTCTTCTAACTATTGTGGATAAGCGAGAGAGTTTATATGGATCATTGAGCTCATTGGAAGATGACATTGTTAGGGTGAAGACTTGTTGTCTTCCGAGAGACAGGAGACTATATCATTCGCTTGTGTTGCGTGTGAGTGAGAGGAAGATTCTAAAGAAGCTTAGGAGCTACATCCATACCCAGACCAATGAGTCTTCCAGCGGAAAGCGCCGGAAGAAGATGGTTCCAAAATCCTAG

SEQ ID NO: 1801 - DNA, 1686 bp, Arabidopsis thaliana
  misc_feature (1)..(1686): Ceres cDNA ID no. 12690834
  misc_feature (1)..(1686): Also known as  Ceres CDNA ID no. 12683979
ctcctatttctctcttctctctctctttaagtgagcttcgccgttaaactttctccggtaccgggaaattaacgaagaaagcgaaaagtcactgttacactaatatcacaaatctctctctgtctctctctctctctttgtcgaagtcgtgcgtgatgctagttacggtggtgaagcagcggttagtgtactctcgccggagaaattggttatgaccggaatctcacctccgtgatcgaagaaactgttttcgtttttttatcgttacgaagaaatggaaaaacaggcgaagctaacgaggacacagtcgtcgttactccggtcatcgtcgaatctccgttcgtcatatcaaagcttatcttcaatcgtcgaaggcgagcaagatctagaagccggagagaaagaagagaaacagagaagaaaaccacctaaaccattcggttcaccaaatcctaaaaccggtttaaccagaatcaatcccggtttagctttcacaatggtatctctctctttcctaagtctctcatcgttcttcttcttcgtcgtcttctcacaaaccgatgagattctcacatcggagaatcttttactagctttaatcttcgtcgctgtagctctcttcttcgcttccaagaacatctctctactaaaccaaaccgtaatcgcaatcaaaaacttagggttccaaaacagagactcgaaatcaaaaccggtacaatggtacatcggagacgattcaaaaccggagaagaaggtaatcaagagattcgttaaagaaggagttcaattctacagtaatggagatttctacgaaggtgaatttaacaaagggaagtgtaacggaagtggtgtgtattactatttcgtgagaggacgttatgaaggagattggctagatgggagatatgatggtcatgggattgagagttgggctagaggaagtagatataaaggtcaatataggcaaggtcttagacatggttttggtgtttatagattctacactggtgattgttatgctggtgagtggtttaatggtcaaagccatggttttggtgttcaatcttgttctgatggtagctcttaccttggtgagtctagatttggtgttaagcatggtcttggttcttaccatttcagaaatggagataagtatgcaggagagtactttggagacaagattcatgggtttggtgtgtatcgatttgctaatggacactgttatgaaggagcatggcatgaaggtcgtaagcaagggtttggtgcttactcgtttagaaatggtgatgctaaatctggtgaatgggattcaggggttcttgtgacttcacttcctcttacgagtgagccagtttcaagagctgttcaggcggctcgagaaacagcgaataaggcagtgaatcggagacgagtagatgagcaggtgagccgagctgtggctgcagctaataaggctgctacggctgcaagagtggctgctgtgagagccgttcagaatcaaatggatggtaaattttgtcaaagttgaaaaaaggaaaatgtaaaaaatctttttttttaccggtttctctgtaaccctgaatcgaaagtttgtttcagaggtttgtaacagagagttaattttcgatctttttactaatgtaacaaaactgtaaatagttgaagaagaagctttgtttttgttgt

SEQ ID NO: 1802 - protein, 1686 aa, Arabidopsis thaliana
CTCCTATTTCTCTCTTCTCTCTCTCTTTAAGTGAGCTTCGCCGTTAAACTTTCTCCGGTACCGGGAAATTAACGAAGAAAGCGAAAAGTCACTGTTACACTAATATCACAAATCTCTCTCTGTCTCTCTCTCTCTCTTTGTCGAAGTCGTGCGTGATGCTAGTTACGGTGGTGAAGCAGCGGTTAGTGTACTCTCGCCGGAGAAATTGGTTATGACCGGAATCTCACCTCCGTGATCGAAGAAACTGTTTTCGTTTTTTTATCGTTACGAAGAAATGGAAAAACAGGCGAAGCTAACGAGGACACAGTCGTCGTTACTCCGGTCATCGTCGAATCTCCGTTCGTCATATCAAAGCTTATCTTCAATCGTCGAAGGCGAGCAAGATCTAGAAGCCGGAGAGAAAGAAGAGAAACAGAGAAGAAAACCACCTAAACCATTCGGTTCACCAAATCCTAAAACCGGTTTAACCAGAATCAATCCCGGTTTAGCTTTCACAATGGTATCTCTCTCTTTCCTAAGTCTCTCATCGTTCTTCTTCTTCGTCGTCTTCTCACAAACCGATGAGATTCTCACATCGGAGAATCTTTTACTAGCTTTAATCTTCGTCGCTGTAGCTCTCTTCTTCGCTTCCAAGAACATCTCTCTACTAAACCAAACCGTAATCGCAATCAAAAACTTAGGGTTCCAAAACAGAGACTCGAAATCAAAACCGGTACAATGGTACATCGGAGACGATTCAAAACCGGAGAAGAAGGTAATCAAGAGATTCGTTAAAGAAGGAGTTCAATTCTACAGTAATGGAGATTTCTACGAAGGTGAATTTAACAAAGGGAAGTGTAACGGAAGTGGTGTGTATTACTATTTCGTGAGAGGACGTTATGAAGGAGATTGGCTAGATGGGAGATATGATGGTCATGGGATTGAGAGTTGGGCTAGAGGAAGTAGATATAAAGGTCAATATAGGCAAGGTCTTAGACATGGTTTTGGTGTTTATAGATTCTACACTGGTGATTGTTATGCTGGTGAGTGGTTTAATGGTCAAAGCCATGGTTTTGGTGTTCAATCTTGTTCTGATGGTAGCTCTTACCTTGGTGAGTCTAGATTTGGTGTTAAGCATGGTCTTGGTTCTTACCATTTCAGAAATGGAGATAAGTATGCAGGAGAGTACTTTGGAGACAAGATTCATGGGTTTGGTGTGTATCGATTTGCTAATGGACACTGTTATGAAGGAGCATGGCATGAAGGTCGTAAGCAAGGGTTTGGTGCTTACTCGTTTAGAAATGGTGATGCTAAATCTGGTGAATGGGATTCAGGGGTTCTTGTGACTTCACTTCCTCTTACGAGTGAGCCAGTTTCAAGAGCTGTTCAGGCGGCTCGAGAAACAGCGAATAAGGCAGTGAATCGGAGACGAGTAGATGAGCAGGTGAGCCGAGCTGTGGCTGCAGCTAATAAGGCTGCTACGGCTGCAAGAGTGGCTGCTGTGAGAGCCGTTCAGAATCAAATGGATGGTAAATTTTGTCAAAGTTGAAAAAAGGAAAATGTAAAAAATCTTTTTTTTTACCGGTTTCTCTGTAACCCTGAATCGAAAGTTTGTTTCAGAGGTTTGTAACAGAGAGTTAATTTTCGATCTTTTTACTAATGTAACAAAACTGTAAATAGTTGAAGAAGAAGCTTTGTTTTTGTTGT

SEQ ID NO: 1803 - DNA, 1482 bp, Arabidopsis thaliana
  misc_feature (1)..(1482): Ceres cDNA ID no. 12690893
  misc_feature (1)..(1482): Also known as  Ceres CDNA ID no. 12683979
aacatcgtcatctctaacaatggcgccttctccgatcatcttctccgttcttcttctcttcatcttctcactctcatcatctgctcaaacacctttccgtcccaaagctctccttctcccagtaacaaaagaccaatctaccctccagtacacaaccgtcatcaaccaacgcacacctctcgtccccgcttccgtcgtcttcgacctcggtggtcgagaactctgggtcgactgcgacaaaggctacgtctcctccacttaccagtctcctcgctgcaactccgccgtctgctcacgtgccggctccacaagctgcggcacatgcttctcccctccgagacctggctgtagtaacaacacttgcggcggcattccggataacaccgttaccggtaccgcaacttccggcgaatttgctttagacgttgtgtctatccagtccactaacggatccaatccgggcagggtcgttaaaatcccaaatttgatcttcgattgtggagcaacgtttcttcttaaaggactcgctaaaggaaccgttggtatggcgggaatgggacgtcacaacatcggtttaccgtcgcaattcgccgccgcgtttagcttccaccgtaaattcgccgtctgtctaacttccggtaaaggcgtcgccttcttcggcaacggaccttacgttttccttcccggaatccagatctcaagtctccaaacgacgccccttctcatcaatccggtcagcactgcttctgcgttttcacaaggtgagaaatcctcagagtactttatcggcgtgacggcgattcaaatcgtcgagaaaacagttccgatcaatccaacgctattgaagattaacgcaagtaccggtatcggaggaaccaaaatcagctccgtcaatccttacacggtgttggagtcatcgatctacaatgcttttacgtcggagttcgttaaacaagcagcggcgaggagcatcaagagagtagcgtcggtgaaaccgttcggcgcgtgtttcagcacgaagaacgtcggcgtgacgcgcctaggatacgccgtgccggagattgagcttgtgcttcatagcaaagacgtcgtttggaggatatttggagccaactcgatggtgagtgtcagtgatgacgtcatctgtttgggtttcgttgacggaggagtcaacgcaagaacctctgttgtgattggagggtttcagttggaggataatttgatcgaatttgatttggcgagtaacaaatttgggtttagttccacgttattgggccgtcaaactaactgcgccaacttcaatttcacttccactgcttgattaaattagttgatccgttttctttttttaaaactgttttttagtggttattatattatgtttgatgtgattaataaagagccaatggaatcattatttggcatttgttatcaactgatttgaataaattatgtaacgagtgaattttatttgataaatct

SEQ ID NO: 1804 - protein, 1482 aa, Arabidopsis thaliana
AACATCGTCATCTCTAACAATGGCGCCTTCTCCGATCATCTTCTCCGTTCTTCTTCTCTTCATCTTCTCACTCTCATCATCTGCTCAAACACCTTTCCGTCCCAAAGCTCTCCTTCTCCCAGTAACAAAAGACCAATCTACCCTCCAGTACACAACCGTCATCAACCAACGCACACCTCTCGTCCCCGCTTCCGTCGTCTTCGACCTCGGTGGTCGAGAACTCTGGGTCGACTGCGACAAAGGCTACGTCTCCTCCACTTACCAGTCTCCTCGCTGCAACTCCGCCGTCTGCTCACGTGCCGGCTCCACAAGCTGCGGCACATGCTTCTCCCCTCCGAGACCTGGCTGTAGTAACAACACTTGCGGCGGCATTCCGGATAACACCGTTACCGGTACCGCAACTTCCGGCGAATTTGCTTTAGACGTTGTGTCTATCCAGTCCACTAACGGATCCAATCCGGGCAGGGTCGTTAAAATCCCAAATTTGATCTTCGATTGTGGAGCAACGTTTCTTCTTAAAGGACTCGCTAAAGGAACCGTTGGTATGGCGGGAATGGGACGTCACAACATCGGTTTACCGTCGCAATTCGCCGCCGCGTTTAGCTTCCACCGTAAATTCGCCGTCTGTCTAACTTCCGGTAAAGGCGTCGCCTTCTTCGGCAACGGACCTTACGTTTTCCTTCCCGGAATCCAGATCTCAAGTCTCCAAACGACGCCCCTTCTCATCAATCCGGTCAGCACTGCTTCTGCGTTTTCACAAGGTGAGAAATCCTCAGAGTACTTTATCGGCGTGACGGCGATTCAAATCGTCGAGAAAACAGTTCCGATCAATCCAACGCTATTGAAGATTAACGCAAGTACCGGTATCGGAGGAACCAAAATCAGCTCCGTCAATCCTTACACGGTGTTGGAGTCATCGATCTACAATGCTTTTACGTCGGAGTTCGTTAAACAAGCAGCGGCGAGGAGCATCAAGAGAGTAGCGTCGGTGAAACCGTTCGGCGCGTGTTTCAGCACGAAGAACGTCGGCGTGACGCGCCTAGGATACGCCGTGCCGGAGATTGAGCTTGTGCTTCATAGCAAAGACGTCGTTTGGAGGATATTTGGAGCCAACTCGATGGTGAGTGTCAGTGATGACGTCATCTGTTTGGGTTTCGTTGACGGAGGAGTCAACGCAAGAACCTCTGTTGTGATTGGAGGGTTTCAGTTGGAGGATAATTTGATCGAATTTGATTTGGCGAGTAACAAATTTGGGTTTAGTTCCACGTTATTGGGCCGTCAAACTAACTGCGCCAACTTCAATTTCACTTCCACTGCTTGATTAAATTAGTTGATCCGTTTTCTTTTTTTAAAACTGTTTTTTAGTGGTTATTATATTATGTTTGATGTGATTAATAAAGAGCCAATGGAATCATTATTTGGCATTTGTTATCAACTGATTTGAATAAATTATGTAACGAGTGAATTTTATTTGATAAATCT

SEQ ID NO: 1805 - DNA, 1042 bp, Arabidopsis thaliana
  misc_feature (1)..(1042): Ceres cDNA ID no. 12691021
actttgtaataataaccacaacttcccaatcttcttcatcagattttgctagttcgtcacacacacggatcatcgtcatcatcttctcttcttcttctccacaagcccacctacaatttccatttcgccgcttcctctgttcccacttacatcaattccgctcgatttcgaatttcgagctcaatcttccctttggatcgaagaagaagaagaagaatctggtctgtctctggctttaaatctatggccgatttggttaaaaccaatgctcgcagagacggtgaagatcgattccaagcgctcgagcaagaggctttcatcagtaattcgtcgtcggagctccagaacgagttggtatccgacgccggcgatggtattgaagcaatcgctaatcgtctggctgcatttttgtgaaatggcagagcaaatggattgtagcagctctgtttggatccgttctgcttctacgacatgatggtgcagctttgtgggctgtgattggatcggtttcaaattccgtgctctcagtagctttgaaacgtatacttaaccaagagagacctgttgctactctccgttctgatcctgggatgccttcttctcatgcccaatccatttctttcatctctgtgttttctgtcttctccgttatggagtggcttggaaccaatgtactctctctgttccttagcggcttcatcctcgcattgggttcttatttcacgtggttaagggtttctcagaagcttcacacgacaagtcaagtggtcgtaggtgcaatcgtgggttctgtttactccaccttatggtatgtaacttggaactctcttgttcttgaagcctttacctcaacattctcagtacaaatagctctctttctggttgctgctgcgtctgctttaggttttgcagtttatgtgctacttaactggtttaaagatgacagatgacagaatgataattatcagtacttaggatgtataaggaatgcatttgattctccttataattcatattgattgagctattttaacattcaatg

SEQ ID NO: 1806 - protein, 119 aa, Arabidopsis thaliana
  misc_feature: PFam Name: PAP2; PFam Description: PAP2 superfamily
  misc_feature: GI Number: 42565815; NR Description: phosphatidic acid
MPSSHAQSISFISVFSVFSVMEWLGTNVLSLFLSGFILALGSYFTWLRVSQKLHTTSQVVVGAIVGSVYSTLWYVTWNSLVLEAFTSTFSVQIALFLVAAASALGFAVYVLLNWFKDDR

SEQ ID NO: 1807 - DNA, 1056 bp, Arabidopsis thaliana
  misc_feature (1)..(1056): Ceres cDNA ID no. 12691552
  misc_feature (1)..(1056): Also known as  Ceres CDNA ID no. 12683979
gatgggtgataggaaacaaacacacatacgtcatcatcatccttaatttctatttctccttcttcttcatcatcaatatcaatctcatcttccactactcctcccctctaacaataagcagcatctctataatccctaagattcacaatggagcttggaggaaaatgcaatgcaattacaaccacaacaatgatctcaacagaagtaaagccacatacggatccggaaccagaagccaaacccgaatcagatccatccatggctttattcccgatcaagaaagaaaaccaaaaaccaaagacacgtgtcgaccaaggagctaagtaccgggaatgtcagaagaaccacgcggcctcaaccggaggacacgtggtggacggatgctgcgagttcatggccggcggagaagaaggtacactcggtgctttaaaatgcgccgcctgtaactgtcaccggagcttccaccggaaagaagtgtacggacacaggaacagtaaacaagatcatcagctgatgataactccggcgttttacagcagtaacagctcgtacaagccacgtgtaatgcatccaacgggtgagattggacggaggacttcatcttcaagcgaggatatgaagaagattctgagtcatcgtaaccaaaacgttgatgggaaaagtttgatgatgatgatgatgaggaagaagaagagagtgaggacaaagatcaatgaagaacaaaaggagaagatgaaggaatttgcagagagattagggtggaggatgcagaagaaagatgaagaagagattgataagttttgtaggatggtgaatctgaggagacaagtttttaaggtttggatgcataataacaagcaagcaatgaagagaaacaatagtaacattagtgaatagtttgatgatctgataaaagtgaaataaatttttacaatcctgttttgcttttatatataatttttgcccttcaaattattcaaaatcttgagtataaatctgtggaatcttgtatgttttgattgttttatattgtatctgggattatttttttctttt

SEQ ID NO: 1808 - protein, 1056 aa, Arabidopsis thaliana
GATGGGTGATAGGAAACAAACACACATACGTCATCATCATCCTTAATTTCTATTTCTCCTTCTTCTTCATCATCAATATCAATCTCATCTTCCACTACTCCTCCCCTCTAACAATAAGCAGCATCTCTATAATCCCTAAGATTCACAATGGAGCTTGGAGGAAAATGCAATGCAATTACAACCACAACAATGATCTCAACAGAAGTAAAGCCACATACGGATCCGGAACCAGAAGCCAAACCCGAATCAGATCCATCCATGGCTTTATTCCCGATCAAGAAAGAAAACCAAAAACCAAAGACACGTGTCGACCAAGGAGCTAAGTACCGGGAATGTCAGAAGAACCACGCGGCCTCAACCGGAGGACACGTGGTGGACGGATGCTGCGAGTTCATGGCCGGCGGAGAAGAAGGTACACTCGGTGCTTTAAAATGCGCCGCCTGTAACTGTCACCGGAGCTTCCACCGGAAAGAAGTGTACGGACACAGGAACAGTAAACAAGATCATCAGCTGATGATAACTCCGGCGTTTTACAGCAGTAACAGCTCGTACAAGCCACGTGTAATGCATCCAACGGGTGAGATTGGACGGAGGACTTCATCTTCAAGCGAGGATATGAAGAAGATTCTGAGTCATCGTAACCAAAACGTTGATGGGAAAAGTTTGATGATGATGATGATGAGGAAGAAGAAGAGAGTGAGGACAAAGATCAATGAAGAACAAAAGGAGAAGATGAAGGAATTTGCAGAGAGATTAGGGTGGAGGATGCAGAAGAAAGATGAAGAAGAGATTGATAAGTTTTGTAGGATGGTGAATCTGAGGAGACAAGTTTTTAAGGTTTGGATGCATAATAACAAGCAAGCAATGAAGAGAAACAATAGTAACATTAGTGAATAGTTTGATGATCTGATAAAAGTGAAATAAATTTTTACAATCCTGTTTTGCTTTTATATATAATTTTTGCCCTTCAAATTATTCAAAATCTTGAGTATAAATCTGTGGAATCTTGTATGTTTTGATTGTTTTATATTGTATCTGGGATTATTTTTTTCTTTT

SEQ ID NO: 1809 - DNA, 453 bp, Arabidopsis thaliana
  misc_feature (1)..(453): Ceres cDNA ID no. 12692289
  misc_feature (1)..(453): Also known as  Ceres CDNA ID no. 12683979
atggagtcatcacaagcaacgacgaagccaacgagaggagcaggaggaaggaaaggtggagataggaagaagagtgttagtaaatctgttaaagctggtcttcaatttcccgttggtcgtatcgctcgttacttgaagaaaggtcggtacgctctccgatacggttccggtgctccggtttacctcgccgccgttctcgaatacctagccgccgaggtacttgagctagctgggaacgcagcgagagataataagaagaacaggataaaccctaggcatctatgtttagcgataaggaacgatgaggaattggggagattgcttcatggagttactattgctagtggtggtgttcttccaaacattaatccagttcttcttcctaagaaatcaacagcttcttcttctcaagcggagaaagcttctgctaccaaatctcctaagaaggcttga

SEQ ID NO: 1810 - protein, 453 aa, Arabidopsis thaliana
ATGGAGTCATCACAAGCAACGACGAAGCCAACGAGAGGAGCAGGAGGAAGGAAAGGTGGAGATAGGAAGAAGAGTGTTAGTAAATCTGTTAAAGCTGGTCTTCAATTTCCCGTTGGTCGTATCGCTCGTTACTTGAAGAAAGGTCGGTACGCTCTCCGATACGGTTCCGGTGCTCCGGTTTACCTCGCCGCCGTTCTCGAATACCTAGCCGCCGAGGTACTTGAGCTAGCTGGGAACGCAGCGAGAGATAATAAGAAGAACAGGATAAACCCTAGGCATCTATGTTTAGCGATAAGGAACGATGAGGAATTGGGGAGATTGCTTCATGGAGTTACTATTGCTAGTGGTGGTGTTCTTCCAAACATTAATCCAGTTCTTCTTCCTAAGAAATCAACAGCTTCTTCTTCTCAAGCGGAGAAAGCTTCTGCTACCAAATCTCCTAAGAAGGCTTGA

SEQ ID NO: 1811 - DNA, 1316 bp, Arabidopsis thaliana
  misc_feature (1)..(1316): Ceres cDNA ID no. 12692494
  misc_feature (1)..(1316): Also known as  Ceres CDNA ID no. 12683979
aaacaaatttcaagttctttaaacgatttccttttcaagaaaaatccttctccttcttctttttaccacatagatcttcttgatctacaatggattctgtttctctttctgaggttactgtcattaaaggaacaacacatttgggttttatgcacagtttcagacagccattttgtggtgtcaaaatatctccaaagttctatttatccaaagttgatggaccaaaggcaatatcttcgagcagcaacacaaagagtcaatttgtttatggaggaggaagcatagctgcaacttcagattcaggttataagatgaatggagtaaacctaaaaagcagaacattgatgagttctgcagttaaagaaagatcattacttgatgcttatgatgatgagtatggtggagtaatagtagatcatggaaaattaccatcaaacccttatgctttcgcttctatgcttcgagcttctctatccgattggagaagaaagggaaagaaaggagtttggttaaagttacctgtggaacaatcagaattagtcccaatagctataaaggaaggttttgagtatcatcatgcagagaaaggatatgtaatgttaacatattggataccagaggaggaacctagtatgcttcctgcaaatgcttcacatcaagttggtgttggaggttttgtattaaatcaacataaagaggtgcttgtggtacaagaaaagtattgtgctccttcgattactggtctatggaagttaccaacagggtttattaatgaatctgaagagattttctctggtgctgtaagagaagtcaaggaagaaactggggtagatacagagttctcagaggttatagctttcagacatgctcacaacgttgcatttgagaaatctgatctgttcttcatctgtatgttgagaccactctctgataagataatcatcgatgctcttgagatcaaagccgcaaagtggatgccattggctgaatttgtggagcaaccgatgataagaggagacaaaatgtttaaaagagtgattgaaatatgcgaggcgagattaagccatcggtactgcggtctttctcctcatcgacttgtctctacttttgatggcaaaccttcttctctctattacaacgttgttgatgatgatcatgatccttcccactccaattgtagcactgagttttatagatagacgggtaaaacagaaccaaatcaagtggttcgattctgtatatacttattctcatgtaatgtatgttgttatttgatactctctcttcagtatagtaaatagtaatagatcctctgc

SEQ ID NO: 1812 - protein, 1316 aa, Arabidopsis thaliana
AAACAAATTTCAAGTTCTTTAAACGATTTCCTTTTCAAGAAAAATCCTTCTCCTTCTTCTTTTTACCACATAGATCTTCTTGATCTACAATGGATTCTGTTTCTCTTTCTGAGGTTACTGTCATTAAAGGAACAACACATTTGGGTTTTATGCACAGTTTCAGACAGCCATTTTGTGGTGTCAAAATATCTCCAAAGTTCTATTTATCCAAAGTTGATGGACCAAAGGCAATATCTTCGAGCAGCAACACAAAGAGTCAATTTGTTTATGGAGGAGGAAGCATAGCTGCAACTTCAGATTCAGGTTATAAGATGAATGGAGTAAACCTAAAAAGCAGAACATTGATGAGTTCTGCAGTTAAAGAAAGATCATTACTTGATGCTTATGATGATGAGTATGGTGGAGTAATAGTAGATCATGGAAAATTACCATCAAACCCTTATGCTTTCGCTTCTATGCTTCGAGCTTCTCTATCCGATTGGAGAAGAAAGGGAAAGAAAGGAGTTTGGTTAAAGTTACCTGTGGAACAATCAGAATTAGTCCCAATAGCTATAAAGGAAGGTTTTGAGTATCATCATGCAGAGAAAGGATATGTAATGTTAACATATTGGATACCAGAGGAGGAACCTAGTATGCTTCCTGCAAATGCTTCACATCAAGTTGGTGTTGGAGGTTTTGTATTAAATCAACATAAAGAGGTGCTTGTGGTACAAGAAAAGTATTGTGCTCCTTCGATTACTGGTCTATGGAAGTTACCAACAGGGTTTATTAATGAATCTGAAGAGATTTTCTCTGGTGCTGTAAGAGAAGTCAAGGAAGAAACTGGGGTAGATACAGAGTTCTCAGAGGTTATAGCTTTCAGACATGCTCACAACGTTGCATTTGAGAAATCTGATCTGTTCTTCATCTGTATGTTGAGACCACTCTCTGATAAGATAATCATCGATGCTCTTGAGATCAAAGCCGCAAAGTGGATGCCATTGGCTGAATTTGTGGAGCAACCGATGATAAGAGGAGACAAAATGTTTAAAAGAGTGATTGAAATATGCGAGGCGAGATTAAGCCATCGGTACTGCGGTCTTTCTCCTCATCGACTTGTCTCTACTTTTGATGGCAAACCTTCTTCTCTCTATTACAACGTTGTTGATGATGATCATGATCCTTCCCACTCCAATTGTAGCACTGAGTTTTATAGATAGACGGGTAAAACAGAACCAAATCAAGTGGTTCGATTCTGTATATACTTATTCTCATGTAATGTATGTTGTTATTTGATACTCTCTCTTCAGTATAGTAAATAGTAATAGATCCTCTGC

SEQ ID NO: 1813 - DNA, 1820 bp, Arabidopsis thaliana
  misc_feature (1)..(1820): Ceres cDNA ID no. 12692882
  misc_feature (1)..(1820): Also known as  Ceres CDNA ID no. 12683979
gtcttttggtgggtcttcgtcaaagctctctcctttacggtccttttctccagcgcatgaaataataaaggacacctgtatttattaaaatcactacattttccgtaacaaaaaaaatcaaactttgttttctcaatggacggtgccggagaatcacgactcggtggtgatggtggtggtgatggttctgttggagttcagatccgacaaacacggatgctaccggattttctccagagcgtgaatctcaagtatgtgaaattaggttaccattacttaatctcaaatctcttgactctctgtttattccctctcgccgttgttatctccgtcgaagcctctcagatgaacccagatgatctcaaacagctctggatccatctacaatacaatctggttagtatcatcatctgttcagcgattctagtcttcgggttaacggtttatgttatgacccgacctagacccgtttacttggttgatttctcttgttatctcccacctgatcatctcaaagctccttacgctcggttcatggaacattctagactcaccggagatttcgatgactctgctctcgagtttcaacgcaagatccttgagcgttctggtttaggggaagacacttatgtccctgaagctatgcattatgttccaccgagaatttcaatggctgctgctagagaagaagctgaacaagtcatgtttggtgctttagataaccttttcgctaacactaatgtgaaaccaaaggatattggaatccttgttgtgaattgtagtctctttaatccaactccttcgttatctgcaatgattgtgaacaagtataagcttagaggtaacattagaagctacaatctaggcggtatgggttgcagcgcgggagttatcgctgtggatcttgctaaagacatgttgttggtacataggaacacttatgcggttgttgtttctactgagaacattactcagaattggtattttggtaacaagaaatcgatgttgataccgaactgcttgtttcgagttggtggctctgcggttttgctatcgaacaagtcgagggacaagagacggtctaagtacaggcttgtacatgtagtcaggactcaccgtggagcagatgataaagctttccgttgtgtttatcaagagcaggatgatacagggagaaccggggtttcgttgtcgaaagatctaatggcgattgcaggggaaactctcaaaaccaatatcactacattgggtcctcttgttctaccgataagtgagcagattctcttctttatgactctagttgtgaagaagctctttaacggtaaagtgaaaccgtatatcccggatttcaaacttgctttcgagcatttctgtatccatgctggtggaagagctgtgatcgatgagttagagaagaatctgcagctttcaccagttcatgtcgaggcttcgaggatgactcttcatcgatttggtaacacatcttcgagctccatttggtatgaattggcttacattgaagcgaagggaaggatgcgaagaggtaatcgtgtttggcaaatcgcgttcggaagtggatttaaatgtaatagcgcgatttgggaagcattaaggcatgtgaaaccttcgaacaacagtccttgggaagattgtattgacaagtatccggtaactttaagttattagcttcgtttgaggaactgttattgtgtaacttcgagactaatccatggttgtttttttcttagagaagaaacccttagatttgatctctgacaatgtcaatgtgtttgttgtttatgtgttttggagagtttgtg

SEQ ID NO: 1814 - protein, 1820 aa, Arabidopsis thaliana
GTCTTTTGGTGGGTCTTCGTCAAAGCTCTCTCCTTTACGGTCCTTTTCTCCAGCGCATGAAATAATAAAGGACACCTGTATTTATTAAAATCACTACATTTTCCGTAACAAAAAAAATCAAACTTTGTTTTCTCAATGGACGGTGCCGGAGAATCACGACTCGGTGGTGATGGTGGTGGTGATGGTTCTGTTGGAGTTCAGATCCGACAAACACGGATGCTACCGGATTTTCTCCAGAGCGTGAATCTCAAGTATGTGAAATTAGGTTACCATTACTTAATCTCAAATCTCTTGACTCTCTGTTTATTCCCTCTCGCCGTTGTTATCTCCGTCGAAGCCTCTCAGATGAACCCAGATGATCTCAAACAGCTCTGGATCCATCTACAATACAATCTGGTTAGTATCATCATCTGTTCAGCGATTCTAGTCTTCGGGTTAACGGTTTATGTTATGACCCGACCTAGACCCGTTTACTTGGTTGATTTCTCTTGTTATCTCCCACCTGATCATCTCAAAGCTCCTTACGCTCGGTTCATGGAACATTCTAGACTCACCGGAGATTTCGATGACTCTGCTCTCGAGTTTCAACGCAAGATCCTTGAGCGTTCTGGTTTAGGGGAAGACACTTATGTCCCTGAAGCTATGCATTATGTTCCACCGAGAATTTCAATGGCTGCTGCTAGAGAAGAAGCTGAACAAGTCATGTTTGGTGCTTTAGATAACCTTTTCGCTAACACTAATGTGAAACCAAAGGATATTGGAATCCTTGTTGTGAATTGTAGTCTCTTTAATCCAACTCCTTCGTTATCTGCAATGATTGTGAACAAGTATAAGCTTAGAGGTAACATTAGAAGCTACAATCTAGGCGGTATGGGTTGCAGCGCGGGAGTTATCGCTGTGGATCTTGCTAAAGACATGTTGTTGGTACATAGGAACACTTATGCGGTTGTTGTTTCTACTGAGAACATTACTCAGAATTGGTATTTTGGTAACAAGAAATCGATGTTGATACCGAACTGCTTGTTTCGAGTTGGTGGCTCTGCGGTTTTGCTATCGAACAAGTCGAGGGACAAGAGACGGTCTAAGTACAGGCTTGTACATGTAGTCAGGACTCACCGTGGAGCAGATGATAAAGCTTTCCGTTGTGTTTATCAAGAGCAGGATGATACAGGGAGAACCGGGGTTTCGTTGTCGAAAGATCTAATGGCGATTGCAGGGGAAACTCTCAAAACCAATATCACTACATTGGGTCCTCTTGTTCTACCGATAAGTGAGCAGATTCTCTTCTTTATGACTCTAGTTGTGAAGAAGCTCTTTAACGGTAAAGTGAAACCGTATATCCCGGATTTCAAACTTGCTTTCGAGCATTTCTGTATCCATGCTGGTGGAAGAGCTGTGATCGATGAGTTAGAGAAGAATCTGCAGCTTTCACCAGTTCATGTCGAGGCTTCGAGGATGACTCTTCATCGATTTGGTAACACATCTTCGAGCTCCATTTGGTATGAATTGGCTTACATTGAAGCGAAGGGAAGGATGCGAAGAGGTAATCGTGTTTGGCAAATCGCGTTCGGAAGTGGATTTAAATGTAATAGCGCGATTTGGGAAGCATTAAGGCATGTGAAACCTTCGAACAACAGTCCTTGGGAAGATTGTATTGACAAGTATCCGGTAACTTTAAGTTATTAGCTTCGTTTGAGGAACTGTTATTGTGTAACTTCGAGACTAATCCATGGTTGTTTTTTTCTTAGAGAAGAAACCCTTAGATTTGATCTCTGACAATGTCAATGTGTTTGTTGTTTATGTGTTTTGGAGAGTTTGTG

SEQ ID NO: 1815 - DNA, 4659 bp, Arabidopsis thaliana
  misc_feature (1)..(4659): Ceres cDNA ID no. 12693224
  misc_feature (1)..(4659): Also known as  Ceres CDNA ID no. 12683979
atggatccgaggaattcgagtgcgtggggtgggggtgatggtctcccccttatctcatccatgggaggtgttgaatcaaagaatagatgctgtgtgactgacgacgatggctctattggtacgaagctatgtgagaaacctaaagctgaggagattgatttttctgctcggaaaaagaagttgaaatcgaagaaaggcgggtctgttagctttgctcttctcgatgttgaagatgacaaggaggaagcagaggatggagacgacaaaaatccttctattaggagtgatgaggtggttggagaaacttcaatgagtaagaaaaagaagaaggataagagtggcaagcatggggtatgtgaagaagatgatgatgcggacaagattcttgctcaacatgggataacaactactgtttcaacagggcctgaagcggagatagctctagctcaacctgagcaagttgcatctgcagatggggctgttgacaaggacggagaagaaaagactgttgagtcagctacagcgaagaaaaagaaaaagaagaaggacaaggacaagaaagcaagtgcttctttagctatttcttctgtggaggctaaggaggatagacaagggaagaaagatgtaaagattaaagtagcggaaaagaaagttcctaaacatgttcgagagaagcaagagactcttgcgcggtggaaagaagctgaagatgggaagaagaaggaagaagaagagagattgaggaaagaggaagaggagcgccgtatagaggaagagcgagaaagggaagctgaagagattaggcagaagagaaagatcaggaaaatggagaagaagcaagaaggcctgattctaacagcaaagcaaaagcgtgatgctgctaagaatgaggctttcagaaaaagggtgttgactgatgctggaagtcttcttgttgcagataaaaacggtgattcctcaaaacgtcccatatatggcaataaaaacaaattagcttgcaaaaaagcaaacgatcctgcttctgtccaggctaaaggtgatggggaaaccaaggaaaatcatgcagcagatgaaccatgtactttacctgacttggtttcagttgaagatagaagggttggtattatcgaatcagtagacacagaagagacacatgaatctgttgatgtatcacaagagaatggtgatgaggaagatgtgtgggatgcaaaaactaattttaccatcaagggtgattctgatgatgaggaggaaaaacctcagcctgtgttcaagaaaggtttaaaagacactgcatcaaaggcacatgattcagttcctggcgcagatagaccaacagtgaagcctggaggttctggcaagccaaaaacagctgccaaaaaagctatgcctaaggtggatgatactacccggccgaaagatacttctaaaaaggatgaaggcttagtactgaatgaacttgctaaagaagtagaagaaaatcttcgctctccaatttgctgcatcatgggtcatgttgattctggtaaaacaaagctgttggattgcatcagaggaacaaatgttcaggaaggtgaagctggaggtattactcaacagattggtgcaacctttttccctgcagaaaacatccgtgagaggaccaaagagttacaagctaatgctaaactcaaggtgccaggtatattggttatcgatacacctggacacgagtcattcacaaatctgcggtcaaggggttcaaatttgtgtgaccttgcaattctagtggttgatataatgcgaggtctagagccacaaaccatagaatctcttaatcttttgagaagaaggaatgtaaagttcattattgccttgaataaggtggataggctatatgggtgggaaaaaagcaagaatgctcctataaggaagacaatgatgcaacaaacgggagatgtggttaaggaatttaaaatgaggctaaaccgagttcaaaaccagttccaagaacaaggactcaacagtatgctttattacaagaacagagaaatgggagaaactatcagtatcctacctgctagcgctattagtggggaagggattccagatcttttactgttcttggttcaatgggctcagaaaacgatggtggagaaacttacatatgttgacaaagtgcagtgtaccgtccttgaggtcaaagttattgaaggccatggtattacagttgatgttgttttggtcaacggtgtactccgtgaaggtgatcaaattgttgtttgtgggtcacagggaccaattgtaacaactattagatcattgttgactccttatcctatgaacgagatgcgggtgacgggtacctatatgcctcacagagaagtaaaggctgcgcagggtatcaaaattgctgcacagggccttgaacacgccattgctggtactgccttgcatgtgattggacctaatgaggacatggaagaagccaagaaaaatgccatggaagatattgagtcagttatgaaccgcattgacaaaagtggtgaaggcgtttatgtacaagcatctacattagggtccttggaagcattgctcgagttcttgaagtcctcagatgtaaaaatacctgtcagtggtattggcataggacctgtgcataagaaggatatcatgaaggccggggtaatgctagagaagaaaaaagagtttgcaacgattttggcctttgatgtgaaaataagtgcagaagctcgtgaacttgcagacaaaatgggagtaaaaatcttctgcgatgataccatctattgtctgttcgataagtttaagagttacatagagggtatcaaagaggagaaaaagaaagaaacagcttgtgaagcagttttcccatgtatccttcagattttaccaaaccatatctacaatcagagggacccaattatccttggagttaaagtcaatgatggaatactaaaggttggaactcccatttgcattgttaaaaggattgagaatgtaagagtgtttatggacattgggcgcgtctcatcaattaagaataacaacaacatgccagttgattatgcaaggaaaggacaggaggtggctattaagatcattgcttctaacccagaagaacagaaaatgtttgggaggcactttggtgtagacgacaggcttatcagtcacatttctagtcgatccgtggacgtaatcagaactaattactggagaaataaaggacctattcacagattcagacaacatcgtcgcattttgattttgaatcgattattttacctacactcgtgtatgagccagtcctccggaataagacaacatctccaggagtctctacgaaattcttcggctctcaaaggtattcacgacggtcttttagctctattctctattgagaacctgatttttccggtgaattttgattattgcaaagttggagaatttttgagatttagaagagatactggcttaggattcgtattcatgtcgagcttattacactgtagaaatgtcgtagattgtgcgtttacttcttccactgttcgtcgcattgtcaatttagggtttttagtgggtagaataagaacgttgtgttcagtgtcacaagtgaaatcagagaatctcgaaaagcaaaaaccatgtttggaatcttttacagtttcttatctcgtggattcttgtggactgtctttggaatctgctaaatcgaattccagattcgtcaaattggtttcgtccaagaaaccagactctgttcttgctctcttcaaggaccatggcttcaccaatgaccagatcaccagtgtcatcaaatcctttcctcgtgttctgtcactgagcccggaagatgtaatctcgcccaagctcatgtttttcagttctatcgggttttcgacctcggatactgcgaaaatgatctcttcttccccgaaaatgctatcatatagcttgcacaaaagattgatcccttgctatgattccctcaagagcatactcgttgaggaagaaagtgttgtcaagtgtctcaagcgtggaatcagatgtttctcattgaagattacacattgtgtgtctcttcgtgtctccatttgtagagagcttggagttcctgacaaaagcatcaagtggttggttcaagcgtctccattcacttttttctctcgtgagagaagattcaacgaggtcttaaacagagtttgcagctacggttttgacccgaaaaaggcgggttttgttcacgctatggtagcctttgattgcacgagtgaatcagcaatggagcggaaatttaagttgttccaatgttttggttggtctaaagaagatttcgtcgcagcgatcatgagattcccaaactgtgtgacggtttcagatgagaagataatgtacacattggagtaccttgtaaacaacattggtctgcaagctcgtgacattgttgcaagaccggtggtgttatctctgagcatggagaagagaatcaaaccgaggaaccaggtcatctctttgcttctctccaaaggacttgtgaagaaggaagacatcaactatttcactatactaaagctgaaaagctccgagttcatggataagtttgtgctgaaatatcaggatgagatgccacaacttgtacaaccctttacaagtaatcgatga

SEQ ID NO: 1816 - protein, 4659 aa, Arabidopsis thaliana
ATGGATCCGAGGAATTCGAGTGCGTGGGGTGGGGGTGATGGTCTCCCCCTTATCTCATCCATGGGAGGTGTTGAATCAAAGAATAGATGCTGTGTGACTGACGACGATGGCTCTATTGGTACGAAGCTATGTGAGAAACCTAAAGCTGAGGAGATTGATTTTTCTGCTCGGAAAAAGAAGTTGAAATCGAAGAAAGGCGGGTCTGTTAGCTTTGCTCTTCTCGATGTTGAAGATGACAAGGAGGAAGCAGAGGATGGAGACGACAAAAATCCTTCTATTAGGAGTGATGAGGTGGTTGGAGAAACTTCAATGAGTAAGAAAAAGAAGAAGGATAAGAGTGGCAAGCATGGGGTATGTGAAGAAGATGATGATGCGGACAAGATTCTTGCTCAACATGGGATAACAACTACTGTTTCAACAGGGCCTGAAGCGGAGATAGCTCTAGCTCAACCTGAGCAAGTTGCATCTGCAGATGGGGCTGTTGACAAGGACGGAGAAGAAAAGACTGTTGAGTCAGCTACAGCGAAGAAAAAGAAAAAGAAGAAGGACAAGGACAAGAAAGCAAGTGCTTCTTTAGCTATTTCTTCTGTGGAGGCTAAGGAGGATAGACAAGGGAAGAAAGATGTAAAGATTAAAGTAGCGGAAAAGAAAGTTCCTAAACATGTTCGAGAGAAGCAAGAGACTCTTGCGCGGTGGAAAGAAGCTGAAGATGGGAAGAAGAAGGAAGAAGAAGAGAGATTGAGGAAAGAGGAAGAGGAGCGCCGTATAGAGGAAGAGCGAGAAAGGGAAGCTGAAGAGATTAGGCAGAAGAGAAAGATCAGGAAAATGGAGAAGAAGCAAGAAGGCCTGATTCTAACAGCAAAGCAAAAGCGTGATGCTGCTAAGAATGAGGCTTTCAGAAAAAGGGTGTTGACTGATGCTGGAAGTCTTCTTGTTGCAGATAAAAACGGTGATTCCTCAAAACGTCCCATATATGGCAATAAAAACAAATTAGCTTGCAAAAAAGCAAACGATCCTGCTTCTGTCCAGGCTAAAGGTGATGGGGAAACCAAGGAAAATCATGCAGCAGATGAACCATGTACTTTACCTGACTTGGTTTCAGTTGAAGATAGAAGGGTTGGTATTATCGAATCAGTAGACACAGAAGAGACACATGAATCTGTTGATGTATCACAAGAGAATGGTGATGAGGAAGATGTGTGGGATGCAAAAACTAATTTTACCATCAAGGGTGATTCTGATGATGAGGAGGAAAAACCTCAGCCTGTGTTCAAGAAAGGTTTAAAAGACACTGCATCAAAGGCACATGATTCAGTTCCTGGCGCAGATAGACCAACAGTGAAGCCTGGAGGTTCTGGCAAGCCAAAAACAGCTGCCAAAAAAGCTATGCCTAAGGTGGATGATACTACCCGGCCGAAAGATACTTCTAAAAAGGATGAAGGCTTAGTACTGAATGAACTTGCTAAAGAAGTAGAAGAAAATCTTCGCTCTCCAATTTGCTGCATCATGGGTCATGTTGATTCTGGTAAAACAAAGCTGTTGGATTGCATCAGAGGAACAAATGTTCAGGAAGGTGAAGCTGGAGGTATTACTCAACAGATTGGTGCAACCTTTTTCCCTGCAGAAAACATCCGTGAGAGGACCAAAGAGTTACAAGCTAATGCTAAACTCAAGGTGCCAGGTATATTGGTTATCGATACACCTGGACACGAGTCATTCACAAATCTGCGGTCAAGGGGTTCAAATTTGTGTGACCTTGCAATTCTAGTGGTTGATATAATGCGAGGTCTAGAGCCACAAACCATAGAATCTCTTAATCTTTTGAGAAGAAGGAATGTAAAGTTCATTATTGCCTTGAATAAGGTGGATAGGCTATATGGGTGGGAAAAAAGCAAGAATGCTCCTATAAGGAAGACAATGATGCAACAAACGGGAGATGTGGTTAAGGAATTTAAAATGAGGCTAAACCGAGTTCAAAACCAGTTCCAAGAACAAGGACTCAACAGTATGCTTTATTACAAGAACAGAGAAATGGGAGAAACTATCAGTATCCTACCTGCTAGCGCTATTAGTGGGGAAGGGATTCCAGATCTTTTACTGTTCTTGGTTCAATGGGCTCAGAAAACGATGGTGGAGAAACTTACATATGTTGACAAAGTGCAGTGTACCGTCCTTGAGGTCAAAGTTATTGAAGGCCATGGTATTACAGTTGATGTTGTTTTGGTCAACGGTGTACTCCGTGAAGGTGATCAAATTGTTGTTTGTGGGTCACAGGGACCAATTGTAACAACTATTAGATCATTGTTGACTCCTTATCCTATGAACGAGATGCGGGTGACGGGTACCTATATGCCTCACAGAGAAGTAAAGGCTGCGCAGGGTATCAAAATTGCTGCACAGGGCCTTGAACACGCCATTGCTGGTACTGCCTTGCATGTGATTGGACCTAATGAGGACATGGAAGAAGCCAAGAAAAATGCCATGGAAGATATTGAGTCAGTTATGAACCGCATTGACAAAAGTGGTGAAGGCGTTTATGTACAAGCATCTACATTAGGGTCCTTGGAAGCATTGCTCGAGTTCTTGAAGTCCTCAGATGTAAAAATACCTGTCAGTGGTATTGGCATAGGACCTGTGCATAAGAAGGATATCATGAAGGCCGGGGTAATGCTAGAGAAGAAAAAAGAGTTTGCAACGATTTTGGCCTTTGATGTGAAAATAAGTGCAGAAGCTCGTGAACTTGCAGACAAAATGGGAGTAAAAATCTTCTGCGATGATACCATCTATTGTCTGTTCGATAAGTTTAAGAGTTACATAGAGGGTATCAAAGAGGAGAAAAAGAAAGAAACAGCTTGTGAAGCAGTTTTCCCATGTATCCTTCAGATTTTACCAAACCATATCTACAATCAGAGGGACCCAATTATCCTTGGAGTTAAAGTCAATGATGGAATACTAAAGGTTGGAACTCCCATTTGCATTGTTAAAAGGATTGAGAATGTAAGAGTGTTTATGGACATTGGGCGCGTCTCATCAATTAAGAATAACAACAACATGCCAGTTGATTATGCAAGGAAAGGACAGGAGGTGGCTATTAAGATCATTGCTTCTAACCCAGAAGAACAGAAAATGTTTGGGAGGCACTTTGGTGTAGACGACAGGCTTATCAGTCACATTTCTAGTCGATCCGTGGACGTAATCAGAACTAATTACTGGAGAAATAAAGGACCTATTCACAGATTCAGACAACATCGTCGCATTTTGATTTTGAATCGATTATTTTACCTACACTCGTGTATGAGCCAGTCCTCCGGAATAAGACAACATCTCCAGGAGTCTCTACGAAATTCTTCGGCTCTCAAAGGTATTCACGACGGTCTTTTAGCTCTATTCTCTATTGAGAACCTGATTTTTCCGGTGAATTTTGATTATTGCAAAGTTGGAGAATTTTTGAGATTTAGAAGAGATACTGGCTTAGGATTCGTATTCATGTCGAGCTTATTACACTGTAGAAATGTCGTAGATTGTGCGTTTACTTCTTCCACTGTTCGTCGCATTGTCAATTTAGGGTTTTTAGTGGGTAGAATAAGAACGTTGTGTTCAGTGTCACAAGTGAAATCAGAGAATCTCGAAAAGCAAAAACCATGTTTGGAATCTTTTACAGTTTCTTATCTCGTGGATTCTTGTGGACTGTCTTTGGAATCTGCTAAATCGAATTCCAGATTCGTCAAATTGGTTTCGTCCAAGAAACCAGACTCTGTTCTTGCTCTCTTCAAGGACCATGGCTTCACCAATGACCAGATCACCAGTGTCATCAAATCCTTTCCTCGTGTTCTGTCACTGAGCCCGGAAGATGTAATCTCGCCCAAGCTCATGTTTTTCAGTTCTATCGGGTTTTCGACCTCGGATACTGCGAAAATGATCTCTTCTTCCCCGAAAATGCTATCATATAGCTTGCACAAAAGATTGATCCCTTGCTATGATTCCCTCAAGAGCATACTCGTTGAGGAAGAAAGTGTTGTCAAGTGTCTCAAGCGTGGAATCAGATGTTTCTCATTGAAGATTACACATTGTGTGTCTCTTCGTGTCTCCATTTGTAGAGAGCTTGGAGTTCCTGACAAAAGCATCAAGTGGTTGGTTCAAGCGTCTCCATTCACTTTTTTCTCTCGTGAGAGAAGATTCAACGAGGTCTTAAACAGAGTTTGCAGCTACGGTTTTGACCCGAAAAAGGCGGGTTTTGTTCACGCTATGGTAGCCTTTGATTGCACGAGTGAATCAGCAATGGAGCGGAAATTTAAGTTGTTCCAATGTTTTGGTTGGTCTAAAGAAGATTTCGTCGCAGCGATCATGAGATTCCCAAACTGTGTGACGGTTTCAGATGAGAAGATAATGTACACATTGGAGTACCTTGTAAACAACATTGGTCTGCAAGCTCGTGACATTGTTGCAAGACCGGTGGTGTTATCTCTGAGCATGGAGAAGAGAATCAAACCGAGGAACCAGGTCATCTCTTTGCTTCTCTCCAAAGGACTTGTGAAGAAGGAAGACATCAACTATTTCACTATACTAAAGCTGAAAAGCTCCGAGTTCATGGATAAGTTTGTGCTGAAATATCAGGATGAGATGCCACAACTTGTACAACCCTTTACAAGTAATCGATGA

SEQ ID NO: 1817 - DNA, 891 bp, Arabidopsis thaliana
  misc_feature (1)..(891): Ceres cDNA ID no. 12693608
  misc_feature (1)..(891): Also known as  Ceres CDNA ID no. 12683979
atgaacacgtcagaggtgagagtacctcgaggaaatcgacggaggaaagctgtgattgatctgaatgcggtacctgttgatcaagaagggacctctgcttctgttagaactcttacggtgcctattacaccgtctcagcctgctcctacgatgattgatgtcgatgctattgaggatgatgttattgaatcatccgctagtgcttttgctgaagctaaaagcaaatcaagaaatgcacgtcggagacctttgatggttgatgtagagtcaggaggtacgactagattccctgccaacataagcaacaaacgcagaaggattccttctagtgaatctgtcatcgactgtgagcatgcctctgtaaatgatgaagtcaacatgtcttcgagagtgtctagatcaaaggctccagctcctccaccagaagagccaaagtttacatgtccaatctgcatgtgtccctttacggaggagatgtcaaccaagtgcggtcacatcttctgcaagggatgtataaagatggcaatatctcgccagggcaaatgccctacttgtaggaaaaaggttactgcaaaagagctgattcgagttttccttccaaccactagatgagtggtccggcaacatcaccagccaccctgtctaatggtttatcagactatcctcctattcactttggaacattgaagggacttcgttgacttggtatttttgaatattttgctttgttggaagagaaatattcagtgatcaagaagccagaaggccctatcattcgatggatatcattggtaataactctttgtttttagttgttgttctatgtaatttaggtctctgcaaacctctcagtcgatactcttctctcttgatagatgataagatatatgg

SEQ ID NO: 1818 - protein, 891 aa, Arabidopsis thaliana
ATGAACACGTCAGAGGTGAGAGTACCTCGAGGAAATCGACGGAGGAAAGCTGTGATTGATCTGAATGCGGTACCTGTTGATCAAGAAGGGACCTCTGCTTCTGTTAGAACTCTTACGGTGCCTATTACACCGTCTCAGCCTGCTCCTACGATGATTGATGTCGATGCTATTGAGGATGATGTTATTGAATCATCCGCTAGTGCTTTTGCTGAAGCTAAAAGCAAATCAAGAAATGCACGTCGGAGACCTTTGATGGTTGATGTAGAGTCAGGAGGTACGACTAGATTCCCTGCCAACATAAGCAACAAACGCAGAAGGATTCCTTCTAGTGAATCTGTCATCGACTGTGAGCATGCCTCTGTAAATGATGAAGTCAACATGTCTTCGAGAGTGTCTAGATCAAAGGCTCCAGCTCCTCCACCAGAAGAGCCAAAGTTTACATGTCCAATCTGCATGTGTCCCTTTACGGAGGAGATGTCAACCAAGTGCGGTCACATCTTCTGCAAGGGATGTATAAAGATGGCAATATCTCGCCAGGGCAAATGCCCTACTTGTAGGAAAAAGGTTACTGCAAAAGAGCTGATTCGAGTTTTCCTTCCAACCACTAGATGAGTGGTCCGGCAACATCACCAGCCACCCTGTCTAATGGTTTATCAGACTATCCTCCTATTCACTTTGGAACATTGAAGGGACTTCGTTGACTTGGTATTTTTGAATATTTTGCTTTGTTGGAAGAGAAATATTCAGTGATCAAGAAGCCAGAAGGCCCTATCATTCGATGGATATCATTGGTAATAACTCTTTGTTTTTAGTTGTTGTTCTATGTAATTTAGGTCTCTGCAAACCTCTCAGTCGATACTCTTCTCTCTTGATAGATGATAAGATATATGG

SEQ ID NO: 1819 - DNA, 792 bp, Arabidopsis thaliana
  misc_feature (1)..(792): Ceres cDNA ID no. 12694236
  misc_feature (1)..(792): Also known as  Ceres CDNA ID no. 12683979
gtcaggggacgttaataggatttgcttcgttctcagaaaaagggttggtggatcaagtgagatcggcggcgatgttgagtcccgttgcttatctcagccacatgaccaccgtcatcggcgatatcgccgcaaaaaccttcctcgccgaggccacctctattcttggatggccagagtttaacccgaaaagtggattagtaggggattttataaaggctatatgccttaaagcggggatcgactgttatgatttagtctctgttatcactggaaagaattgctgccttaacgcatcaaccattgatctgttccttgccaacgaacctcaatctacttccaccaagaacatgatccaccttgctcaaacggtaagagacaaggagttgagaaaatacaactatggaagcagtgatcgcaacataaaacattacggtcaagcgataccaccggcatacaacatatcggcgatcccacacgagcttccgctttttttcagctacggtggtttagatagcctggctgatgtgaaagacgttgagtttctccttgaccagtttaagtatcacgacatcgataagatgaatgtgcagtttgtgaaagactatgctcatgctgatttcatcatgggtgttactgccaaagacgttgtttataaccaagttgctacctttttcaaacgacaagcttgataatattattaccttgtcattagtttatgtaattgcatgtgcccatattcttcaattgtttccctctaaacaaaatgggcaaaaataaaattaaaatttttat

SEQ ID NO: 1820 - protein, 792 aa, Arabidopsis thaliana
GTCAGGGGACGTTAATAGGATTTGCTTCGTTCTCAGAAAAAGGGTTGGTGGATCAAGTGAGATCGGCGGCGATGTTGAGTCCCGTTGCTTATCTCAGCCACATGACCACCGTCATCGGCGATATCGCCGCAAAAACCTTCCTCGCCGAGGCCACCTCTATTCTTGGATGGCCAGAGTTTAACCCGAAAAGTGGATTAGTAGGGGATTTTATAAAGGCTATATGCCTTAAAGCGGGGATCGACTGTTATGATTTAGTCTCTGTTATCACTGGAAAGAATTGCTGCCTTAACGCATCAACCATTGATCTGTTCCTTGCCAACGAACCTCAATCTACTTCCACCAAGAACATGATCCACCTTGCTCAAACGGTAAGAGACAAGGAGTTGAGAAAATACAACTATGGAAGCAGTGATCGCAACATAAAACATTACGGTCAAGCGATACCACCGGCATACAACATATCGGCGATCCCACACGAGCTTCCGCTTTTTTTCAGCTACGGTGGTTTAGATAGCCTGGCTGATGTGAAAGACGTTGAGTTTCTCCTTGACCAGTTTAAGTATCACGACATCGATAAGATGAATGTGCAGTTTGTGAAAGACTATGCTCATGCTGATTTCATCATGGGTGTTACTGCCAAAGACGTTGTTTATAACCAAGTTGCTACCTTTTTCAAACGACAAGCTTGATAATATTATTACCTTGTCATTAGTTTATGTAATTGCATGTGCCCATATTCTTCAATTGTTTCCCTCTAAACAAAATGGGCAAAAATAAAATTAAAATTTTTAT

SEQ ID NO: 1821 - DNA, 1329 bp, Arabidopsis thaliana
  misc_feature (1)..(1329): Ceres cDNA ID no. 12694329
  misc_feature (1)..(1329): Also known as  Ceres CDNA ID no. 12683979
atgaagagcgtatcaacctgggctttgtctttcttctccgacgaactttctcggcgagctgtttccgattgttatttatggaccaccgcgatttcgcttctcttaatccttctccttcatatcttcttttccactaaatttcgcttcttcacttctgctccttcttcttcttcttcttcttcttcttcttcctctccctctacagaatcagttcccgcgaactctcaatcaaggatatccaaactagtctctgatgaagatttgaaatttctgatcgagaatttggaggaggaaacaaatgattccacggagatatgggaacatgttattcacaaaagcaacgatcgcatttcatactctgctaaacgctgcaaacccaaagatggcggtggtcctatgaagtacctaagtgtcacggtcttcgagggtttctctgcagagattgtgagggacttttacatggacaatgattataggaaactatgggataagactgtggttgagcatgagcagttgcaggttgatagtaatactggaattgagattggtcgcaccattaaaaagtttcccttgttgacatcgagagagtacgttctagcttggagattgtggcaaggaaaggagaagaagttctactgtttcacaaaggtcaaattcaaccaaaaaacctctctctccctctatctgtcgcaatttgaatgtgatcacaatatggtaccacaacagaggaagtatgtacgtgtaagttactttagatctggttggcgaatcaggcaagtttctgttgtcagcattctttctacctttgatacttatctgactgatacctttgacacacttgctgcagttcccggtagaaatgcgtgtgagatcaaaatgtttcaccaggagaatgctgggttaaatgttgagatggccaagctcgccttctcaaaaggcatatggagttacgtttgtaagatggaaaacgctctttgtaaatacatagcaaccagtcatagaacccaaggacccattctatctgctgtcaccttaatgaaagaggttccatcagagttagaaactgggacagataatgtcacaggctccatggaaacaagtagtggtgaaggagtgttgagtcatgttgtagccgccaaacagaagaaaaaaatgagaaagccatcaacgaaactgatagcaaaaggtctagtacttgtgggcggtgcgatctgcttgtcccgtggtccctcagccttaggtgctaaagtcgcattggcttacctcttgacgaagctgaacaaacgtggaacttctctgaatcagaccacccagaccaccaccatttaa

SEQ ID NO: 1822 - protein, 1329 aa, Arabidopsis thaliana
ATGAAGAGCGTATCAACCTGGGCTTTGTCTTTCTTCTCCGACGAACTTTCTCGGCGAGCTGTTTCCGATTGTTATTTATGGACCACCGCGATTTCGCTTCTCTTAATCCTTCTCCTTCATATCTTCTTTTCCACTAAATTTCGCTTCTTCACTTCTGCTCCTTCTTCTTCTTCTTCTTCTTCTTCTTCTTCCTCTCCCTCTACAGAATCAGTTCCCGCGAACTCTCAATCAAGGATATCCAAACTAGTCTCTGATGAAGATTTGAAATTTCTGATCGAGAATTTGGAGGAGGAAACAAATGATTCCACGGAGATATGGGAACATGTTATTCACAAAAGCAACGATCGCATTTCATACTCTGCTAAACGCTGCAAACCCAAAGATGGCGGTGGTCCTATGAAGTACCTAAGTGTCACGGTCTTCGAGGGTTTCTCTGCAGAGATTGTGAGGGACTTTTACATGGACAATGATTATAGGAAACTATGGGATAAGACTGTGGTTGAGCATGAGCAGTTGCAGGTTGATAGTAATACTGGAATTGAGATTGGTCGCACCATTAAAAAGTTTCCCTTGTTGACATCGAGAGAGTACGTTCTAGCTTGGAGATTGTGGCAAGGAAAGGAGAAGAAGTTCTACTGTTTCACAAAGGTCAAATTCAACCAAAAAACCTCTCTCTCCCTCTATCTGTCGCAATTTGAATGTGATCACAATATGGTACCACAACAGAGGAAGTATGTACGTGTAAGTTACTTTAGATCTGGTTGGCGAATCAGGCAAGTTTCTGTTGTCAGCATTCTTTCTACCTTTGATACTTATCTGACTGATACCTTTGACACACTTGCTGCAGTTCCCGGTAGAAATGCGTGTGAGATCAAAATGTTTCACCAGGAGAATGCTGGGTTAAATGTTGAGATGGCCAAGCTCGCCTTCTCAAAAGGCATATGGAGTTACGTTTGTAAGATGGAAAACGCTCTTTGTAAATACATAGCAACCAGTCATAGAACCCAAGGACCCATTCTATCTGCTGTCACCTTAATGAAAGAGGTTCCATCAGAGTTAGAAACTGGGACAGATAATGTCACAGGCTCCATGGAAACAAGTAGTGGTGAAGGAGTGTTGAGTCATGTTGTAGCCGCCAAACAGAAGAAAAAAATGAGAAAGCCATCAACGAAACTGATAGCAAAAGGTCTAGTACTTGTGGGCGGTGCGATCTGCTTGTCCCGTGGTCCCTCAGCCTTAGGTGCTAAAGTCGCATTGGCTTACCTCTTGACGAAGCTGAACAAACGTGGAACTTCTCTGAATCAGACCACCCAGACCACCACCATTTAA

SEQ ID NO: 1823 - DNA, 1565 bp, Arabidopsis thaliana
  misc_feature (1)..(1565): Ceres cDNA ID no. 12695205
  misc_feature (1)..(1565): Also known as  Ceres CDNA ID no. 12683979
gcatcgcctgtttttataatttctcgtcttgtacaaaataaaagactctctctctcttaaaatttctctttcgattctctcgcatttcaaaatttcatttccttatatagactcttaaggccggcgatttctgtgagtccatagattttcgctactccgccgtcagtttttctcaactccggaggctgtgtttttgccaccgctttgattcgccggtaagttcacgtatggccagtaatactttgaaagagatgaatagtcttcatgtaactgagaagataagtgactgtaaagctagcttgaccaagccatgtgttggtaaaatgaatggaaaatctgaagatagaccattaccaaactctgcctccttggattccagtgattctaaagttgtagaagcagagaaacccgagccagagatagctattgtggaagttgaatatattgaatctgaaaacttggataatgtagacgatgctgatgcagttctgaagtctgttttagctggactagagtccaaggactggatttcactctgtgatgctcttaataacgttcgccgactttcgatattccacaaggaagaaatgatgcatatgcttgaaaaagtgataccacttgtcgtgaaatcactgaaaaatccaagaagtgcggtgtgtaaaacggcatgcatgacatctgcagatatcttcagtgcatataataatcatataacagatctgttggagcctctgcttactcaactactcctcaagtcttcccaagacaaacggtttgtttgcgaggcagcagagaaagctttaacagcaatgaccaaatatgtttccccaaccttgctgttaccaaagctgcaaccttgtctcaaaaacaggaatcctcggatccgtgccaaagcatcattatgcttttctcgaagtgttcctcgactgggcgttgaagggattaaagaatatggaatcgacaaattagttcaagcagccgcatctcagcttagcgatcagctccctgaatcccgtgaggctgcacggactgtcctactagaacttcagagcgtatatgaaaaagctcatcctctcatcaaccctgagacatcatcaccagaagaacagcaaatcccggaggtagagccaattacttgggaaactttctgcaagtcaaaactgtcggctcttagcgcacaagccgtgcttcgtgtcaccaatgttgtcactgttactgctcgggagggtttggttactacaggttcatcatcttcatcccagttataaacattttctactacaaattttttaaaaaccgtttgctacgagtcatacggtttacatggtattctccggcatggcggcatgatctaccaaattggcaaattatggaccgataaaaagagtgaacgttcgtgtatgaaaaatcttggcttctttctgggttattttctttttgtggattctcatctgtcttcactaccagtacttgtttctttttcttatgtgtatatattctataccaagatttggtaagatagtcatgagtcttttggttatatgcaaaattggtcggattctttg

SEQ ID NO: 1824 - protein, 1565 aa, Arabidopsis thaliana
GCATCGCCTGTTTTTATAATTTCTCGTCTTGTACAAAATAAAAGACTCTCTCTCTCTTAAAATTTCTCTTTCGATTCTCTCGCATTTCAAAATTTCATTTCCTTATATAGACTCTTAAGGCCGGCGATTTCTGTGAGTCCATAGATTTTCGCTACTCCGCCGTCAGTTTTTCTCAACTCCGGAGGCTGTGTTTTTGCCACCGCTTTGATTCGCCGGTAAGTTCACGTATGGCCAGTAATACTTTGAAAGAGATGAATAGTCTTCATGTAACTGAGAAGATAAGTGACTGTAAAGCTAGCTTGACCAAGCCATGTGTTGGTAAAATGAATGGAAAATCTGAAGATAGACCATTACCAAACTCTGCCTCCTTGGATTCCAGTGATTCTAAAGTTGTAGAAGCAGAGAAACCCGAGCCAGAGATAGCTATTGTGGAAGTTGAATATATTGAATCTGAAAACTTGGATAATGTAGACGATGCTGATGCAGTTCTGAAGTCTGTTTTAGCTGGACTAGAGTCCAAGGACTGGATTTCACTCTGTGATGCTCTTAATAACGTTCGCCGACTTTCGATATTCCACAAGGAAGAAATGATGCATATGCTTGAAAAAGTGATACCACTTGTCGTGAAATCACTGAAAAATCCAAGAAGTGCGGTGTGTAAAACGGCATGCATGACATCTGCAGATATCTTCAGTGCATATAATAATCATATAACAGATCTGTTGGAGCCTCTGCTTACTCAACTACTCCTCAAGTCTTCCCAAGACAAACGGTTTGTTTGCGAGGCAGCAGAGAAAGCTTTAACAGCAATGACCAAATATGTTTCCCCAACCTTGCTGTTACCAAAGCTGCAACCTTGTCTCAAAAACAGGAATCCTCGGATCCGTGCCAAAGCATCATTATGCTTTTCTCGAAGTGTTCCTCGACTGGGCGTTGAAGGGATTAAAGAATATGGAATCGACAAATTAGTTCAAGCAGCCGCATCTCAGCTTAGCGATCAGCTCCCTGAATCCCGTGAGGCTGCACGGACTGTCCTACTAGAACTTCAGAGCGTATATGAAAAAGCTCATCCTCTCATCAACCCTGAGACATCATCACCAGAAGAACAGCAAATCCCGGAGGTAGAGCCAATTACTTGGGAAACTTTCTGCAAGTCAAAACTGTCGGCTCTTAGCGCACAAGCCGTGCTTCGTGTCACCAATGTTGTCACTGTTACTGCTCGGGAGGGTTTGGTTACTACAGGTTCATCATCTTCATCCCAGTTATAAACATTTTCTACTACAAATTTTTTAAAAACCGTTTGCTACGAGTCATACGGTTTACATGGTATTCTCCGGCATGGCGGCATGATCTACCAAATTGGCAAATTATGGACCGATAAAAAGAGTGAACGTTCGTGTATGAAAAATCTTGGCTTCTTTCTGGGTTATTTTCTTTTTGTGGATTCTCATCTGTCTTCACTACCAGTACTTGTTTCTTTTTCTTATGTGTATATATTCTATACCAAGATTTGGTAAGATAGTCATGAGTCTTTTGGTTATATGCAAAATTGGTCGGATTCTTTG

SEQ ID NO: 1825 - DNA, 1281 bp, Arabidopsis thaliana
  misc_feature (1)..(1281): Ceres cDNA ID no. 12695314
  misc_feature (1)..(1281): Also known as  Ceres CDNA ID no. 12683979
atgtcgtcgaagaaatatcgatattcttcatcttcttctttttcttcttcatcttcttctcagctaagtactccaagagcattgcaaaatgggtattctcaagccattgctaaatctcctctttgggatgttgaagaggtgaaatgcagctttagttcctcagtgtctaagtggaacgaagaacttattggagagatcgcggaacttgacaccgagatcttacagttagagcggtatcttctctcgctatacagatcatcttttggagatcatttgcctgataattcttcactccctccatgcacgaccaaatttcacaatgaccaggcctcttctgtttctgataagtctgtcttgtccaggctcaaacagttctctaaaacggacaagataaaaggatctgactctggtcacccgagtttggctgatcttcttggtcttaacactctcagccctaataaactctctgaagagattctgagaagtatttgtgtgatacactacaaactctcagacaatggacataacagattggtcaagaactcaaagaatgaagagtatgggcaggaacttggagttggtatccataagctatacctagacgattacaatttaaagtccgtagagagcatgcttcagaattttagatcattagttcaaaagctcgagaaagttgatccggcaaggctcggtcgggaagagaagcttgcgttctggatcaacatacataatgctttggtgatgcacgcagcatttaacataggtggggagtgggtaaatgcatacgatatccagagttcgatattgggcattcgtccatgccattcaccatcacgtttacggacgctgttttcaccggctaagagttcaaagacaagtagtggtagacacacttacgcgttggactatgccgagccacttcttcattttgccctctcgaccggagcatcaaccgatccaatggtcagagtgtatacatcagaaggaatctttcaagaacttaggcaagcaagagacagttacatccaaacaagtgttggatttgagaaagagacaaagattttattgccaaagatcatttacaactatgcgaaggatacttctcttgacatgggtgaactctttagtaccgtgtctgagtgtttaatggagtcacaaagaacggcaatgagaagaattgtgaacaaaaagcaagagagatgcattcgttgggttcacgatgaatccaagttccgttatgtcatccattcggaacttgtgagaggcagtcttgaaatttga

SEQ ID NO: 1826 - protein, 1281 aa, Arabidopsis thaliana
ATGTCGTCGAAGAAATATCGATATTCTTCATCTTCTTCTTTTTCTTCTTCATCTTCTTCTCAGCTAAGTACTCCAAGAGCATTGCAAAATGGGTATTCTCAAGCCATTGCTAAATCTCCTCTTTGGGATGTTGAAGAGGTGAAATGCAGCTTTAGTTCCTCAGTGTCTAAGTGGAACGAAGAACTTATTGGAGAGATCGCGGAACTTGACACCGAGATCTTACAGTTAGAGCGGTATCTTCTCTCGCTATACAGATCATCTTTTGGAGATCATTTGCCTGATAATTCTTCACTCCCTCCATGCACGACCAAATTTCACAATGACCAGGCCTCTTCTGTTTCTGATAAGTCTGTCTTGTCCAGGCTCAAACAGTTCTCTAAAACGGACAAGATAAAAGGATCTGACTCTGGTCACCCGAGTTTGGCTGATCTTCTTGGTCTTAACACTCTCAGCCCTAATAAACTCTCTGAAGAGATTCTGAGAAGTATTTGTGTGATACACTACAAACTCTCAGACAATGGACATAACAGATTGGTCAAGAACTCAAAGAATGAAGAGTATGGGCAGGAACTTGGAGTTGGTATCCATAAGCTATACCTAGACGATTACAATTTAAAGTCCGTAGAGAGCATGCTTCAGAATTTTAGATCATTAGTTCAAAAGCTCGAGAAAGTTGATCCGGCAAGGCTCGGTCGGGAAGAGAAGCTTGCGTTCTGGATCAACATACATAATGCTTTGGTGATGCACGCAGCATTTAACATAGGTGGGGAGTGGGTAAATGCATACGATATCCAGAGTTCGATATTGGGCATTCGTCCATGCCATTCACCATCACGTTTACGGACGCTGTTTTCACCGGCTAAGAGTTCAAAGACAAGTAGTGGTAGACACACTTACGCGTTGGACTATGCCGAGCCACTTCTTCATTTTGCCCTCTCGACCGGAGCATCAACCGATCCAATGGTCAGAGTGTATACATCAGAAGGAATCTTTCAAGAACTTAGGCAAGCAAGAGACAGTTACATCCAAACAAGTGTTGGATTTGAGAAAGAGACAAAGATTTTATTGCCAAAGATCATTTACAACTATGCGAAGGATACTTCTCTTGACATGGGTGAACTCTTTAGTACCGTGTCTGAGTGTTTAATGGAGTCACAAAGAACGGCAATGAGAAGAATTGTGAACAAAAAGCAAGAGAGATGCATTCGTTGGGTTCACGATGAATCCAAGTTCCGTTATGTCATCCATTCGGAACTTGTGAGAGGCAGTCTTGAAATTTGA

SEQ ID NO: 1827 - DNA, 1002 bp, Arabidopsis thaliana
  misc_feature (1)..(1002): Ceres cDNA ID no. 12695641
  misc_feature (1)..(1002): Also known as  Ceres CDNA ID no. 12683979
atgggttctttaggtgatgagcttagtttgggatcgatctttgggagaggagtttcgatgaatgttgtggcggttgagaaagttgatgaacatgttaagaagcttgaagaagagaagagaaagctcgaaagttgtcaacttgagcttcctctgtctttgcagattttaaacgatgcgattttgtatctgaaggataagagatgttcagagatggagactcaaccattgttgaaagatttcatttctgttaataaacctattcaaggagaaagaggaatagaattgctgaaaagagaggagctaatgagggagaagaagtttcagcaatggaaagctaatgatgatcacactagtaagatcaagagcaagcttgagattaagagaaatgaggagaaatctcctatgttgttgattccaaaggtggaaactggtttaggcctcggtttaagttcgagttcgataagaagaaaagggattgttgcctcatgtggctttacttctaactctatgccacaaccaccaacaccagcagtaccacaacaaccagcatttcttaagcagcaagctttacggaagcaaagaaggtgttggaatccagagttgcatcgccgatttgtcgatgcattgcaacagctaggtggaccgggagtggcaactcctaaacaaattagagaacatatgcaagaagaaggcttaaccaatgatgaagtcaagagtcatttacagaaatacaggttacacatcaggaagccaaattcgaatgcggagaaacaatcagcagttgttttagggtttaacttgtggaattcttcagcacaagatgaagaagagacatgtgaaggaggagaatcattgaagagaagcaatgcgcaatcagattctcctcaaggtcctttgcagttaccgtctacaacaacaacaactggtggagatagtagcatggaagatgttgaagatgctaagtctgagagctttcaactggagagattgagatcaccataa

SEQ ID NO: 1828 - protein, 1002 aa, Arabidopsis thaliana
ATGGGTTCTTTAGGTGATGAGCTTAGTTTGGGATCGATCTTTGGGAGAGGAGTTTCGATGAATGTTGTGGCGGTTGAGAAAGTTGATGAACATGTTAAGAAGCTTGAAGAAGAGAAGAGAAAGCTCGAAAGTTGTCAACTTGAGCTTCCTCTGTCTTTGCAGATTTTAAACGATGCGATTTTGTATCTGAAGGATAAGAGATGTTCAGAGATGGAGACTCAACCATTGTTGAAAGATTTCATTTCTGTTAATAAACCTATTCAAGGAGAAAGAGGAATAGAATTGCTGAAAAGAGAGGAGCTAATGAGGGAGAAGAAGTTTCAGCAATGGAAAGCTAATGATGATCACACTAGTAAGATCAAGAGCAAGCTTGAGATTAAGAGAAATGAGGAGAAATCTCCTATGTTGTTGATTCCAAAGGTGGAAACTGGTTTAGGCCTCGGTTTAAGTTCGAGTTCGATAAGAAGAAAAGGGATTGTTGCCTCATGTGGCTTTACTTCTAACTCTATGCCACAACCACCAACACCAGCAGTACCACAACAACCAGCATTTCTTAAGCAGCAAGCTTTACGGAAGCAAAGAAGGTGTTGGAATCCAGAGTTGCATCGCCGATTTGTCGATGCATTGCAACAGCTAGGTGGACCGGGAGTGGCAACTCCTAAACAAATTAGAGAACATATGCAAGAAGAAGGCTTAACCAATGATGAAGTCAAGAGTCATTTACAGAAATACAGGTTACACATCAGGAAGCCAAATTCGAATGCGGAGAAACAATCAGCAGTTGTTTTAGGGTTTAACTTGTGGAATTCTTCAGCACAAGATGAAGAAGAGACATGTGAAGGAGGAGAATCATTGAAGAGAAGCAATGCGCAATCAGATTCTCCTCAAGGTCCTTTGCAGTTACCGTCTACAACAACAACAACTGGTGGAGATAGTAGCATGGAAGATGTTGAAGATGCTAAGTCTGAGAGCTTTCAACTGGAGAGATTGAGATCACCATAA

SEQ ID NO: 1829 - DNA, 1863 bp, Arabidopsis thaliana
  misc_feature (1)..(1863): Ceres cDNA ID no. 12696488
  misc_feature (1)..(1863): Also known as  Ceres CDNA ID no. 12683979
atgaagaaatggttagcaatcgcagcgacggtggcgataattgcaataatcgttagacaaggcacgacacaatacggatggaacaaagaggcggcgttggaaaagctaaaggaatggtcagatcggctggggatttgggcgattccaacgtatgtagcggttcacacaataaccttagctctttgtctccctcacgccgtcttctttgaagctggtgcttctatgctctttggtttccttcctgctcttctctgtgttttctctgctaaagttctcgccgcttctttctccttctggatcggcaggtttgtttttaagagttccaccagagctacagggtgggcgcatagcaacaagtacttcaatattctctcaagaggagttgagcgcgatggttggaagtttgttcttcttgcaaggttctcgcccattccttcctatgtcataaactacgctttggcagctactgaagtccggtttgtagctgattttctgttccccacggttattggctgcctcccgatgatcctgcagaacgcatcagtcggtagcctcgctggtatggctgtggcttcagtagctggaaaacagaaaagtcaggtctggggttatgttttcccagtacttgggatactgtcaagtgttctgatttcattgaggatcaaaaagtactcagctggaattacagaggcatcatcagatacctctgctaacaactctagtttagcttcatctgaaactgcgaatcccgcttatggaaccgatggatccaagaaaagtgagcacatggattcgttcttggagttggtacaaggacttctaaaagacaacaatgagcttattcctactcttgtgctctttgttttgttctcttttgatgttagtgttgctcatccaggtctaggatttggatggggaagtaatagtcccattggaggatctttttactcaaatctttacccacaattttaccagttctcttgtccacaagctgatgagattgttatgacggtgctcgaaaaagccatagctaaagaaccaagaatggcagcatctttactcagacttcacttccacgactgcttcgttcagggctgtgatgcatcaatcttgttggatgatagtgcaaccataagaagtgaaaagaatgctggaccaaacaagaactccgttagagggtttcaagtaatcgacgagatcaaagccaaacttgagcaagcttgtcctcaaactgtctcctgcgccgacattctagctctagctgctcgtggctcaactatactgagtggtggaccatcatgggagcttccactagggaggagagactcgaggaccgctagccttaatggcgcaaacacgaacattcctgcacctaactcaactattcaaaatctcttaaccatgttccaacgtaaaggtttgaacgaagaagaccttgtttccctatcaggaggacatacgattggagtagcgaggtgcacaacgtttaaacaaagactatacaatcaaaacggtaataaccaaccagacgagacgctagagaggtcttactactatggtctcaggtcaatttgtccaccaacaggcggtgacaacaatatttcacctctagacttagcctctcctgcaagattcgacaacacatacttcaagctccttctatggggcaaaggcttattgacatcagatgaagtgcttctcactggcaatgtaggcaagactggtgcattagtgaaagcttatgccgaagacgagagacttttcttccaacaattcgcaaagtcgatggttaacatgggaaacattcagcctcttactggttttaatggtgagatcaggaagagttgtcatgtgattaactaa

SEQ ID NO: 1830 - protein, 1863 aa, Arabidopsis thaliana
ATGAAGAAATGGTTAGCAATCGCAGCGACGGTGGCGATAATTGCAATAATCGTTAGACAAGGCACGACACAATACGGATGGAACAAAGAGGCGGCGTTGGAAAAGCTAAAGGAATGGTCAGATCGGCTGGGGATTTGGGCGATTCCAACGTATGTAGCGGTTCACACAATAACCTTAGCTCTTTGTCTCCCTCACGCCGTCTTCTTTGAAGCTGGTGCTTCTATGCTCTTTGGTTTCCTTCCTGCTCTTCTCTGTGTTTTCTCTGCTAAAGTTCTCGCCGCTTCTTTCTCCTTCTGGATCGGCAGGTTTGTTTTTAAGAGTTCCACCAGAGCTACAGGGTGGGCGCATAGCAACAAGTACTTCAATATTCTCTCAAGAGGAGTTGAGCGCGATGGTTGGAAGTTTGTTCTTCTTGCAAGGTTCTCGCCCATTCCTTCCTATGTCATAAACTACGCTTTGGCAGCTACTGAAGTCCGGTTTGTAGCTGATTTTCTGTTCCCCACGGTTATTGGCTGCCTCCCGATGATCCTGCAGAACGCATCAGTCGGTAGCCTCGCTGGTATGGCTGTGGCTTCAGTAGCTGGAAAACAGAAAAGTCAGGTCTGGGGTTATGTTTTCCCAGTACTTGGGATACTGTCAAGTGTTCTGATTTCATTGAGGATCAAAAAGTACTCAGCTGGAATTACAGAGGCATCATCAGATACCTCTGCTAACAACTCTAGTTTAGCTTCATCTGAAACTGCGAATCCCGCTTATGGAACCGATGGATCCAAGAAAAGTGAGCACATGGATTCGTTCTTGGAGTTGGTACAAGGACTTCTAAAAGACAACAATGAGCTTATTCCTACTCTTGTGCTCTTTGTTTTGTTCTCTTTTGATGTTAGTGTTGCTCATCCAGGTCTAGGATTTGGATGGGGAAGTAATAGTCCCATTGGAGGATCTTTTTACTCAAATCTTTACCCACAATTTTACCAGTTCTCTTGTCCACAAGCTGATGAGATTGTTATGACGGTGCTCGAAAAAGCCATAGCTAAAGAACCAAGAATGGCAGCATCTTTACTCAGACTTCACTTCCACGACTGCTTCGTTCAGGGCTGTGATGCATCAATCTTGTTGGATGATAGTGCAACCATAAGAAGTGAAAAGAATGCTGGACCAAACAAGAACTCCGTTAGAGGGTTTCAAGTAATCGACGAGATCAAAGCCAAACTTGAGCAAGCTTGTCCTCAAACTGTCTCCTGCGCCGACATTCTAGCTCTAGCTGCTCGTGGCTCAACTATACTGAGTGGTGGACCATCATGGGAGCTTCCACTAGGGAGGAGAGACTCGAGGACCGCTAGCCTTAATGGCGCAAACACGAACATTCCTGCACCTAACTCAACTATTCAAAATCTCTTAACCATGTTCCAACGTAAAGGTTTGAACGAAGAAGACCTTGTTTCCCTATCAGGAGGACATACGATTGGAGTAGCGAGGTGCACAACGTTTAAACAAAGACTATACAATCAAAACGGTAATAACCAACCAGACGAGACGCTAGAGAGGTCTTACTACTATGGTCTCAGGTCAATTTGTCCACCAACAGGCGGTGACAACAATATTTCACCTCTAGACTTAGCCTCTCCTGCAAGATTCGACAACACATACTTCAAGCTCCTTCTATGGGGCAAAGGCTTATTGACATCAGATGAAGTGCTTCTCACTGGCAATGTAGGCAAGACTGGTGCATTAGTGAAAGCTTATGCCGAAGACGAGAGACTTTTCTTCCAACAATTCGCAAAGTCGATGGTTAACATGGGAAACATTCAGCCTCTTACTGGTTTTAATGGTGAGATCAGGAAGAGTTGTCATGTGATTAACTAA

SEQ ID NO: 1831 - DNA, 1192 bp, Arabidopsis thaliana
  misc_feature (1)..(1192): Ceres cDNA ID no. 12697376
  misc_feature (1)..(1192): Also known as  Ceres CDNA ID no. 12683979
attagagaagaaaaaaagaatggcgaatccttggtgggtagggaatgttgcgatcggtggagttgagagtccagtgacgtcatcagctccttctttgcaccacagaaacagtaacaacaacaacccaccgactatgactcgttcggatccaagattggaccatgacttcaccaccaacaacagtggaagccctaatacccagactcagagccaagaagaacagaacagcagagacgagcaaccagctgttgaacccggatccggatccgggtctacgggtcgtcgtcctagaggtagacctcctggttccaagaacaaaccaaagagtccagttgttgttaccaaagaaagccctaactctctccagagccatgttcttgagattgctacgggagctgacgtggcggaaagcttaaacgcctttgctcgtagacgcggccggggcgtttcggtgctgagcggtagtggtttggttactaatgttactctgcgtcagcctgctgcatccggtggagttgttagtttacgtggtcagtttgagatcttgtctatgtgtggggcttttcttcctacgtctggctctcctgctgcagccgctggtttaaccatttacttagctggagctcaaggtcaagttgtgggaggtggagttgctggcccgcttattgcctctggacccgttattgtgatagctgctacgttttgcaatgccacttatgagaggttaccgattgaggaagaacaacagcaagagcagccgcttcaactagaagatgggaagaagcagaaagaagagaatgatgataacgagagtgggaataacggaaacgaaggatcgatgcagccgccgatgtataatatgcctcctaattttatcccaaatggtcatcaaatggctcaacacgacgtgtattggggtggtcctccgcctcgtgctcctccttcgtattgattagttagataggcggtggttggtgcgttctttttactggaatgattatattttccattaggatggttaggcttttgtttattaaagctatcaagtttcttttttttttacggataattcggatgacaattagctagtgtttgtttgtttgttttgtggcggcttttctgacttgactattttgatcgcggatagctttgtatgaaagtgaattgattgtagaatcgtcttttgaatttt

SEQ ID NO: 1832 - protein, 1192 aa, Arabidopsis thaliana
ATTAGAGAAGAAAAAAAGAATGGCGAATCCTTGGTGGGTAGGGAATGTTGCGATCGGTGGAGTTGAGAGTCCAGTGACGTCATCAGCTCCTTCTTTGCACCACAGAAACAGTAACAACAACAACCCACCGACTATGACTCGTTCGGATCCAAGATTGGACCATGACTTCACCACCAACAACAGTGGAAGCCCTAATACCCAGACTCAGAGCCAAGAAGAACAGAACAGCAGAGACGAGCAACCAGCTGTTGAACCCGGATCCGGATCCGGGTCTACGGGTCGTCGTCCTAGAGGTAGACCTCCTGGTTCCAAGAACAAACCAAAGAGTCCAGTTGTTGTTACCAAAGAAAGCCCTAACTCTCTCCAGAGCCATGTTCTTGAGATTGCTACGGGAGCTGACGTGGCGGAAAGCTTAAACGCCTTTGCTCGTAGACGCGGCCGGGGCGTTTCGGTGCTGAGCGGTAGTGGTTTGGTTACTAATGTTACTCTGCGTCAGCCTGCTGCATCCGGTGGAGTTGTTAGTTTACGTGGTCAGTTTGAGATCTTGTCTATGTGTGGGGCTTTTCTTCCTACGTCTGGCTCTCCTGCTGCAGCCGCTGGTTTAACCATTTACTTAGCTGGAGCTCAAGGTCAAGTTGTGGGAGGTGGAGTTGCTGGCCCGCTTATTGCCTCTGGACCCGTTATTGTGATAGCTGCTACGTTTTGCAATGCCACTTATGAGAGGTTACCGATTGAGGAAGAACAACAGCAAGAGCAGCCGCTTCAACTAGAAGATGGGAAGAAGCAGAAAGAAGAGAATGATGATAACGAGAGTGGGAATAACGGAAACGAAGGATCGATGCAGCCGCCGATGTATAATATGCCTCCTAATTTTATCCCAAATGGTCATCAAATGGCTCAACACGACGTGTATTGGGGTGGTCCTCCGCCTCGTGCTCCTCCTTCGTATTGATTAGTTAGATAGGCGGTGGTTGGTGCGTTCTTTTTACTGGAATGATTATATTTTCCATTAGGATGGTTAGGCTTTTGTTTATTAAAGCTATCAAGTTTCTTTTTTTTTTACGGATAATTCGGATGACAATTAGCTAGTGTTTGTTTGTTTGTTTTGTGGCGGCTTTTCTGACTTGACTATTTTGATCGCGGATAGCTTTGTATGAAAGTGAATTGATTGTAGAATCGTCTTTTGAATTTT

SEQ ID NO: 1833 - DNA, 1026 bp, Arabidopsis thaliana
  misc_feature (1)..(1026): Ceres cDNA ID no. 12697577
  misc_feature (1)..(1026): Also known as  Ceres CDNA ID no. 12683979
atggatattggtgttgacgaacttccaatggcggagagattttattgtggagggagactagtctttggtccagatgcatcgtctctccttctgacaacagctatgattggaggtcctgctctcactttctgcatacgaatggtttttttgatcggaaaacgctatcctttgttccactctcttatattgttgggtgcacttttgctcactgtcctggattttacatttctcttcttaacatcatcgagagaccccgggattatccctagaaacaaagaagcacctgaagcagaagggcttgatatgatcactcaatcctcagagtgggtaaacaacaaactcggtaatacaaagatacctcgaacgaaggatatattggtgaatggctacactgtcaaagttaaattttgtgatacatgtttgctttaccgtcctcctcgcgcctctcactgttcaatctgtaacaactgtgttcaaaggtttgatcatcattgtccatgggttggccaatgcatagccttacgaaactatccatacttcatctgtttcatatcaacttcaacactcctctgcttgtacgtctttgtcttctcatgggtcagtatgcttgagacaacttatgagaatttccggtatcggtatgacaagaaagaaaacccttatggaaagggtctcttcaagaacctatatgagttgttctttgccagaattccacctcccatgatcaacttcagagactgggctccagaggaacctgacgaggaggttggatccattgcatctgagctagaccgaacttttggaccccgaggagataaatatgatatggaaatggaaattggcggttgcaaaaacagtaaggtcggtttacaactccatacactggagtatgacaacaacaacagcagcgaagaaactgtcaagaagaaaggtgtaagcgaagaaaccgccgcgttttacatcccggggattcaagaacccgcgaatataacaagaaactcgagcattgatgtgagatcgaggtag

SEQ ID NO: 1834 - protein, 1026 aa, Arabidopsis thaliana
ATGGATATTGGTGTTGACGAACTTCCAATGGCGGAGAGATTTTATTGTGGAGGGAGACTAGTCTTTGGTCCAGATGCATCGTCTCTCCTTCTGACAACAGCTATGATTGGAGGTCCTGCTCTCACTTTCTGCATACGAATGGTTTTTTTGATCGGAAAACGCTATCCTTTGTTCCACTCTCTTATATTGTTGGGTGCACTTTTGCTCACTGTCCTGGATTTTACATTTCTCTTCTTAACATCATCGAGAGACCCCGGGATTATCCCTAGAAACAAAGAAGCACCTGAAGCAGAAGGGCTTGATATGATCACTCAATCCTCAGAGTGGGTAAACAACAAACTCGGTAATACAAAGATACCTCGAACGAAGGATATATTGGTGAATGGCTACACTGTCAAAGTTAAATTTTGTGATACATGTTTGCTTTACCGTCCTCCTCGCGCCTCTCACTGTTCAATCTGTAACAACTGTGTTCAAAGGTTTGATCATCATTGTCCATGGGTTGGCCAATGCATAGCCTTACGAAACTATCCATACTTCATCTGTTTCATATCAACTTCAACACTCCTCTGCTTGTACGTCTTTGTCTTCTCATGGGTCAGTATGCTTGAGACAACTTATGAGAATTTCCGGTATCGGTATGACAAGAAAGAAAACCCTTATGGAAAGGGTCTCTTCAAGAACCTATATGAGTTGTTCTTTGCCAGAATTCCACCTCCCATGATCAACTTCAGAGACTGGGCTCCAGAGGAACCTGACGAGGAGGTTGGATCCATTGCATCTGAGCTAGACCGAACTTTTGGACCCCGAGGAGATAAATATGATATGGAAATGGAAATTGGCGGTTGCAAAAACAGTAAGGTCGGTTTACAACTCCATACACTGGAGTATGACAACAACAACAGCAGCGAAGAAACTGTCAAGAAGAAAGGTGTAAGCGAAGAAACCGCCGCGTTTTACATCCCGGGGATTCAAGAACCCGCGAATATAACAAGAAACTCGAGCATTGATGTGAGATCGAGGTAG

SEQ ID NO: 1835 - DNA, 1301 bp, Arabidopsis thaliana
  misc_feature (1)..(1301): Ceres cDNA ID no. 12699274
  misc_feature (1)..(1301): Also known as  Ceres CDNA ID no. 12683979
atgggttgtttcggatgcagtaagaaatcgagcaaacgatccgagactaacaaagatactgtcataaatagaaaaattgtcggtggtactacgagcgttgctaagagtgataagcgagacgatcagactcagcccagttcagattcaacaaaagtcagtccatatagagatgtaaacaatgaaggaggagttggtaaggaagatcagttatctttggatgtgaagggtttgaatctaaatgaccaagtcacagggaagaaagcacagacttttacttttcaagaacttgcagaagctacgggaaactttagatcggattgttttcttggtgaaggaggtttcggaaaagttttcaagggaactatagagaaattggatcaggttgttgcaatcaagcaacttgatcgtaatggggttcaaggaatcagggaatttgtggttgaggtattgactctaagtcttgctgaccatccgaatcttgtgaagcttattgggttttgtgctgagggtgatcagagactactggtgtacgagtatatgccgcaaggatcccttgaagatcatctacatgttctcccttctggtaaaaagcctcttgactggaacacccggatgaaaatagcagctggtgcagcaagaggtttagagtatctgcatgacagaatgacgccccctgtgatttaccgagatcttaaatgttcgaatattttgcttggtgaagactatcaaccgaaactatctgactttgggttggctaaagtaggaccaagcggggataaaacccatgtctcgacaagggttatgggaacgtacggatactgtgctcctgactacgctatgacgggtcagctcacatttaaatccgatatatacagttttggagtagtccttctcgagcttatcaccggaaggaaagcgattgacaatacaaaaacgcgtaaagatcagaatttggttggatgggcacgaccattgttcaaagacaggaggaacttcccaaaaatggttgatccattgcttcagggacaatacccagttagaggactgtaccaagcactagcaatatcagcaatgtgcgttcaagagcagcctaccatgagaccagtggtatctgatgtagtattggctctcaacttcttagcctcttctaaatatgatccgaatagccctagcagcagcagcgggaagaacccttcttttcacagagacagagatgatgaagagaaaagaccacacctcgtcaaggaaactgaatgtgaagggtcctcataggatatccaataagagagtggtaaaaaatc

SEQ ID NO: 1836 - protein, 1301 aa, Arabidopsis thaliana
ATGGGTTGTTTCGGATGCAGTAAGAAATCGAGCAAACGATCCGAGACTAACAAAGATACTGTCATAAATAGAAAAATTGTCGGTGGTACTACGAGCGTTGCTAAGAGTGATAAGCGAGACGATCAGACTCAGCCCAGTTCAGATTCAACAAAAGTCAGTCCATATAGAGATGTAAACAATGAAGGAGGAGTTGGTAAGGAAGATCAGTTATCTTTGGATGTGAAGGGTTTGAATCTAAATGACCAAGTCACAGGGAAGAAAGCACAGACTTTTACTTTTCAAGAACTTGCAGAAGCTACGGGAAACTTTAGATCGGATTGTTTTCTTGGTGAAGGAGGTTTCGGAAAAGTTTTCAAGGGAACTATAGAGAAATTGGATCAGGTTGTTGCAATCAAGCAACTTGATCGTAATGGGGTTCAAGGAATCAGGGAATTTGTGGTTGAGGTATTGACTCTAAGTCTTGCTGACCATCCGAATCTTGTGAAGCTTATTGGGTTTTGTGCTGAGGGTGATCAGAGACTACTGGTGTACGAGTATATGCCGCAAGGATCCCTTGAAGATCATCTACATGTTCTCCCTTCTGGTAAAAAGCCTCTTGACTGGAACACCCGGATGAAAATAGCAGCTGGTGCAGCAAGAGGTTTAGAGTATCTGCATGACAGAATGACGCCCCCTGTGATTTACCGAGATCTTAAATGTTCGAATATTTTGCTTGGTGAAGACTATCAACCGAAACTATCTGACTTTGGGTTGGCTAAAGTAGGACCAAGCGGGGATAAAACCCATGTCTCGACAAGGGTTATGGGAACGTACGGATACTGTGCTCCTGACTACGCTATGACGGGTCAGCTCACATTTAAATCCGATATATACAGTTTTGGAGTAGTCCTTCTCGAGCTTATCACCGGAAGGAAAGCGATTGACAATACAAAAACGCGTAAAGATCAGAATTTGGTTGGATGGGCACGACCATTGTTCAAAGACAGGAGGAACTTCCCAAAAATGGTTGATCCATTGCTTCAGGGACAATACCCAGTTAGAGGACTGTACCAAGCACTAGCAATATCAGCAATGTGCGTTCAAGAGCAGCCTACCATGAGACCAGTGGTATCTGATGTAGTATTGGCTCTCAACTTCTTAGCCTCTTCTAAATATGATCCGAATAGCCCTAGCAGCAGCAGCGGGAAGAACCCTTCTTTTCACAGAGACAGAGATGATGAAGAGAAAAGACCACACCTCGTCAAGGAAACTGAATGTGAAGGGTCCTCATAGGATATCCAATAAGAGAGTGGTAAAAAATC

SEQ ID NO: 1837 - DNA, 1509 bp, Arabidopsis thaliana
  misc_feature (1)..(1509): Ceres cDNA ID no. 12700601
  misc_feature (1)..(1509): Also known as  Ceres CDNA ID no. 12683979
aattatttttcccattctcttcactatctctctccctagaaaattgccagaagaagaaggttctccaattcaaaaaaatagaaactcgctaccattcatttcaaaaaatttcttgttaagttacgtttttttctttttttttgcttctttcgttcttattgtcttagaagacaaaagagactagagaggatagaaaaatggaagcttcaagcacaagaagcgagaagaagaagaagaagaagacgatacagagagaaaacaccgatactcaaaagaaaaaaaagctacccagtgtttggttttcacttaagaaatctctcccctgcaaatctgatgtctccgatgtccacattccgagatccaaaaaagagctagctcccatatccactaagagaacaacaacctcctccggcggcggggtcggcggcaggtccggttgttcaagatccatagccaatcttaaagacgtaatccatggaaaccaacggcatttagagaagccgctttgctctagccctcgttctataggaagcagcgagtttctcaatcccattactcacgatgtaatctttagcaactccacctgcgagctcaagatcaccgccgccggagcaacagaattcgtcgggaatcttagaccagggacgccggtcaattactcttcttcacgccgtagccaaacttcgagaaaggcttcttctttagatagagaaggattagggtttcaccagagcagaagagagaatgatagagaagccgccattaacggagacaattcctctgtttcttgccataaatgcggcgagaaatttagcaaactcgaagctgcagaagctcatcatctaaccaaacacgccgtgactgagctaatggaaggagactcgtcgaggagaatagtggagataatctgcagaacaagctggttaaagacagagaatcaaggagggagaatcgatcggattttgaaagtacacaacatgcaaaaaaccttagcgagattcgaagaatacagagatacagtgaagatcagagcaagcaagttacaaaagaaacatccgagatgtatcgccgacggaaacgagcttctcaggtttcacggcaccactgtggcttgcgctttggggataaacgggtcgacgagtctgtgttcgtcggaaaagtgttgcgtttgtcggattatacgaaatgggttctcggcgaaacgggagatgaataacggaattggggtttttactgcgtcgacgagtgagagggcgtttgagtctattgtgattggagatggtggtggtggtgatcggaaggcgttgattgtgtgtcgagtgattgccgggagggttcatcggccggtggagaatgtagaggagatgggtgggttgttgagtgggtttgattcattggctggtaaagttgggttgtacacaaatgttgaggagctctatttgctcaattctcgagctttgcttccttgttttgtgctaatctgcaaaccttaaatcaaacttttgaggt

SEQ ID NO: 1838 - protein, 1509 aa, Arabidopsis thaliana
AATTATTTTTCCCATTCTCTTCACTATCTCTCTCCCTAGAAAATTGCCAGAAGAAGAAGGTTCTCCAATTCAAAAAAATAGAAACTCGCTACCATTCATTTCAAAAAATTTCTTGTTAAGTTACGTTTTTTTCTTTTTTTTTGCTTCTTTCGTTCTTATTGTCTTAGAAGACAAAAGAGACTAGAGAGGATAGAAAAATGGAAGCTTCAAGCACAAGAAGCGAGAAGAAGAAGAAGAAGAAGACGATACAGAGAGAAAACACCGATACTCAAAAGAAAAAAAAGCTACCCAGTGTTTGGTTTTCACTTAAGAAATCTCTCCCCTGCAAATCTGATGTCTCCGATGTCCACATTCCGAGATCCAAAAAAGAGCTAGCTCCCATATCCACTAAGAGAACAACAACCTCCTCCGGCGGCGGGGTCGGCGGCAGGTCCGGTTGTTCAAGATCCATAGCCAATCTTAAAGACGTAATCCATGGAAACCAACGGCATTTAGAGAAGCCGCTTTGCTCTAGCCCTCGTTCTATAGGAAGCAGCGAGTTTCTCAATCCCATTACTCACGATGTAATCTTTAGCAACTCCACCTGCGAGCTCAAGATCACCGCCGCCGGAGCAACAGAATTCGTCGGGAATCTTAGACCAGGGACGCCGGTCAATTACTCTTCTTCACGCCGTAGCCAAACTTCGAGAAAGGCTTCTTCTTTAGATAGAGAAGGATTAGGGTTTCACCAGAGCAGAAGAGAGAATGATAGAGAAGCCGCCATTAACGGAGACAATTCCTCTGTTTCTTGCCATAAATGCGGCGAGAAATTTAGCAAACTCGAAGCTGCAGAAGCTCATCATCTAACCAAACACGCCGTGACTGAGCTAATGGAAGGAGACTCGTCGAGGAGAATAGTGGAGATAATCTGCAGAACAAGCTGGTTAAAGACAGAGAATCAAGGAGGGAGAATCGATCGGATTTTGAAAGTACACAACATGCAAAAAACCTTAGCGAGATTCGAAGAATACAGAGATACAGTGAAGATCAGAGCAAGCAAGTTACAAAAGAAACATCCGAGATGTATCGCCGACGGAAACGAGCTTCTCAGGTTTCACGGCACCACTGTGGCTTGCGCTTTGGGGATAAACGGGTCGACGAGTCTGTGTTCGTCGGAAAAGTGTTGCGTTTGTCGGATTATACGAAATGGGTTCTCGGCGAAACGGGAGATGAATAACGGAATTGGGGTTTTTACTGCGTCGACGAGTGAGAGGGCGTTTGAGTCTATTGTGATTGGAGATGGTGGTGGTGGTGATCGGAAGGCGTTGATTGTGTGTCGAGTGATTGCCGGGAGGGTTCATCGGCCGGTGGAGAATGTAGAGGAGATGGGTGGGTTGTTGAGTGGGTTTGATTCATTGGCTGGTAAAGTTGGGTTGTACACAAATGTTGAGGAGCTCTATTTGCTCAATTCTCGAGCTTTGCTTCCTTGTTTTGTGCTAATCTGCAAACCTTAAATCAAACTTTTGAGGT

SEQ ID NO: 1839 - DNA, 993 bp, Arabidopsis thaliana
  misc_feature (1)..(993): Ceres cDNA ID no. 12700653
  misc_feature (1)..(993): Also known as  Ceres CDNA ID no. 12683979
atgagtacacgaagaaatggcatttccaagcatcagcgaggtgataaattttgtggtgaagggccaaactggatactaattgcagggggtgcattgttgagcacattgtccattcgctttggatacaagctaaagcagtcgcttgattcgaaacctcaatcaaatggctctgctggattaaaacctaatggaacatctgagaggcaaaaatctacaagctgttgcttacactctaccacatcttcctgtacacaaaataatgatttttgttgcttccgaactgagagtgtggaaggaaaagaggtgacaagcgagcaaatgatatccgcatctgacacttcactgcctcttgtgacagttcctgctccatcgagcaaagagaatggagtcatgtgggcaacttctcctgatcgcctggaacttcccccaagaccatacaatcacaattcaaactgctcagattctccttgcgtatctgaaaccagctcagacattttcagcaaacgagaagtaatacagaaactaaggcagcagctgaagagacgggatgacatgatacaggaaatgcaagaacagattctagagctgcaaaactcgtataacgcacagacggcacactcaagccatctccaggcacagctagacacactgaacagagatctgtttgaatcagaaagagaagttcaaagactgagaaaggcaattgctgatcacagcgtgggatgtggcgcggacagcaatggcaagacatctccggttggaccttggaatggcgggtttatggacagcgaaagcaattatgagtcacaagaaaagagcctaagggatggagaaagagtagagatgttgagaaaggaagtgagtgagcttaaagaagtgatagatgggaaagagtatctacttagaagctataaggagcagaagattgagctttcgcagaaggtaaaagagttgcagcagagactggactcacagctccaaaacttattgtag

SEQ ID NO: 1840 - protein, 993 aa, Arabidopsis thaliana
ATGAGTACACGAAGAAATGGCATTTCCAAGCATCAGCGAGGTGATAAATTTTGTGGTGAAGGGCCAAACTGGATACTAATTGCAGGGGGTGCATTGTTGAGCACATTGTCCATTCGCTTTGGATACAAGCTAAAGCAGTCGCTTGATTCGAAACCTCAATCAAATGGCTCTGCTGGATTAAAACCTAATGGAACATCTGAGAGGCAAAAATCTACAAGCTGTTGCTTACACTCTACCACATCTTCCTGTACACAAAATAATGATTTTTGTTGCTTCCGAACTGAGAGTGTGGAAGGAAAAGAGGTGACAAGCGAGCAAATGATATCCGCATCTGACACTTCACTGCCTCTTGTGACAGTTCCTGCTCCATCGAGCAAAGAGAATGGAGTCATGTGGGCAACTTCTCCTGATCGCCTGGAACTTCCCCCAAGACCATACAATCACAATTCAAACTGCTCAGATTCTCCTTGCGTATCTGAAACCAGCTCAGACATTTTCAGCAAACGAGAAGTAATACAGAAACTAAGGCAGCAGCTGAAGAGACGGGATGACATGATACAGGAAATGCAAGAACAGATTCTAGAGCTGCAAAACTCGTATAACGCACAGACGGCACACTCAAGCCATCTCCAGGCACAGCTAGACACACTGAACAGAGATCTGTTTGAATCAGAAAGAGAAGTTCAAAGACTGAGAAAGGCAATTGCTGATCACAGCGTGGGATGTGGCGCGGACAGCAATGGCAAGACATCTCCGGTTGGACCTTGGAATGGCGGGTTTATGGACAGCGAAAGCAATTATGAGTCACAAGAAAAGAGCCTAAGGGATGGAGAAAGAGTAGAGATGTTGAGAAAGGAAGTGAGTGAGCTTAAAGAAGTGATAGATGGGAAAGAGTATCTACTTAGAAGCTATAAGGAGCAGAAGATTGAGCTTTCGCAGAAGGTAAAAGAGTTGCAGCAGAGACTGGACTCACAGCTCCAAAACTTATTGTAG

SEQ ID NO: 1841 - DNA, 1388 bp, Arabidopsis thaliana
  misc_feature (1)..(1388): Ceres cDNA ID no. 12700657
  misc_feature (1)..(1388): Also known as  Ceres CDNA ID no. 12683979
aaaacagcctggtaagcttcttcgttttcccttctagagaccattgattatcataattgttctacaaactttagctttttcattagtctctcgatctacttgatcgttgtcacttagcaaccctaatttctgggagaatcgtccctgcagtattacccatcccgatgagtgttaaggttggatgatagaagacattttttgaccttctcttacaatgactacacgaagaaatggcgtttccaggcatcagcggtttgagagttttcgcggtgaaggaccaaattggatcttaattgctgggggtgctttgttgagtacattgtccattcgttttggctacaaattaaagcagtctattgactccaaacctcctcattccaatgccactggtggattaaaacctaatggaacaaccgacagaggaagatttaagggctgctgcttgcattctaatgcatcaccctgtgaaaggaataatgattgttgctttcactgcactcccggaactgagaatggggaaggaaatcatgctacaaatgagcaaatggcagagtccagtacttctctgcctcttgtgacagttcctgcttcatcatatagcaaagagagtgcagtcgtatggggatcttctcctgaccacctggaagtgccgatgaaagcataccatcaacattcgacctgctcagattctccttgcgtatctgaatccggctcagacatcttcagcaagcgagaagtaatacagaaactgaggcaacagctgaagagacgtgacgacatgatagttgaaatgcaggaacagattctagagctgcaaaactcgctaaacgcccagatgggacactctagccatatccaaacacagctagacgcaacaaacagggacctgtttgaatcagaaagagaagtccagagactgagaaaggcaatcgctgatcactgcgtgggacacacaggtagcaatggttggagtggcgatgtgaacagcgaaaacaactacgagtcaccagaaaatggaataagggatggagaaagaatagagatgttgagaaaagaagtgggtgagcttaaagaagtgatagatgggaaagagtatctacttaggagctataaggagcagaaaacagagcttttgcagaaggtaaaagagttgcagcagagactggactcgcagctcccaaacattttgtaggtgaagaaggttaggcattgtgcattcttaccactctcttttgtttccccgagtaaaaaatatgaatctttgttcaaaaatatctcaatttctccggggaaacttatcaactgactacattgttttgggtgtcaattatgattttatccaaattgtttttttctcttggtgaagtggatattcgaaagttgcaaac

SEQ ID NO: 1842 - protein, 1388 aa, Arabidopsis thaliana
AAAACAGCCTGGTAAGCTTCTTCGTTTTCCCTTCTAGAGACCATTGATTATCATAATTGTTCTACAAACTTTAGCTTTTTCATTAGTCTCTCGATCTACTTGATCGTTGTCACTTAGCAACCCTAATTTCTGGGAGAATCGTCCCTGCAGTATTACCCATCCCGATGAGTGTTAAGGTTGGATGATAGAAGACATTTTTTGACCTTCTCTTACAATGACTACACGAAGAAATGGCGTTTCCAGGCATCAGCGGTTTGAGAGTTTTCGCGGTGAAGGACCAAATTGGATCTTAATTGCTGGGGGTGCTTTGTTGAGTACATTGTCCATTCGTTTTGGCTACAAATTAAAGCAGTCTATTGACTCCAAACCTCCTCATTCCAATGCCACTGGTGGATTAAAACCTAATGGAACAACCGACAGAGGAAGATTTAAGGGCTGCTGCTTGCATTCTAATGCATCACCCTGTGAAAGGAATAATGATTGTTGCTTTCACTGCACTCCCGGAACTGAGAATGGGGAAGGAAATCATGCTACAAATGAGCAAATGGCAGAGTCCAGTACTTCTCTGCCTCTTGTGACAGTTCCTGCTTCATCATATAGCAAAGAGAGTGCAGTCGTATGGGGATCTTCTCCTGACCACCTGGAAGTGCCGATGAAAGCATACCATCAACATTCGACCTGCTCAGATTCTCCTTGCGTATCTGAATCCGGCTCAGACATCTTCAGCAAGCGAGAAGTAATACAGAAACTGAGGCAACAGCTGAAGAGACGTGACGACATGATAGTTGAAATGCAGGAACAGATTCTAGAGCTGCAAAACTCGCTAAACGCCCAGATGGGACACTCTAGCCATATCCAAACACAGCTAGACGCAACAAACAGGGACCTGTTTGAATCAGAAAGAGAAGTCCAGAGACTGAGAAAGGCAATCGCTGATCACTGCGTGGGACACACAGGTAGCAATGGTTGGAGTGGCGATGTGAACAGCGAAAACAACTACGAGTCACCAGAAAATGGAATAAGGGATGGAGAAAGAATAGAGATGTTGAGAAAAGAAGTGGGTGAGCTTAAAGAAGTGATAGATGGGAAAGAGTATCTACTTAGGAGCTATAAGGAGCAGAAAACAGAGCTTTTGCAGAAGGTAAAAGAGTTGCAGCAGAGACTGGACTCGCAGCTCCCAAACATTTTGTAGGTGAAGAAGGTTAGGCATTGTGCATTCTTACCACTCTCTTTTGTTTCCCCGAGTAAAAAATATGAATCTTTGTTCAAAAATATCTCAATTTCTCCGGGGAAACTTATCAACTGACTACATTGTTTTGGGTGTCAATTATGATTTTATCCAAATTGTTTTTTTCTCTTGGTGAAGTGGATATTCGAAAGTTGCAAAC

SEQ ID NO: 1843 - DNA, 1224 bp, Arabidopsis thaliana
  misc_feature (1)..(1224): Ceres cDNA ID no. 12700823
  misc_feature (1)..(1224): Also known as  Ceres CDNA ID no. 12683979
atgacacaacgggtattccaagtctggaaaggaagcaataaattcatcctgggtgggagattgatatttggaccagatgctaggtcactgcctcttaccttgctattgatcatagttccggttgttttgttctgtgtatttgtagcaaggcaccttcgccatgagttctctccctacaatgcgggatatgctatcatggtggtagcaattcttttcactatttatgtattgatcctcctcttcttcacatctgcacgagatcctggtattgttcctcgaaattcgcatccaccagaggaagacctacgttatgagacaactgtatcagctgatggaagacaaacaccgagtgttcaaattcccaggacgaaagaagtcattgttaatggcgtttctgttagagtgaaatactgtgatacatgcatgctttacaggcctcctcgctgctctcattgctccatatgcaacaactgtgttgagcgctttgatcatcattgcccatgggtgggacaatgcattggactgagaaactataggtatttctttatgtttgtttcttcgtcaacacttctctgcatctatattttctcgatgtcggcggtatacatcaagattctgatggatcatcaacaagcaactgtgtggagggcaatgaaagaatcaccttgggctgttgtgttgatgatatattgctttattgccctgtggtttgttggagggctcacagcgtttcacttgtacctcataagtacaaaccagacaacctatgagaaactccggtacaggtcatcacacagcaggagcattgtctataaccgtggctgtccaaacaatttcctggaagttttttgctcaaaggtgaagccctcgaggaacaactttagagccttcatcgaagaagaacccccaagagttattactctgcctagcaccaccagggaatcaggggaagcagaagacgaaaatgtgacccggcgacagaaagtggaagacgatctagacattggagacgatctaatgaatctctcacggcgttgtaatgcagaagatgccaacaacaatcagcctcatcacacattggacatagaccatgagagagcaggctcgataaggacagaagcaagacatgaaagctggggaagaagaagtgggagctgggatgtagcagcaacagatgtgagggaaagtcgaagctacgcaacagcaaaggatggaaggggataa

SEQ ID NO: 1844 - protein, 1224 aa, Arabidopsis thaliana
ATGACACAACGGGTATTCCAAGTCTGGAAAGGAAGCAATAAATTCATCCTGGGTGGGAGATTGATATTTGGACCAGATGCTAGGTCACTGCCTCTTACCTTGCTATTGATCATAGTTCCGGTTGTTTTGTTCTGTGTATTTGTAGCAAGGCACCTTCGCCATGAGTTCTCTCCCTACAATGCGGGATATGCTATCATGGTGGTAGCAATTCTTTTCACTATTTATGTATTGATCCTCCTCTTCTTCACATCTGCACGAGATCCTGGTATTGTTCCTCGAAATTCGCATCCACCAGAGGAAGACCTACGTTATGAGACAACTGTATCAGCTGATGGAAGACAAACACCGAGTGTTCAAATTCCCAGGACGAAAGAAGTCATTGTTAATGGCGTTTCTGTTAGAGTGAAATACTGTGATACATGCATGCTTTACAGGCCTCCTCGCTGCTCTCATTGCTCCATATGCAACAACTGTGTTGAGCGCTTTGATCATCATTGCCCATGGGTGGGACAATGCATTGGACTGAGAAACTATAGGTATTTCTTTATGTTTGTTTCTTCGTCAACACTTCTCTGCATCTATATTTTCTCGATGTCGGCGGTATACATCAAGATTCTGATGGATCATCAACAAGCAACTGTGTGGAGGGCAATGAAAGAATCACCTTGGGCTGTTGTGTTGATGATATATTGCTTTATTGCCCTGTGGTTTGTTGGAGGGCTCACAGCGTTTCACTTGTACCTCATAAGTACAAACCAGACAACCTATGAGAAACTCCGGTACAGGTCATCACACAGCAGGAGCATTGTCTATAACCGTGGCTGTCCAAACAATTTCCTGGAAGTTTTTTGCTCAAAGGTGAAGCCCTCGAGGAACAACTTTAGAGCCTTCATCGAAGAAGAACCCCCAAGAGTTATTACTCTGCCTAGCACCACCAGGGAATCAGGGGAAGCAGAAGACGAAAATGTGACCCGGCGACAGAAAGTGGAAGACGATCTAGACATTGGAGACGATCTAATGAATCTCTCACGGCGTTGTAATGCAGAAGATGCCAACAACAATCAGCCTCATCACACATTGGACATAGACCATGAGAGAGCAGGCTCGATAAGGACAGAAGCAAGACATGAAAGCTGGGGAAGAAGAAGTGGGAGCTGGGATGTAGCAGCAACAGATGTGAGGGAAAGTCGAAGCTACGCAACAGCAAAGGATGGAAGGGGATAA

SEQ ID NO: 1845 - DNA, 1560 bp, Arabidopsis thaliana
  misc_feature (1)..(1560): Ceres cDNA ID no. 12701521
  misc_feature (1)..(1560): Also known as  Ceres CDNA ID no. 12683979
atggccatgcctgcttttcttcaatatttgagcttgagaagaacagaagaaacttccaggatcaatcaatcgatcaactttagtgaactaactcttgatttttcattcgaagttatggaatcggttcccgaatccgtaccatcgccgaactcgaatacaccgtcaataccaccgccggtgaactccgtaccgcctttcttgagtaaaacctacgacatggttgatgatccgttgaccaatgaggtcgtttcgtggagcagcgggaacaacagcttcgtcgtctggagtgccccggagttctcgaaggtgctcttgcccaagtatttcaagcacaacaacttctccagcttcgtcagacagttaaatacttatggtttcagaaaagttgatcctgaccgatgggaatttgcaaatgaaggatttcttagaggccgaaaacaactactgaagagtattgtcaggagaaaaccttcgcatgtgcagcagaatcagcaacaaactcaagttcagagctcatctgttggtgcttgtgtcgaggtggggaagtttggaatagaagaagaagtggaaagacttaagcgggataagaatgttcttatgcaagaactcgtcaggttaaggcagcaacagcaagctactgaaaaccaactgcagaatgtgggacagaaagttcaggtgatggagcaaaggcaacaacaaatgatgtcgtttttagcaaaggctgttcaaagtccaggtttcttaaaccagttagtacaacagaataataatgatggcaacagacaaattccaggaagcaacaaaaagaggagacttcctgtagatgagcaggagaatcgtggtgacaatgtggctaatggtcttaaccgccagattgttagatatcagccgtcgataaacgaagcagcacaaaatatgcttcgacagttcttaaatactagtacctcacctcggtatgaatcagtttcaaacaatcctgacagtttcctattgggtgatgttcccagttctacctctgtagacaatgggaacccttcaagtagagtttctggagtaacattggccgagttttcacccaacacagttcagtcagcaacgaatcaagtacccgaagcaagtttggctcatcatcctcaagctggtctggttcagccaaatataggtcaaagtccggctcaaggagcagcacctgcagactcttggagccctgaatttgatttagttggatgcgagacagatagtggagagtgttttgatccaataatggctgttttagatgagtcagaaggcgatgcaatttctcctgaaggtgagggcaagatgaatgagttactggagggagtccctaagctgcccggaatccaagatccattctgggaacagttcttttctgttgaactcccagcgattgcagatacagacgatattctatcaggatcagtggagaataatgacttggtattggaacaagaaccaaacgagtggacccgtaatgaacaacaaatgaagtatcttactgaacaaatgggactgctttcctcagaagcacagaggaaataa

SEQ ID NO: 1846 - protein, 1560 aa, Arabidopsis thaliana
ATGGCCATGCCTGCTTTTCTTCAATATTTGAGCTTGAGAAGAACAGAAGAAACTTCCAGGATCAATCAATCGATCAACTTTAGTGAACTAACTCTTGATTTTTCATTCGAAGTTATGGAATCGGTTCCCGAATCCGTACCATCGCCGAACTCGAATACACCGTCAATACCACCGCCGGTGAACTCCGTACCGCCTTTCTTGAGTAAAACCTACGACATGGTTGATGATCCGTTGACCAATGAGGTCGTTTCGTGGAGCAGCGGGAACAACAGCTTCGTCGTCTGGAGTGCCCCGGAGTTCTCGAAGGTGCTCTTGCCCAAGTATTTCAAGCACAACAACTTCTCCAGCTTCGTCAGACAGTTAAATACTTATGGTTTCAGAAAAGTTGATCCTGACCGATGGGAATTTGCAAATGAAGGATTTCTTAGAGGCCGAAAACAACTACTGAAGAGTATTGTCAGGAGAAAACCTTCGCATGTGCAGCAGAATCAGCAACAAACTCAAGTTCAGAGCTCATCTGTTGGTGCTTGTGTCGAGGTGGGGAAGTTTGGAATAGAAGAAGAAGTGGAAAGACTTAAGCGGGATAAGAATGTTCTTATGCAAGAACTCGTCAGGTTAAGGCAGCAACAGCAAGCTACTGAAAACCAACTGCAGAATGTGGGACAGAAAGTTCAGGTGATGGAGCAAAGGCAACAACAAATGATGTCGTTTTTAGCAAAGGCTGTTCAAAGTCCAGGTTTCTTAAACCAGTTAGTACAACAGAATAATAATGATGGCAACAGACAAATTCCAGGAAGCAACAAAAAGAGGAGACTTCCTGTAGATGAGCAGGAGAATCGTGGTGACAATGTGGCTAATGGTCTTAACCGCCAGATTGTTAGATATCAGCCGTCGATAAACGAAGCAGCACAAAATATGCTTCGACAGTTCTTAAATACTAGTACCTCACCTCGGTATGAATCAGTTTCAAACAATCCTGACAGTTTCCTATTGGGTGATGTTCCCAGTTCTACCTCTGTAGACAATGGGAACCCTTCAAGTAGAGTTTCTGGAGTAACATTGGCCGAGTTTTCACCCAACACAGTTCAGTCAGCAACGAATCAAGTACCCGAAGCAAGTTTGGCTCATCATCCTCAAGCTGGTCTGGTTCAGCCAAATATAGGTCAAAGTCCGGCTCAAGGAGCAGCACCTGCAGACTCTTGGAGCCCTGAATTTGATTTAGTTGGATGCGAGACAGATAGTGGAGAGTGTTTTGATCCAATAATGGCTGTTTTAGATGAGTCAGAAGGCGATGCAATTTCTCCTGAAGGTGAGGGCAAGATGAATGAGTTACTGGAGGGAGTCCCTAAGCTGCCCGGAATCCAAGATCCATTCTGGGAACAGTTCTTTTCTGTTGAACTCCCAGCGATTGCAGATACAGACGATATTCTATCAGGATCAGTGGAGAATAATGACTTGGTATTGGAACAAGAACCAAACGAGTGGACCCGTAATGAACAACAAATGAAGTATCTTACTGAACAAATGGGACTGCTTTCCTCAGAAGCACAGAGGAAATAA

SEQ ID NO: 1847 - DNA, 1274 bp, Arabidopsis thaliana
  misc_feature (1)..(1274): Ceres cDNA ID no. 12701672
  misc_feature (1)..(1274): Ceres CLONE  ID no. 39195
  misc_feature (1)..(1274): Also known as  Ceres CDNA ID no. 23360242
acaaccctttccacaagaagttataaaccaatacatagaagaaaacttccaaccccaaaaaatgatgaagggtgccaagttttcatctcttcttgtgcttttctttatttttccgatcgcatttgctcaactgagagtcgggttttatagtcaatcatgccctcaagccgagactatcgtacgcaatctggtgcgccaacggtttggtgttaccccaaccgttaccgccgctttgctccgtatgcatttccacgactgtttcgttaagggctgtgacgcttctctcctcattgattcaaccaattccgagaaaactgctggaccaaacggaagcgtcagggaatttgacctgatagaccggatcaaggctcagctagaagctgcatgcccttccacagtctcatgtgctgacatcgtcacattggccacacgtgactcggtggccttagccggaggcccaagctacagcatccccacgggaaggcgtgacggtagggtctcaaacaatcttgatgtaaccttaccgggtccaacgatctccgtctctggagccgtgagtttattcacgaacaaagggatgaacacgttcgatgcagtagctcttttgggtgcacacactgttggtcaaggaaattgtggtctctttagtgacagaatcactagcttccaaggaactggacgaccggacccgtccatggaccccgctttggttaccagcctaaggaacacatgcagaaatagcgcgacggcggcactagaccagtcgagtccattgagattcgacaaccagttcttcaagcaaatccgtaaaaggagaggagtgttgcaagttgaccaacgcctcgcatccgacccacagactcgtgggattgtggctcggtatgctaataacaacgccttcttcaagcgtcagttcgttagagcaatggtgaagatgggagcagttgatgtgcttactggtcgtaacggtgagatcagaaggaactgcaggagattcaactaatgaactacagaagcgtggatataatattacatttgatacaatatatttcaaatcttctttatatttttactaattcatttttggttttggttggggttttcttgcataaataaggcttttcttaaattggatggtttcgattttcgagaaagattactatatattatattgttggtctgcatttggtggatgtatcttaagtttacaaataatttgtgatattgaaatattgatatgtatctttatcatggttaatcatatatatatatat

SEQ ID NO: 1848 - protein, 1274 aa, Arabidopsis thaliana
  misc_feature: PFam Name: peroxidase; PFam Description: Peroxidase
  misc_feature: GI Number: 21593467; NR Description: peroxidase ATP13a
  misc_feature: GI Number: 31745133; NR Description: putative peroxidase [Arabidopsis thaliana] >gi|9759059|dbj|BAB09581.1| peroxidase [Arabidopsis thaliana] >gi|1429219|emb|CAA67312.1| peroxidase ATP13a [Arabidopsis thaliana] >gi|1402900|emb|CAA66966.1|
  misc_feature: GI Number: 21593692; NR Description: putative peroxidase
  misc_feature: GI Number: 51970002; NR Description: putative peroxidase
ACAACCCTTTCCACAAGAAGTTATAAACCAATACATAGAAGAAAACTTCCAACCCCAAAAAATGATGAAGGGTGCCAAGTTTTCATCTCTTCTTGTGCTTTTCTTTATTTTTCCGATCGCATTTGCTCAACTGAGAGTCGGGTTTTATAGTCAATCATGCCCTCAAGCCGAGACTATCGTACGCAATCTGGTGCGCCAACGGTTTGGTGTTACCCCAACCGTTACCGCCGCTTTGCTCCGTATGCATTTCCACGACTGTTTCGTTAAGGGCTGTGACGCTTCTCTCCTCATTGATTCAACCAATTCCGAGAAAACTGCTGGACCAAACGGAAGCGTCAGGGAATTTGACCTGATAGACCGGATCAAGGCTCAGCTAGAAGCTGCATGCCCTTCCACAGTCTCATGTGCTGACATCGTCACATTGGCCACACGTGACTCGGTGGCCTTAGCCGGAGGCCCAAGCTACAGCATCCCCACGGGAAGGCGTGACGGTAGGGTCTCAAACAATCTTGATGTAACCTTACCGGGTCCAACGATCTCCGTCTCTGGAGCCGTGAGTTTATTCACGAACAAAGGGATGAACACGTTCGATGCAGTAGCTCTTTTGGGTGCACACACTGTTGGTCAAGGAAATTGTGGTCTCTTTAGTGACAGAATCACTAGCTTCCAAGGAACTGGACGACCGGACCCGTCCATGGACCCCGCTTTGGTTACCAGCCTAAGGAACACATGCAGAAATAGCGCGACGGCGGCACTAGACCAGTCGAGTCCATTGAGATTCGACAACCAGTTCTTCAAGCAAATCCGTAAAAGGAGAGGAGTGTTGCAAGTTGACCAACGCCTCGCATCCGACCCACAGACTCGTGGGATTGTGGCTCGGTATGCTAATAACAACGCCTTCTTCAAGCGTCAGTTCGTTAGAGCAATGGTGAAGATGGGAGCAGTTGATGTGCTTACTGGTCGTAACGGTGAGATCAGAAGGAACTGCAGGAGATTCAACTAATGAACTACAGAAGCGTGGATATAATATTACATTTGATACAATATATTTCAAATCTTCTTTATATTTTTACTAATTCATTTTTGGTTTTGGTTGGGGTTTTCTTGCATAAATAAGGCTTTTCTTAAATTGGATGGTTTCGATTTTCGAGAAAGATTACTATATATTATATTGTTGGTCTGCATTTGGTGGATGTATCTTAAGTTTACAAATAATTTGTGATATTGAAATATTGATATGTATCTTTATCATGGTTAATCATATATATATATAT

SEQ ID NO: 1849 - DNA, 1308 bp, Arabidopsis thaliana
  misc_feature (1)..(1308): Ceres cDNA ID no. 12701687
  misc_feature (1)..(1308): Also known as  Ceres CDNA ID no. 23360242
atgtcggtcacagcgggagtgagtgaatctgcaattgctgtaagggagaaactaaaaggtggtattggacagactaaagtgcgaaggtattggccaggaaaagctccggagtgggctgaggaagctgaagaagatgatgatgttaggatgcagaaggtttctgttttggatagagcttttccaaagaatgatgatttgggtgttgctaggaaggatgatccaaggctgcgccgtttagctaagactaaagttgaaaaccgtgacgaagttagagctgatcatcggcggataagacaggctgagattatttatacggaagaagaagaatcgaggaatcaagagaatagagacgaggacgatgatgaagatgccttggaagagagaagaagaagaattagagagaaaaatcttagaagagcgcaagaggaggctgctttacttcctttagaagaagaagatgagatacaagaggaagaagaggaggaggaggagtctgagtacgagactgattcggaagatgatatgcctggtattgccatgattaagcctgtttttgtaccgaaagctgagagagatacaattgcagagcgagagaggcttgaggctgaagaagaagctcttgaagaattagcaaagagaaaattggagcaaagaaaattagagacaaagcaaatagtggttgaggaagttaggaaagatgaagagatacggaagaacattctattggaggaagcaaatattggagatgtggaaactgatgatgaactcaatgaagctgaggagtatgaagtttggaagacaagagagattggtaggatcaagagagaaagagatgcaagggaagctatgctgagagagagggaagaaatagagaagttgaggaatatgacagagcaggagaggagagattgggagaggaagaatccgaaacctttgtcagctcaaccgaaaaagaaatggaactttatgcagaaatattaccacaagggtgccttcttccaggcagatcctgatgatgaggcaggttctgctggaaccgatggtatatttcagcgcgacttctctgctccaactggagaagataggttggacaaatcgattctccccaaagttatgcaagtcaagcactttggtcgtagtggaagaactaaatggactcaccttgtcaatgaggacacaacagattggagtaacccgtggacttccaatgatcctctacgtgaaaaatacaacaagaaaatggcaggcatggatgctcctatcgcaaaaccaaaagggagcaagaagatgaaagattgggagtcttaa

SEQ ID NO: 1850 - protein, 1308 aa, Arabidopsis thaliana
  misc_feature: PFam Name: peroxidase; PFam Description: Peroxidase
  misc_feature: GI Number: 21593467; NR Description: peroxidase ATP13a
  misc_feature: GI Number: 31745133; NR Description: putative peroxidase [Arabidopsis thaliana] >gi|9759059|dbj|BAB09581.1| peroxidase [Arabidopsis thaliana] >gi|1429219|emb|CAA67312.1| peroxidase ATP13a [Arabidopsis thaliana] >gi|1402900|emb|CAA66966.1|
  misc_feature: GI Number: 21593692; NR Description: putative peroxidase
  misc_feature: GI Number: 51970002; NR Description: putative peroxidase
ATGTCGGTCACAGCGGGAGTGAGTGAATCTGCAATTGCTGTAAGGGAGAAACTAAAAGGTGGTATTGGACAGACTAAAGTGCGAAGGTATTGGCCAGGAAAAGCTCCGGAGTGGGCTGAGGAAGCTGAAGAAGATGATGATGTTAGGATGCAGAAGGTTTCTGTTTTGGATAGAGCTTTTCCAAAGAATGATGATTTGGGTGTTGCTAGGAAGGATGATCCAAGGCTGCGCCGTTTAGCTAAGACTAAAGTTGAAAACCGTGACGAAGTTAGAGCTGATCATCGGCGGATAAGACAGGCTGAGATTATTTATACGGAAGAAGAAGAATCGAGGAATCAAGAGAATAGAGACGAGGACGATGATGAAGATGCCTTGGAAGAGAGAAGAAGAAGAATTAGAGAGAAAAATCTTAGAAGAGCGCAAGAGGAGGCTGCTTTACTTCCTTTAGAAGAAGAAGATGAGATACAAGAGGAAGAAGAGGAGGAGGAGGAGTCTGAGTACGAGACTGATTCGGAAGATGATATGCCTGGTATTGCCATGATTAAGCCTGTTTTTGTACCGAAAGCTGAGAGAGATACAATTGCAGAGCGAGAGAGGCTTGAGGCTGAAGAAGAAGCTCTTGAAGAATTAGCAAAGAGAAAATTGGAGCAAAGAAAATTAGAGACAAAGCAAATAGTGGTTGAGGAAGTTAGGAAAGATGAAGAGATACGGAAGAACATTCTATTGGAGGAAGCAAATATTGGAGATGTGGAAACTGATGATGAACTCAATGAAGCTGAGGAGTATGAAGTTTGGAAGACAAGAGAGATTGGTAGGATCAAGAGAGAAAGAGATGCAAGGGAAGCTATGCTGAGAGAGAGGGAAGAAATAGAGAAGTTGAGGAATATGACAGAGCAGGAGAGGAGAGATTGGGAGAGGAAGAATCCGAAACCTTTGTCAGCTCAACCGAAAAAGAAATGGAACTTTATGCAGAAATATTACCACAAGGGTGCCTTCTTCCAGGCAGATCCTGATGATGAGGCAGGTTCTGCTGGAACCGATGGTATATTTCAGCGCGACTTCTCTGCTCCAACTGGAGAAGATAGGTTGGACAAATCGATTCTCCCCAAAGTTATGCAAGTCAAGCACTTTGGTCGTAGTGGAAGAACTAAATGGACTCACCTTGTCAATGAGGACACAACAGATTGGAGTAACCCGTGGACTTCCAATGATCCTCTACGTGAAAAATACAACAAGAAAATGGCAGGCATGGATGCTCCTATCGCAAAACCAAAAGGGAGCAAGAAGATGAAAGATTGGGAGTCTTAA

SEQ ID NO: 1851 - DNA, 1243 bp, Arabidopsis thaliana
  misc_feature (1)..(1243): Ceres cDNA ID no. 12701822
  misc_feature (1)..(1243): Also known as  Ceres CDNA ID no. 23360242
agatttgagactatctatttacattctgattatttcttaagaagaagcggccatggaagtcaaaggagcaacccggagctctatcatagttccttctgttcaagagatggtgaaggagaagatgatcacgacggttcctccgaggtatgtacggtctgatcaagacgtagctgagatagccgttgattctggtctaagaaaccagatcccaatcatagacatgagtcttctgtgttcttcaacctccatggattctgagattgacaagcttgactctgcttgcaaagagtggggattttttcagcttgtaaaccatggaatggagtcaagtttcttgaacaaagtaaagtcagaggttcaagacttcttcaaccttcccatggaagagaagaagaatttgtggcaacaacccgatgagatcgaagggtttggacaagtatttgtggtttcagaagagcagaaactcgattgggcagatatgttcttccttacaatgcaacctgttcgattacgcaagcctcacttgttccccaagttacctctgccctttagagatacactagacatgtattcggctgaagtgaaaagcattgctaagatcttacttgggaaaatagcggtagctctgaagatcaaacccgaggaaatggataagttgtttgatgatgagttagggcagagaattaggctgaattactacccgcgttgtccagagcccgataaggttattggtctaactccgcattctgattctacaggactcaccatactgttgcaggctaatgaagttgaaggtctccaaatcaagaaaaatgccaagtgggtttctgtcaaacctctcccaaatgctttggttgtcaatgtcggagacatcttagagataataacgaatgggacataccgaagtatagagcatcgtggagttgtgaactcagagaaagagagactttcggtggcggcattccacaatataggattgggtaaagaaattggtcctatgagaagtctcgtggaaaggcacaaggctgcatttttcaaaagcgtgactactgaagagtatttcaatggcttgttttcccgtgagctcgatggaaaagcttaccttgatgttatgagactctaaaaggaaacaattcataaaaatattggcttgtgccccaagaaaccaatcacattttctgacccttcctattgtagtgtatatactctgtttctcctctgtttcatgcttttgcaaatagcc

SEQ ID NO: 1852 - protein, 1243 aa, Arabidopsis thaliana
  misc_feature: PFam Name: peroxidase; PFam Description: Peroxidase
  misc_feature: GI Number: 21593467; NR Description: peroxidase ATP13a
  misc_feature: GI Number: 31745133; NR Description: putative peroxidase [Arabidopsis thaliana] >gi|9759059|dbj|BAB09581.1| peroxidase [Arabidopsis thaliana] >gi|1429219|emb|CAA67312.1| peroxidase ATP13a [Arabidopsis thaliana] >gi|1402900|emb|CAA66966.1|
  misc_feature: GI Number: 21593692; NR Description: putative peroxidase
  misc_feature: GI Number: 51970002; NR Description: putative peroxidase
AGATTTGAGACTATCTATTTACATTCTGATTATTTCTTAAGAAGAAGCGGCCATGGAAGTCAAAGGAGCAACCCGGAGCTCTATCATAGTTCCTTCTGTTCAAGAGATGGTGAAGGAGAAGATGATCACGACGGTTCCTCCGAGGTATGTACGGTCTGATCAAGACGTAGCTGAGATAGCCGTTGATTCTGGTCTAAGAAACCAGATCCCAATCATAGACATGAGTCTTCTGTGTTCTTCAACCTCCATGGATTCTGAGATTGACAAGCTTGACTCTGCTTGCAAAGAGTGGGGATTTTTTCAGCTTGTAAACCATGGAATGGAGTCAAGTTTCTTGAACAAAGTAAAGTCAGAGGTTCAAGACTTCTTCAACCTTCCCATGGAAGAGAAGAAGAATTTGTGGCAACAACCCGATGAGATCGAAGGGTTTGGACAAGTATTTGTGGTTTCAGAAGAGCAGAAACTCGATTGGGCAGATATGTTCTTCCTTACAATGCAACCTGTTCGATTACGCAAGCCTCACTTGTTCCCCAAGTTACCTCTGCCCTTTAGAGATACACTAGACATGTATTCGGCTGAAGTGAAAAGCATTGCTAAGATCTTACTTGGGAAAATAGCGGTAGCTCTGAAGATCAAACCCGAGGAAATGGATAAGTTGTTTGATGATGAGTTAGGGCAGAGAATTAGGCTGAATTACTACCCGCGTTGTCCAGAGCCCGATAAGGTTATTGGTCTAACTCCGCATTCTGATTCTACAGGACTCACCATACTGTTGCAGGCTAATGAAGTTGAAGGTCTCCAAATCAAGAAAAATGCCAAGTGGGTTTCTGTCAAACCTCTCCCAAATGCTTTGGTTGTCAATGTCGGAGACATCTTAGAGATAATAACGAATGGGACATACCGAAGTATAGAGCATCGTGGAGTTGTGAACTCAGAGAAAGAGAGACTTTCGGTGGCGGCATTCCACAATATAGGATTGGGTAAAGAAATTGGTCCTATGAGAAGTCTCGTGGAAAGGCACAAGGCTGCATTTTTCAAAAGCGTGACTACTGAAGAGTATTTCAATGGCTTGTTTTCCCGTGAGCTCGATGGAAAAGCTTACCTTGATGTTATGAGACTCTAAAAGGAAACAATTCATAAAAATATTGGCTTGTGCCCCAAGAAACCAATCACATTTTCTGACCCTTCCTATTGTAGTGTATATACTCTGTTTCTCCTCTGTTTCATGCTTTTGCAAATAGCC

SEQ ID NO: 1853 - DNA, 1467 bp, Arabidopsis thaliana
  misc_feature (1)..(1467): Ceres cDNA ID no. 12701978
  misc_feature (1)..(1467): Also known as  Ceres CDNA ID no. 23360242
atgttcatcctcagagttcattccgttgactccgagagaccaatctccgttgaagaagaagaatcaggtttcacttacgcatcgaaaagagctcagcctcctcttaaactcatacaaccatctctcaaactcaccgaccgcaaaggcttgatccatctctatcgcaaatcttcacatagctctctgcctaaccctagctcccgatccaccactctcttcatcgtcgctgttcccaattatctctcctctctcgattttatccgtttctgtgattcccgcatctcccaagtctccgacatcctcttcatcaggaacgatggaatggaagatagatatagtgttcttatcacattttctgatcaatccgaagctgatggtttctacaacaacttgaatgggaaaaagttcgcaccatctgaggctgaggtttgtcatattctatatgtaatgtcggtggaacacacagaatttgatgaggttgctgcagaagcacctactggatttaccgagttacctacgtgtccaatatgtcttgagagattagatcctgacaccagtggtatagttagcactctttgtgatcactcgtttcagtgttcttgcacttcgaaatggacttatctgtcttgtcaggtttgtcgattgtgtcaacagcaagatgagatattaaactgttctatttgtggaaaaactgagaatgtatgggcatgccttgtctgtggcttcgtaggttgtggaagatacaaggaagggcattctattaggcactggaaagaaacgcatcactgctattctcttgatttgcgaacacaacaaatctgggattatgttggtgacagctatgttcatcggttaaaccattcaaaaattgatggaaagtcagtagagatgagcaccagttgtctgtcacaccagggggactgtggcctctgtgagtgtagtgaggatacaggaattagcggagctatctttaacagcaaagttgattcaattgtaatcgagtataatgaccttcttgcaagtcaactaaagggacagcgacagtactatgaatctctcattgttgaggcgagaagcaagcaagaaagtagtattgccgaagcagtagagcaaattgttgttaacacaatgcaggagcttcagaataagattgaaaaatgtgaagaggaaaaaagtggtatcactgaagttaacacaaaacttataaaagagcaggatacttggcggaagaaggccaaagaaatagaagagagggaagctgcattgctaggatcaaaagacgagatgataactgatcttcaagaacagataagagatattacggtcttcattgaagccaagaaaaccttaaagaagatgtcatcagatacggatggtatacgcgaaggaaccgtcttaccagtgcctatcagtcccgagccagtttcctcagttagaaggcaaaagaagtcaaaccggagaaagtaa

SEQ ID NO: 1854 - protein, 1467 aa, Arabidopsis thaliana
  misc_feature: PFam Name: peroxidase; PFam Description: Peroxidase
  misc_feature: GI Number: 21593467; NR Description: peroxidase ATP13a
  misc_feature: GI Number: 31745133; NR Description: putative peroxidase [Arabidopsis thaliana] >gi|9759059|dbj|BAB09581.1| peroxidase [Arabidopsis thaliana] >gi|1429219|emb|CAA67312.1| peroxidase ATP13a [Arabidopsis thaliana] >gi|1402900|emb|CAA66966.1|
  misc_feature: GI Number: 21593692; NR Description: putative peroxidase
  misc_feature: GI Number: 51970002; NR Description: putative peroxidase
ATGTTCATCCTCAGAGTTCATTCCGTTGACTCCGAGAGACCAATCTCCGTTGAAGAAGAAGAATCAGGTTTCACTTACGCATCGAAAAGAGCTCAGCCTCCTCTTAAACTCATACAACCATCTCTCAAACTCACCGACCGCAAAGGCTTGATCCATCTCTATCGCAAATCTTCACATAGCTCTCTGCCTAACCCTAGCTCCCGATCCACCACTCTCTTCATCGTCGCTGTTCCCAATTATCTCTCCTCTCTCGATTTTATCCGTTTCTGTGATTCCCGCATCTCCCAAGTCTCCGACATCCTCTTCATCAGGAACGATGGAATGGAAGATAGATATAGTGTTCTTATCACATTTTCTGATCAATCCGAAGCTGATGGTTTCTACAACAACTTGAATGGGAAAAAGTTCGCACCATCTGAGGCTGAGGTTTGTCATATTCTATATGTAATGTCGGTGGAACACACAGAATTTGATGAGGTTGCTGCAGAAGCACCTACTGGATTTACCGAGTTACCTACGTGTCCAATATGTCTTGAGAGATTAGATCCTGACACCAGTGGTATAGTTAGCACTCTTTGTGATCACTCGTTTCAGTGTTCTTGCACTTCGAAATGGACTTATCTGTCTTGTCAGGTTTGTCGATTGTGTCAACAGCAAGATGAGATATTAAACTGTTCTATTTGTGGAAAAACTGAGAATGTATGGGCATGCCTTGTCTGTGGCTTCGTAGGTTGTGGAAGATACAAGGAAGGGCATTCTATTAGGCACTGGAAAGAAACGCATCACTGCTATTCTCTTGATTTGCGAACACAACAAATCTGGGATTATGTTGGTGACAGCTATGTTCATCGGTTAAACCATTCAAAAATTGATGGAAAGTCAGTAGAGATGAGCACCAGTTGTCTGTCACACCAGGGGGACTGTGGCCTCTGTGAGTGTAGTGAGGATACAGGAATTAGCGGAGCTATCTTTAACAGCAAAGTTGATTCAATTGTAATCGAGTATAATGACCTTCTTGCAAGTCAACTAAAGGGACAGCGACAGTACTATGAATCTCTCATTGTTGAGGCGAGAAGCAAGCAAGAAAGTAGTATTGCCGAAGCAGTAGAGCAAATTGTTGTTAACACAATGCAGGAGCTTCAGAATAAGATTGAAAAATGTGAAGAGGAAAAAAGTGGTATCACTGAAGTTAACACAAAACTTATAAAAGAGCAGGATACTTGGCGGAAGAAGGCCAAAGAAATAGAAGAGAGGGAAGCTGCATTGCTAGGATCAAAAGACGAGATGATAACTGATCTTCAAGAACAGATAAGAGATATTACGGTCTTCATTGAAGCCAAGAAAACCTTAAAGAAGATGTCATCAGATACGGATGGTATACGCGAAGGAACCGTCTTACCAGTGCCTATCAGTCCCGAGCCAGTTTCCTCAGTTAGAAGGCAAAAGAAGTCAAACCGGAGAAAGTAA

SEQ ID NO: 1855 - DNA, 795 bp, Arabidopsis thaliana
  misc_feature (1)..(795): Ceres cDNA ID no. 12702692
  misc_feature (1)..(795): Also known as  Ceres CDNA ID no. 23360242
atgacttgcacagaactgagaaggatgggaaacgaatcatatgaagacgccatcgaagctctcaagaatgagaaggatgatctgaaggatgtagctgcggccaaggtgaagaagatcacggcggagcttcaggcagcctcgtcatcggacagcaaatcttttgatcccgtcgaacgaattaaggaaggcttcgtcaccttcaagaaggagaaatacgagaccaatcctgctttgtatggtgagctcgccaaaggtcaaagcccaaagtacatggtgtttgcttgttcggactcacgagtgtgcccatcacacgtactagacttccatcctggagatgccttcgtggttcgtaatatcgccaatatggttcctccttttgacaaggtcaaatatgcaggagttggagccgccattgaatacgctgtcttgcaccttaaggtggaaaacattgtggtgatagggcacagtgcatgtggtggcatcaaggggcttatgtcatttcctcttgacggaaacaactctactgacttcatagaggattgggtcaaaatctgtttaccagcaaagtcaaaagttttggcagaaagtgaaagttcagcatttgaagaccaatgtggccgatgcgaaagggaggcagtgaatgtgtcactagcaaacctattgacatatccatttgtgagagaaggagttgtgaaaggaacacttgctttgaagggaggctactatgactttgttaatggctcctttgagctttgggagctccagtttggaatttcccccgttcattctatatga

SEQ ID NO: 1856 - protein, 795 aa, Arabidopsis thaliana
  misc_feature: PFam Name: peroxidase; PFam Description: Peroxidase
  misc_feature: GI Number: 21593467; NR Description: peroxidase ATP13a
  misc_feature: GI Number: 31745133; NR Description: putative peroxidase [Arabidopsis thaliana] >gi|9759059|dbj|BAB09581.1| peroxidase [Arabidopsis thaliana] >gi|1429219|emb|CAA67312.1| peroxidase ATP13a [Arabidopsis thaliana] >gi|1402900|emb|CAA66966.1|
  misc_feature: GI Number: 21593692; NR Description: putative peroxidase
  misc_feature: GI Number: 51970002; NR Description: putative peroxidase
ATGACTTGCACAGAACTGAGAAGGATGGGAAACGAATCATATGAAGACGCCATCGAAGCTCTCAAGAATGAGAAGGATGATCTGAAGGATGTAGCTGCGGCCAAGGTGAAGAAGATCACGGCGGAGCTTCAGGCAGCCTCGTCATCGGACAGCAAATCTTTTGATCCCGTCGAACGAATTAAGGAAGGCTTCGTCACCTTCAAGAAGGAGAAATACGAGACCAATCCTGCTTTGTATGGTGAGCTCGCCAAAGGTCAAAGCCCAAAGTACATGGTGTTTGCTTGTTCGGACTCACGAGTGTGCCCATCACACGTACTAGACTTCCATCCTGGAGATGCCTTCGTGGTTCGTAATATCGCCAATATGGTTCCTCCTTTTGACAAGGTCAAATATGCAGGAGTTGGAGCCGCCATTGAATACGCTGTCTTGCACCTTAAGGTGGAAAACATTGTGGTGATAGGGCACAGTGCATGTGGTGGCATCAAGGGGCTTATGTCATTTCCTCTTGACGGAAACAACTCTACTGACTTCATAGAGGATTGGGTCAAAATCTGTTTACCAGCAAAGTCAAAAGTTTTGGCAGAAAGTGAAAGTTCAGCATTTGAAGACCAATGTGGCCGATGCGAAAGGGAGGCAGTGAATGTGTCACTAGCAAACCTATTGACATATCCATTTGTGAGAGAAGGAGTTGTGAAAGGAACACTTGCTTTGAAGGGAGGCTACTATGACTTTGTTAATGGCTCCTTTGAGCTTTGGGAGCTCCAGTTTGGAATTTCCCCCGTTCATTCTATATGA

SEQ ID NO: 1857 - DNA, 1205 bp, Arabidopsis thaliana
  misc_feature (1)..(1205): Ceres cDNA ID no. 12703052
  misc_feature (1)..(1205): Also known as  Ceres CDNA ID no. 23360242
aacgccagttgccatccaggggaggggagaagaagaatttgtattctcaagttgtcgatatgagagagatgaagtcagaaacacgtttgtgagagaacagcttttagatgtgattgtggatcagattctcaaagacttttcgcgaagagtctctgatccttaaatcgcttctctctcgcttgacctcatttcgtcgtcgaaatcagatccttgtgaaaatgccgaaacaggatatggagaagatggagcttcgtaagaacttccgtaatgtttggcataccgatcttacccacagtatccagaacgatactccttattgttgcttcgcgttgtggtgtgccccttgtgcatcatacttgcttcgcaagcgtgcgctttacgatgatatgtcaaggtacgtctgctgtgccggttacatgccttgtagtggtaggtgtggagaagccaaatgtcctcaactttgtcttgccactgaggtcttctgctgctttgcaaactctgtggcctcaactcgctttcttctgcaagatgagttccaaattcaaacgacaaaatgtgacaactgcatcattggtttcatggtttgcctcagccaagtggcttgcatattctccatagttgcatgtattgtcggtatggatgagctttcagaagcttctcagatactcacatgttgctctgacatggtgtactgcacggtttgcgcatgtatgcagacacaacacaagatggaaatggacaagagggacggtaagttcgggccacagccaatggcagtgcctccggctcagcaaatgtcacggtttgatcaagccaccccacccgcagtcggttatcctccacaacaaggttatccaccttctggttatcctcaacaccctccacaaggttatccaccttctggctatcctcaaaaccctcctccctcagcttattctcaataccctcctggggcttatcctcctcctcccgcttacccaaagtgatcactctttgcctgttttctctcccgattggaaaattttatttcatctttttttaatgctgtcttgttacgggtcaagaattgaacgttcgctgattgttttgaggtcgttgtttgtatgagattttgacctcgcatgttgttgttgttttctgaaacgtccctcttggactaagagatttcatgactttttcctttccttttaaattctctctttttc

SEQ ID NO: 1858 - protein, 1205 aa, Arabidopsis thaliana
  misc_feature: PFam Name: peroxidase; PFam Description: Peroxidase
  misc_feature: GI Number: 21593467; NR Description: peroxidase ATP13a
  misc_feature: GI Number: 31745133; NR Description: putative peroxidase [Arabidopsis thaliana] >gi|9759059|dbj|BAB09581.1| peroxidase [Arabidopsis thaliana] >gi|1429219|emb|CAA67312.1| peroxidase ATP13a [Arabidopsis thaliana] >gi|1402900|emb|CAA66966.1|
  misc_feature: GI Number: 21593692; NR Description: putative peroxidase
  misc_feature: GI Number: 51970002; NR Description: putative peroxidase
AACGCCAGTTGCCATCCAGGGGAGGGGAGAAGAAGAATTTGTATTCTCAAGTTGTCGATATGAGAGAGATGAAGTCAGAAACACGTTTGTGAGAGAACAGCTTTTAGATGTGATTGTGGATCAGATTCTCAAAGACTTTTCGCGAAGAGTCTCTGATCCTTAAATCGCTTCTCTCTCGCTTGACCTCATTTCGTCGTCGAAATCAGATCCTTGTGAAAATGCCGAAACAGGATATGGAGAAGATGGAGCTTCGTAAGAACTTCCGTAATGTTTGGCATACCGATCTTACCCACAGTATCCAGAACGATACTCCTTATTGTTGCTTCGCGTTGTGGTGTGCCCCTTGTGCATCATACTTGCTTCGCAAGCGTGCGCTTTACGATGATATGTCAAGGTACGTCTGCTGTGCCGGTTACATGCCTTGTAGTGGTAGGTGTGGAGAAGCCAAATGTCCTCAACTTTGTCTTGCCACTGAGGTCTTCTGCTGCTTTGCAAACTCTGTGGCCTCAACTCGCTTTCTTCTGCAAGATGAGTTCCAAATTCAAACGACAAAATGTGACAACTGCATCATTGGTTTCATGGTTTGCCTCAGCCAAGTGGCTTGCATATTCTCCATAGTTGCATGTATTGTCGGTATGGATGAGCTTTCAGAAGCTTCTCAGATACTCACATGTTGCTCTGACATGGTGTACTGCACGGTTTGCGCATGTATGCAGACACAACACAAGATGGAAATGGACAAGAGGGACGGTAAGTTCGGGCCACAGCCAATGGCAGTGCCTCCGGCTCAGCAAATGTCACGGTTTGATCAAGCCACCCCACCCGCAGTCGGTTATCCTCCACAACAAGGTTATCCACCTTCTGGTTATCCTCAACACCCTCCACAAGGTTATCCACCTTCTGGCTATCCTCAAAACCCTCCTCCCTCAGCTTATTCTCAATACCCTCCTGGGGCTTATCCTCCTCCTCCCGCTTACCCAAAGTGATCACTCTTTGCCTGTTTTCTCTCCCGATTGGAAAATTTTATTTCATCTTTTTTTAATGCTGTCTTGTTACGGGTCAAGAATTGAACGTTCGCTGATTGTTTTGAGGTCGTTGTTTGTATGAGATTTTGACCTCGCATGTTGTTGTTGTTTTCTGAAACGTCCCTCTTGGACTAAGAGATTTCATGACTTTTTCCTTTCCTTTTAAATTCTCTCTTTTTC

SEQ ID NO: 1859 - DNA, 1719 bp, Arabidopsis thaliana
  misc_feature (1)..(1719): Ceres cDNA ID no. 12703108
  misc_feature (1)..(1719): Also known as  Ceres CDNA ID no. 23360242
atgcggcgtagtcttgagagtctgcctcctcaccttgctgatgctctcctccgtcgcctcctcaaaaagcggcttcttttcccttcgttactcgaaggattcaaatattctgtagagaatatagatctccgaggcaaaagctcagttaacgcagaatggatggcttacattggaggcttcgttaatctaattactctaaatctttcagattgccagagaatcaacagttccaccctctggcctatcacaggattaacaagtttgacagagttggacctttcaagatgtttcaaggttacggatgctggtatgaagcacctccaatctgttgtaaatctgaaaaagttgtggatttcacagacaggtgtcactgaagttggaatttctcttcttgcttcacttaaaaaattgtctcttttggatttgggcggcttacctgtaactgatcagaacttgatttctctccaggcactgacaaagctagagtaccttgacatctggggaagcaacgtaaccaaccaaggagctgtcagtattctcaaattttctaacttgagcttcctaaacctctcgtggacaagcatcacacagactccaaacattccgcaccttgaatgcttacacatgaacacgtgcaccattgtctccgaaccaaaaactcatagctcattagcttccttgaaaaagctagttttatcgggagctaatttcagtgccgagacagagtccttgtcctttaccaacaaaagctgtataacctacttagacgtttccaagacttccctcaaaaacttcagcttcttagaaactatgtttaacctagaacatcttgatctgagctccacagctttcggggatgattctgttgggtttgtagcatgtgttggtgagaatctaaagaatcttaatgtctcggatacacaaatcactccttctggggtcgggaatcttgctggacatgtgccacaacttgagacattatctatgtcccagacatttgtcgacgatctttccatcttgcttatcagcaccacgatgccttgcattaaagcccttgacttgggcatgaacagcaccctaggattctactatctaatatctccacaagaagaaaaagagaagtcactagcagcactacaatctctaacttcccttgaaaccctgagtctagaacatccgtacctgggtgacaaagctctttccggtctaagtagccttactggattaacacatttgtccctaacaagcacatccctcacagattccacactccaccatctctcctctcttccaaacctagtcagtctcggagtccgagatggagttttgaccagcaatggtcttgagaagtttagaccacctaacaggctaagaacactcgacctccaaggttgttggcttttaaccaaagatgatattgctggtctctgcaaaaggtaccctcacatcaaggtgaggcatgagcatgctgactcttcttctctcgaccagaatcaacttcttcctcggtcatctactccacagagttttggaaaggtagcaaggaggaacaaccagaggccggagagttctgttgctgttcccaggagttttttagatcagagggtgaagtacaatagggaagagttggttgctctacaaaattcgcctttatcacaattgctgccatgggaagaacttgtcagtgtaccggaacttcttgctgattccgtgatttga

SEQ ID NO: 1860 - protein, 1719 aa, Arabidopsis thaliana
  misc_feature: PFam Name: peroxidase; PFam Description: Peroxidase
  misc_feature: GI Number: 21593467; NR Description: peroxidase ATP13a
  misc_feature: GI Number: 31745133; NR Description: putative peroxidase [Arabidopsis thaliana] >gi|9759059|dbj|BAB09581.1| peroxidase [Arabidopsis thaliana] >gi|1429219|emb|CAA67312.1| peroxidase ATP13a [Arabidopsis thaliana] >gi|1402900|emb|CAA66966.1|
  misc_feature: GI Number: 21593692; NR Description: putative peroxidase
  misc_feature: GI Number: 51970002; NR Description: putative peroxidase
ATGCGGCGTAGTCTTGAGAGTCTGCCTCCTCACCTTGCTGATGCTCTCCTCCGTCGCCTCCTCAAAAAGCGGCTTCTTTTCCCTTCGTTACTCGAAGGATTCAAATATTCTGTAGAGAATATAGATCTCCGAGGCAAAAGCTCAGTTAACGCAGAATGGATGGCTTACATTGGAGGCTTCGTTAATCTAATTACTCTAAATCTTTCAGATTGCCAGAGAATCAACAGTTCCACCCTCTGGCCTATCACAGGATTAACAAGTTTGACAGAGTTGGACCTTTCAAGATGTTTCAAGGTTACGGATGCTGGTATGAAGCACCTCCAATCTGTTGTAAATCTGAAAAAGTTGTGGATTTCACAGACAGGTGTCACTGAAGTTGGAATTTCTCTTCTTGCTTCACTTAAAAAATTGTCTCTTTTGGATTTGGGCGGCTTACCTGTAACTGATCAGAACTTGATTTCTCTCCAGGCACTGACAAAGCTAGAGTACCTTGACATCTGGGGAAGCAACGTAACCAACCAAGGAGCTGTCAGTATTCTCAAATTTTCTAACTTGAGCTTCCTAAACCTCTCGTGGACAAGCATCACACAGACTCCAAACATTCCGCACCTTGAATGCTTACACATGAACACGTGCACCATTGTCTCCGAACCAAAAACTCATAGCTCATTAGCTTCCTTGAAAAAGCTAGTTTTATCGGGAGCTAATTTCAGTGCCGAGACAGAGTCCTTGTCCTTTACCAACAAAAGCTGTATAACCTACTTAGACGTTTCCAAGACTTCCCTCAAAAACTTCAGCTTCTTAGAAACTATGTTTAACCTAGAACATCTTGATCTGAGCTCCACAGCTTTCGGGGATGATTCTGTTGGGTTTGTAGCATGTGTTGGTGAGAATCTAAAGAATCTTAATGTCTCGGATACACAAATCACTCCTTCTGGGGTCGGGAATCTTGCTGGACATGTGCCACAACTTGAGACATTATCTATGTCCCAGACATTTGTCGACGATCTTTCCATCTTGCTTATCAGCACCACGATGCCTTGCATTAAAGCCCTTGACTTGGGCATGAACAGCACCCTAGGATTCTACTATCTAATATCTCCACAAGAAGAAAAAGAGAAGTCACTAGCAGCACTACAATCTCTAACTTCCCTTGAAACCCTGAGTCTAGAACATCCGTACCTGGGTGACAAAGCTCTTTCCGGTCTAAGTAGCCTTACTGGATTAACACATTTGTCCCTAACAAGCACATCCCTCACAGATTCCACACTCCACCATCTCTCCTCTCTTCCAAACCTAGTCAGTCTCGGAGTCCGAGATGGAGTTTTGACCAGCAATGGTCTTGAGAAGTTTAGACCACCTAACAGGCTAAGAACACTCGACCTCCAAGGTTGTTGGCTTTTAACCAAAGATGATATTGCTGGTCTCTGCAAAAGGTACCCTCACATCAAGGTGAGGCATGAGCATGCTGACTCTTCTTCTCTCGACCAGAATCAACTTCTTCCTCGGTCATCTACTCCACAGAGTTTTGGAAAGGTAGCAAGGAGGAACAACCAGAGGCCGGAGAGTTCTGTTGCTGTTCCCAGGAGTTTTTTAGATCAGAGGGTGAAGTACAATAGGGAAGAGTTGGTTGCTCTACAAAATTCGCCTTTATCACAATTGCTGCCATGGGAAGAACTTGTCAGTGTACCGGAACTTCTTGCTGATTCCGTGATTTGA

SEQ ID NO: 1861 - DNA, 1530 bp, Arabidopsis thaliana
  misc_feature (1)..(1530): Ceres cDNA ID no. 12703185
  misc_feature (1)..(1530): Also known as  Ceres CDNA ID no. 23360242
atggatgtagagcaaaagaaaccgttaatcgaatcatcagatcgtaatctacctgatttcaaaaaatcagtgaagcttaaatatgtgaagcttggttaccattaccttatcactcatggaatgtaccttttcctctccccattagtacttgtaatcgctgcacagatttcaactttctctgtcaccgatcttcgtagcctctgggagcatcttcagtacaatcttatctcagtggttgtttgttctatgctgcttgttttcttaatgactatttacttcatgactcgaccacgtcctgtctacttggtgaacttctcgtgctttaaacccgatgagtcacgaaaatgcactaaaaagatctttatggatcgttctaaactcactggctctttcacagaggagaatcttgagttccagcgtaagattctacaacgttcggggctcggggaatcgacttacttacccgaggctgtacttaatgttccgcctaacccgtgtatgaaagaagctcgaaaagaggccgagactgttatgtttggagctattgatgagcttcttgcgaagacgaatgtgaacccgaaggatattgggatcttgattgttaactgtagtttgtttaacccgacaccttcgttatctgctatggttgttaatcactataagctccgcgggaatatacttagttacaacttgggaggaatgggttgcagtgctggtttgatttctattgatcttgctaaacatcttcttcactctattcccaacacttatgcaatggtgattagtatggagaacattacgttgaactggtatttcgggaatgaccggtcgaagcttgtttctaattgtctgtttagaatgggaggtgcagcgattcttctttcgaacaaaagatgggacagaagaagatcgaaatatgagcttgttgatacggttaggactcacaagggagctgatgataagtgttttggttgcataactcaagaagaggattccgcaagtaagattggtgttaccttgtcgaaagaacttatggctgttgcgggtgatgctctaaagacaaatattacgacgttaggaccactggttttaccgacatctgaacagcttctgttctttgcaacgttagtgggaagaaaactcttcaagatgaagatcaagccttacatcccagacttcaaactagcgtttgagcatttctgcatccacgcaggagggagagctgttcttgatgaattggagaagaacttgaaactcacagagtggcatatggagccctcgaggatgacactctaccgttttggtaacacgtccagttcttctttgtggtatgaattagcatatagtgaggccaaaggaaggatcaagaaaggtgatagaatttggcagatagcttttggttcggggttcaagtgcaacagctcggtttggagagcggtaaggtcggtaaaccctaagaaagagaagaacccatggatggatgaaattcatgagttcccagttgaagtccccaaggtctccacaatctag

SEQ ID NO: 1862 - protein, 1530 aa, Arabidopsis thaliana
  misc_feature: PFam Name: peroxidase; PFam Description: Peroxidase
  misc_feature: GI Number: 21593467; NR Description: peroxidase ATP13a
  misc_feature: GI Number: 31745133; NR Description: putative peroxidase [Arabidopsis thaliana] >gi|9759059|dbj|BAB09581.1| peroxidase [Arabidopsis thaliana] >gi|1429219|emb|CAA67312.1| peroxidase ATP13a [Arabidopsis thaliana] >gi|1402900|emb|CAA66966.1|
  misc_feature: GI Number: 21593692; NR Description: putative peroxidase
  misc_feature: GI Number: 51970002; NR Description: putative peroxidase
ATGGATGTAGAGCAAAAGAAACCGTTAATCGAATCATCAGATCGTAATCTACCTGATTTCAAAAAATCAGTGAAGCTTAAATATGTGAAGCTTGGTTACCATTACCTTATCACTCATGGAATGTACCTTTTCCTCTCCCCATTAGTACTTGTAATCGCTGCACAGATTTCAACTTTCTCTGTCACCGATCTTCGTAGCCTCTGGGAGCATCTTCAGTACAATCTTATCTCAGTGGTTGTTTGTTCTATGCTGCTTGTTTTCTTAATGACTATTTACTTCATGACTCGACCACGTCCTGTCTACTTGGTGAACTTCTCGTGCTTTAAACCCGATGAGTCACGAAAATGCACTAAAAAGATCTTTATGGATCGTTCTAAACTCACTGGCTCTTTCACAGAGGAGAATCTTGAGTTCCAGCGTAAGATTCTACAACGTTCGGGGCTCGGGGAATCGACTTACTTACCCGAGGCTGTACTTAATGTTCCGCCTAACCCGTGTATGAAAGAAGCTCGAAAAGAGGCCGAGACTGTTATGTTTGGAGCTATTGATGAGCTTCTTGCGAAGACGAATGTGAACCCGAAGGATATTGGGATCTTGATTGTTAACTGTAGTTTGTTTAACCCGACACCTTCGTTATCTGCTATGGTTGTTAATCACTATAAGCTCCGCGGGAATATACTTAGTTACAACTTGGGAGGAATGGGTTGCAGTGCTGGTTTGATTTCTATTGATCTTGCTAAACATCTTCTTCACTCTATTCCCAACACTTATGCAATGGTGATTAGTATGGAGAACATTACGTTGAACTGGTATTTCGGGAATGACCGGTCGAAGCTTGTTTCTAATTGTCTGTTTAGAATGGGAGGTGCAGCGATTCTTCTTTCGAACAAAAGATGGGACAGAAGAAGATCGAAATATGAGCTTGTTGATACGGTTAGGACTCACAAGGGAGCTGATGATAAGTGTTTTGGTTGCATAACTCAAGAAGAGGATTCCGCAAGTAAGATTGGTGTTACCTTGTCGAAAGAACTTATGGCTGTTGCGGGTGATGCTCTAAAGACAAATATTACGACGTTAGGACCACTGGTTTTACCGACATCTGAACAGCTTCTGTTCTTTGCAACGTTAGTGGGAAGAAAACTCTTCAAGATGAAGATCAAGCCTTACATCCCAGACTTCAAACTAGCGTTTGAGCATTTCTGCATCCACGCAGGAGGGAGAGCTGTTCTTGATGAATTGGAGAAGAACTTGAAACTCACAGAGTGGCATATGGAGCCCTCGAGGATGACACTCTACCGTTTTGGTAACACGTCCAGTTCTTCTTTGTGGTATGAATTAGCATATAGTGAGGCCAAAGGAAGGATCAAGAAAGGTGATAGAATTTGGCAGATAGCTTTTGGTTCGGGGTTCAAGTGCAACAGCTCGGTTTGGAGAGCGGTAAGGTCGGTAAACCCTAAGAAAGAGAAGAACCCATGGATGGATGAAATTCATGAGTTCCCAGTTGAAGTCCCCAAGGTCTCCACAATCTAG

SEQ ID NO: 1863 - DNA, 2643 bp, Arabidopsis thaliana
  misc_feature (1)..(2643): Ceres cDNA ID no. 12704707
  misc_feature (1)..(2643): Also known as  Ceres CDNA ID no. 23360242
atgaagattcaccttttgttggccatgattggaacctttgtcgttataattggagcccaggatcaagaaggtttcatcagtttagattgtggattacctagtgacgaatctccttacgatgattcgtttaacggattaacattcacatcggattccactttcatccaaacaggaaaaattgatagtgtcgataaagatcttaacataaacttatcaaaacaatatttgactcttagatacttcccagaaggaaaacgtaattgttatagtcttgatgtcaagcgtggcacaacttatctcatcgtggttagctttgtatatggaaattatgatggtcttaaccgtgatccaaacttcgatatccatcttggtcccaataagtggaaaagaatagatttggatggagagaaagaaggtacaagagaagagatcatacacaaagccaggtcaaactctttggatatttgtcttgttaagacaggagaaactttgccaataatttcagccatagaaatacggccactaaggaataatacgtatgttacacaatctggttcgctgatgatgtctttccgggtttatcttagcaattcagatgcatctataaggtatgctgatgacgtccatgatcgtatttggtctccattcaacggatcttcacatacacatataacaactgatctcaatataaacaactcaaatgcatatgagattccaaaaaatatactccaaactgctgccataccaagaaacgccagtgcgccgctgattattacgtgggatccactacccattaatgcggaggtatacttgtacatgcactttgcggagattcaaacccttgaagccaacgagacgaggcagtttgacgttatcttgagaggaaactttaatcattcaggatttagtccaaccaagttaaaggtatttacattatacacagaagaaccaatgaaatgtggttcagaaggttgttatttacagctagtaaaaacaccgaactcaactctgccacctctgatcaacgctattgaggcatacagtgttatcgagttctcacaattggaaacaagtcttagtgatgtggacgctatcaagaacatcaaaaatacttataagctgaataaaatcacttggcaaggagatccatgtctccctcaagatttgtcgtgggaaagtattagatgcacctacgtagatggctccacttcaccaacaatcatttccttagatttgtcgaaaagtggattaaatgggagtataccccaaattttacaaaatttcacgcaattacaagaactggacttatcaaataatagcttgactggaccggtgcctatcttccttgccaacatgaaaacaaacttaagtgggaacaatctcagtggttcagttcctcaagctcttcttgacaaagaaaaagaaggacttgtgttaaaacttgaaggaaatccagatttgtgcaaatccagtttttgcaataccgaaaagaaaaataaattcttgctcccggttattgcatcagctgcctctttggttattgtagttgtggttgtggctcttttttttgtcttccgaaagaagaaggccagcccttcaaatctacatgctccaccaagtatgcctgtatcgaatcccgggcacaatagtcaatcagaatcatcattcacatcgaaaaaaattaggtttacttactctgaggttcaagaaatgacaaataacttcgataaagctctcggtgaaggaggatttggagtcgtgtatcatggttttgttaatgttattgaacaagtagcagttaaattgctatcacaatcatcttctcaaggctataagcatttcaaggcagaggtggaactccttatgagagttcaccatataaatttggtgagtcttgttgggtattgtgatgaaggagaacacttggctcttatttatgaatacatgccaaatggagacttaaagcaacatttgtcaggaaagcatggcggattcgtcctgagctgggaaagtagactaaaaatagttttggatgcagcactaggattggagtatttacatactggatgtgtaccaccaatggttcacagagatatcaaaactacgaatatacttctagatcaacatctccaagctaaattagctgattttgggctttcaagatcttttcccatcggaaatgagaaaaatgtgtcaactgttgttgctggtactcctggatatcttgatcctgagtattatcaaacaaattggttgacagaaaagagtgatatatacagtttcggaattgtactgttagagataatttcaaaccgtcctataatccagcaatcccgtgaaaagcctcacatagtggaatgggtcagttttatgataacaaaaggagatcttagaagtattatggatccaaacctccaccaagattatgatattggttctgtctggaaggccattgaattagcaatgtcatgtgtgagtctttcttctgcaagacgaccaaacatgtctcgagttgtgaatgaattaaaagaatgtcttatatccgaaacctctaggataggtgagggacgagacatggaatcaaaaggttcaatggaattcagcagagacatttataatgaggtaatacctcaagctcgctag

SEQ ID NO: 1864 - protein, 2643 aa, Arabidopsis thaliana
  misc_feature: PFam Name: peroxidase; PFam Description: Peroxidase
  misc_feature: GI Number: 21593467; NR Description: peroxidase ATP13a
  misc_feature: GI Number: 31745133; NR Description: putative peroxidase [Arabidopsis thaliana] >gi|9759059|dbj|BAB09581.1| peroxidase [Arabidopsis thaliana] >gi|1429219|emb|CAA67312.1| peroxidase ATP13a [Arabidopsis thaliana] >gi|1402900|emb|CAA66966.1|
  misc_feature: GI Number: 21593692; NR Description: putative peroxidase
  misc_feature: GI Number: 51970002; NR Description: putative peroxidase
ATGAAGATTCACCTTTTGTTGGCCATGATTGGAACCTTTGTCGTTATAATTGGAGCCCAGGATCAAGAAGGTTTCATCAGTTTAGATTGTGGATTACCTAGTGACGAATCTCCTTACGATGATTCGTTTAACGGATTAACATTCACATCGGATTCCACTTTCATCCAAACAGGAAAAATTGATAGTGTCGATAAAGATCTTAACATAAACTTATCAAAACAATATTTGACTCTTAGATACTTCCCAGAAGGAAAACGTAATTGTTATAGTCTTGATGTCAAGCGTGGCACAACTTATCTCATCGTGGTTAGCTTTGTATATGGAAATTATGATGGTCTTAACCGTGATCCAAACTTCGATATCCATCTTGGTCCCAATAAGTGGAAAAGAATAGATTTGGATGGAGAGAAAGAAGGTACAAGAGAAGAGATCATACACAAAGCCAGGTCAAACTCTTTGGATATTTGTCTTGTTAAGACAGGAGAAACTTTGCCAATAATTTCAGCCATAGAAATACGGCCACTAAGGAATAATACGTATGTTACACAATCTGGTTCGCTGATGATGTCTTTCCGGGTTTATCTTAGCAATTCAGATGCATCTATAAGGTATGCTGATGACGTCCATGATCGTATTTGGTCTCCATTCAACGGATCTTCACATACACATATAACAACTGATCTCAATATAAACAACTCAAATGCATATGAGATTCCAAAAAATATACTCCAAACTGCTGCCATACCAAGAAACGCCAGTGCGCCGCTGATTATTACGTGGGATCCACTACCCATTAATGCGGAGGTATACTTGTACATGCACTTTGCGGAGATTCAAACCCTTGAAGCCAACGAGACGAGGCAGTTTGACGTTATCTTGAGAGGAAACTTTAATCATTCAGGATTTAGTCCAACCAAGTTAAAGGTATTTACATTATACACAGAAGAACCAATGAAATGTGGTTCAGAAGGTTGTTATTTACAGCTAGTAAAAACACCGAACTCAACTCTGCCACCTCTGATCAACGCTATTGAGGCATACAGTGTTATCGAGTTCTCACAATTGGAAACAAGTCTTAGTGATGTGGACGCTATCAAGAACATCAAAAATACTTATAAGCTGAATAAAATCACTTGGCAAGGAGATCCATGTCTCCCTCAAGATTTGTCGTGGGAAAGTATTAGATGCACCTACGTAGATGGCTCCACTTCACCAACAATCATTTCCTTAGATTTGTCGAAAAGTGGATTAAATGGGAGTATACCCCAAATTTTACAAAATTTCACGCAATTACAAGAACTGGACTTATCAAATAATAGCTTGACTGGACCGGTGCCTATCTTCCTTGCCAACATGAAAACAAACTTAAGTGGGAACAATCTCAGTGGTTCAGTTCCTCAAGCTCTTCTTGACAAAGAAAAAGAAGGACTTGTGTTAAAACTTGAAGGAAATCCAGATTTGTGCAAATCCAGTTTTTGCAATACCGAAAAGAAAAATAAATTCTTGCTCCCGGTTATTGCATCAGCTGCCTCTTTGGTTATTGTAGTTGTGGTTGTGGCTCTTTTTTTTGTCTTCCGAAAGAAGAAGGCCAGCCCTTCAAATCTACATGCTCCACCAAGTATGCCTGTATCGAATCCCGGGCACAATAGTCAATCAGAATCATCATTCACATCGAAAAAAATTAGGTTTACTTACTCTGAGGTTCAAGAAATGACAAATAACTTCGATAAAGCTCTCGGTGAAGGAGGATTTGGAGTCGTGTATCATGGTTTTGTTAATGTTATTGAACAAGTAGCAGTTAAATTGCTATCACAATCATCTTCTCAAGGCTATAAGCATTTCAAGGCAGAGGTGGAACTCCTTATGAGAGTTCACCATATAAATTTGGTGAGTCTTGTTGGGTATTGTGATGAAGGAGAACACTTGGCTCTTATTTATGAATACATGCCAAATGGAGACTTAAAGCAACATTTGTCAGGAAAGCATGGCGGATTCGTCCTGAGCTGGGAAAGTAGACTAAAAATAGTTTTGGATGCAGCACTAGGATTGGAGTATTTACATACTGGATGTGTACCACCAATGGTTCACAGAGATATCAAAACTACGAATATACTTCTAGATCAACATCTCCAAGCTAAATTAGCTGATTTTGGGCTTTCAAGATCTTTTCCCATCGGAAATGAGAAAAATGTGTCAACTGTTGTTGCTGGTACTCCTGGATATCTTGATCCTGAGTATTATCAAACAAATTGGTTGACAGAAAAGAGTGATATATACAGTTTCGGAATTGTACTGTTAGAGATAATTTCAAACCGTCCTATAATCCAGCAATCCCGTGAAAAGCCTCACATAGTGGAATGGGTCAGTTTTATGATAACAAAAGGAGATCTTAGAAGTATTATGGATCCAAACCTCCACCAAGATTATGATATTGGTTCTGTCTGGAAGGCCATTGAATTAGCAATGTCATGTGTGAGTCTTTCTTCTGCAAGACGACCAAACATGTCTCGAGTTGTGAATGAATTAAAAGAATGTCTTATATCCGAAACCTCTAGGATAGGTGAGGGACGAGACATGGAATCAAAAGGTTCAATGGAATTCAGCAGAGACATTTATAATGAGGTAATACCTCAAGCTCGCTAG

SEQ ID NO: 1865 - DNA, 780 bp, Arabidopsis thaliana
  misc_feature (1)..(780): Ceres cDNA ID no. 12706463
  misc_feature (1)..(780): Also known as  Ceres CDNA ID no. 23360242
atgatttcaaatctcaactactgtataactttctcatctattcctcgtcaaaacccagttcaaaggataaatctaagttacaacaacactcgtctcacttaccaactagagcatataagtaagaattctccttgttttatgtcgactttgttgtctaagattgatgataatcagaaagatgtatccaagggattgactaagttccttaggtacaatccgataaacgagtttgaaccgtttttcgagagtttgggtttgtgtccttatgagtttgaaacgtttcttccacggaagctaatgtttttgagtgatgatggtatcatgtttgagaactttcatgctctttgcaactatgggatcccgcgtggtaagattggccgtatgtataaagaagcgagagagatttttagatatgaatctgggatgttggcgatgaagctaaggggttatgagaatttgggtcttagtaaggctacagttattaagttagttactagttgccctttgctactggttggtgggattgatgctgagttttcttctgtagttgataagttgaaagggttacaagtaggatgtgattggcttgggcggtacttgtctgaccggaaaacatatagctggcgcagaattctggagacaatagagtttcttgataaagtgggatgtaaagaggagaagttgagtagtcttttgaaaacgtatccagctttggtaatcgaaggctccggaaagaaattctatgttctgtttggttgtttaaagcggggcttcaagtga

SEQ ID NO: 1866 - protein, 780 aa, Arabidopsis thaliana
  misc_feature: PFam Name: peroxidase; PFam Description: Peroxidase
  misc_feature: GI Number: 21593467; NR Description: peroxidase ATP13a
  misc_feature: GI Number: 31745133; NR Description: putative peroxidase [Arabidopsis thaliana] >gi|9759059|dbj|BAB09581.1| peroxidase [Arabidopsis thaliana] >gi|1429219|emb|CAA67312.1| peroxidase ATP13a [Arabidopsis thaliana] >gi|1402900|emb|CAA66966.1|
  misc_feature: GI Number: 21593692; NR Description: putative peroxidase
  misc_feature: GI Number: 51970002; NR Description: putative peroxidase
ATGATTTCAAATCTCAACTACTGTATAACTTTCTCATCTATTCCTCGTCAAAACCCAGTTCAAAGGATAAATCTAAGTTACAACAACACTCGTCTCACTTACCAACTAGAGCATATAAGTAAGAATTCTCCTTGTTTTATGTCGACTTTGTTGTCTAAGATTGATGATAATCAGAAAGATGTATCCAAGGGATTGACTAAGTTCCTTAGGTACAATCCGATAAACGAGTTTGAACCGTTTTTCGAGAGTTTGGGTTTGTGTCCTTATGAGTTTGAAACGTTTCTTCCACGGAAGCTAATGTTTTTGAGTGATGATGGTATCATGTTTGAGAACTTTCATGCTCTTTGCAACTATGGGATCCCGCGTGGTAAGATTGGCCGTATGTATAAAGAAGCGAGAGAGATTTTTAGATATGAATCTGGGATGTTGGCGATGAAGCTAAGGGGTTATGAGAATTTGGGTCTTAGTAAGGCTACAGTTATTAAGTTAGTTACTAGTTGCCCTTTGCTACTGGTTGGTGGGATTGATGCTGAGTTTTCTTCTGTAGTTGATAAGTTGAAAGGGTTACAAGTAGGATGTGATTGGCTTGGGCGGTACTTGTCTGACCGGAAAACATATAGCTGGCGCAGAATTCTGGAGACAATAGAGTTTCTTGATAAAGTGGGATGTAAAGAGGAGAAGTTGAGTAGTCTTTTGAAAACGTATCCAGCTTTGGTAATCGAAGGCTCCGGAAAGAAATTCTATGTTCTGTTTGGTTGTTTAAAGCGGGGCTTCAAGTGA

SEQ ID NO: 1867 - DNA, 2337 bp, Arabidopsis thaliana
  misc_feature (1)..(2337): Ceres cDNA ID no. 12706876
  misc_feature (1)..(2337): Also known as  Ceres CDNA ID no. 23360242
atggcgacaagtgaagaacctagtacggatgcctccataatatgttatgcgccaagcatgatcaccaccaatggtgtttggcaaggcgataatcctctcgacttttcgctacctctctttgttcttcagctaactttggttgttgtcgtcactcgtttcttcgtctttatcctcaaaccctttcgccaacctcgtgtcatctccgagatccttggcggaattgttcttggaccatcggtgctagggcgctccacaaaatttgcacacactattttccctcaaagaagtgtgatggtacttgaaacaatggctaatgtgggtttactttacttcctattcttggtgggtgtagagatggacattatggttgtacgtaagacagggaagcgagccctaaccatcgctattggtggtatggttttaccattcctcattggtgctgccttctctttctctatgcatagatcagaagaccacttagggcaaggcacctatatacttttccttggtgttgcactctccgttactgcattcccggttcttgcaagaattcttgctgagctcaagctcatcaataccgagattgggcggatatcgatgtctgcagctttagttaacgacatgttcgcttggattcttttggccttagctattgcattggctgagagtgacaaaacttcatttgcctctctttgggttatgatctctagtgcagttttcattgccgtttgtgtttttgttgtgagaccaggcattgcttggatcatacgtaaaacccctgaaggagagaatttcagtgagttccacatatgcctaatcttgacaggagttatgatctccggtttcattactgatgcaatcggaacacattcagtctttggtgcttttgtgtttggtcttgtgattcccaatggacctcttggtctaaccctcattgagaagcttgaagatttcgtctctggccttctcctacctctcttctttgccataagtggtctcaagactaatatagctgccattcaaggccctgccacgtggttaactctgtttcttgtcattttcctcgcttgtgctggaaaggtcatcggtacagttattgttgcgtttttccatggaatgccagttcgtgaaggaatcactcttggactactcttgaacactaaaggtcttgttgaaatgattgtacttaatgttggaaaagaccaaaaggttttggatgatgagacatttgctactatggtacttgtggccttggttatgactggagtcattactcctattgtaacaatcctttacaagccagtgaagaaatctgtttcatacaagagacgaacaatccaacaaacgaagccagacagcgagcttcgggtattggtttgcgttcacacaccgcgtaatgttcctactataattaaccttcttgaagcttcacatcccacaaagagatctcctatatgcatctacgttctccaccttgttgagctcacgggccgcgcatccgcgatgttgattgtccacaacactcgtaagtcaggacgacccgcgcttaacagaactcaagctcaatcagatcatatcatcaacgcctttgagaactatgaacaacacgctgcctttgtcgctgtacaacctttaacagctatttcaccttactcaacaatgcatgaagatgtttgtagcttagcagaggacaaacgtgtctccttcataatcataccatttcacaaacaacaaacagttgatggaggaatggaatcaaccaacccggcctaccgtttagtcaaccaaaacctactcgaaaactcgccttgttcggtcggaatactcgtggatagaggactcaatggagcgacaagactcaactcaaacactgtttctcttcaagttgctgttctgtttttcggcggtccagacgatagagaagctttggcttatgcatggagaatggctcaacatcctggcatcactctaactgttttacgggcagaaaatgcggaatacgagtcaattgtgtatatagaaaaactagtgagcaatggggaagagactgttgcagcagtgagatcaatggacagttctcatgatttgtttatagttggaagaggagaaggaatgtcgtctcctcttaccgcgggtttaactgattggagtgagtgtcctgagcttggtgccattggagatttgcttgcttcatcagactttgcagctactgtgtcggttcttgtggttcaacagtatgttgggtcatgggcacaagaagatgatatggattttcctgagagtccagtacattcacatgaaacaaaagtcacatatggtttagagaatccacgttag

SEQ ID NO: 1868 - protein, 2337 aa, Arabidopsis thaliana
  misc_feature: PFam Name: peroxidase; PFam Description: Peroxidase
  misc_feature: GI Number: 21593467; NR Description: peroxidase ATP13a
  misc_feature: GI Number: 31745133; NR Description: putative peroxidase [Arabidopsis thaliana] >gi|9759059|dbj|BAB09581.1| peroxidase [Arabidopsis thaliana] >gi|1429219|emb|CAA67312.1| peroxidase ATP13a [Arabidopsis thaliana] >gi|1402900|emb|CAA66966.1|
  misc_feature: GI Number: 21593692; NR Description: putative peroxidase
  misc_feature: GI Number: 51970002; NR Description: putative peroxidase
ATGGCGACAAGTGAAGAACCTAGTACGGATGCCTCCATAATATGTTATGCGCCAAGCATGATCACCACCAATGGTGTTTGGCAAGGCGATAATCCTCTCGACTTTTCGCTACCTCTCTTTGTTCTTCAGCTAACTTTGGTTGTTGTCGTCACTCGTTTCTTCGTCTTTATCCTCAAACCCTTTCGCCAACCTCGTGTCATCTCCGAGATCCTTGGCGGAATTGTTCTTGGACCATCGGTGCTAGGGCGCTCCACAAAATTTGCACACACTATTTTCCCTCAAAGAAGTGTGATGGTACTTGAAACAATGGCTAATGTGGGTTTACTTTACTTCCTATTCTTGGTGGGTGTAGAGATGGACATTATGGTTGTACGTAAGACAGGGAAGCGAGCCCTAACCATCGCTATTGGTGGTATGGTTTTACCATTCCTCATTGGTGCTGCCTTCTCTTTCTCTATGCATAGATCAGAAGACCACTTAGGGCAAGGCACCTATATACTTTTCCTTGGTGTTGCACTCTCCGTTACTGCATTCCCGGTTCTTGCAAGAATTCTTGCTGAGCTCAAGCTCATCAATACCGAGATTGGGCGGATATCGATGTCTGCAGCTTTAGTTAACGACATGTTCGCTTGGATTCTTTTGGCCTTAGCTATTGCATTGGCTGAGAGTGACAAAACTTCATTTGCCTCTCTTTGGGTTATGATCTCTAGTGCAGTTTTCATTGCCGTTTGTGTTTTTGTTGTGAGACCAGGCATTGCTTGGATCATACGTAAAACCCCTGAAGGAGAGAATTTCAGTGAGTTCCACATATGCCTAATCTTGACAGGAGTTATGATCTCCGGTTTCATTACTGATGCAATCGGAACACATTCAGTCTTTGGTGCTTTTGTGTTTGGTCTTGTGATTCCCAATGGACCTCTTGGTCTAACCCTCATTGAGAAGCTTGAAGATTTCGTCTCTGGCCTTCTCCTACCTCTCTTCTTTGCCATAAGTGGTCTCAAGACTAATATAGCTGCCATTCAAGGCCCTGCCACGTGGTTAACTCTGTTTCTTGTCATTTTCCTCGCTTGTGCTGGAAAGGTCATCGGTACAGTTATTGTTGCGTTTTTCCATGGAATGCCAGTTCGTGAAGGAATCACTCTTGGACTACTCTTGAACACTAAAGGTCTTGTTGAAATGATTGTACTTAATGTTGGAAAAGACCAAAAGGTTTTGGATGATGAGACATTTGCTACTATGGTACTTGTGGCCTTGGTTATGACTGGAGTCATTACTCCTATTGTAACAATCCTTTACAAGCCAGTGAAGAAATCTGTTTCATACAAGAGACGAACAATCCAACAAACGAAGCCAGACAGCGAGCTTCGGGTATTGGTTTGCGTTCACACACCGCGTAATGTTCCTACTATAATTAACCTTCTTGAAGCTTCACATCCCACAAAGAGATCTCCTATATGCATCTACGTTCTCCACCTTGTTGAGCTCACGGGCCGCGCATCCGCGATGTTGATTGTCCACAACACTCGTAAGTCAGGACGACCCGCGCTTAACAGAACTCAAGCTCAATCAGATCATATCATCAACGCCTTTGAGAACTATGAACAACACGCTGCCTTTGTCGCTGTACAACCTTTAACAGCTATTTCACCTTACTCAACAATGCATGAAGATGTTTGTAGCTTAGCAGAGGACAAACGTGTCTCCTTCATAATCATACCATTTCACAAACAACAAACAGTTGATGGAGGAATGGAATCAACCAACCCGGCCTACCGTTTAGTCAACCAAAACCTACTCGAAAACTCGCCTTGTTCGGTCGGAATACTCGTGGATAGAGGACTCAATGGAGCGACAAGACTCAACTCAAACACTGTTTCTCTTCAAGTTGCTGTTCTGTTTTTCGGCGGTCCAGACGATAGAGAAGCTTTGGCTTATGCATGGAGAATGGCTCAACATCCTGGCATCACTCTAACTGTTTTACGGGCAGAAAATGCGGAATACGAGTCAATTGTGTATATAGAAAAACTAGTGAGCAATGGGGAAGAGACTGTTGCAGCAGTGAGATCAATGGACAGTTCTCATGATTTGTTTATAGTTGGAAGAGGAGAAGGAATGTCGTCTCCTCTTACCGCGGGTTTAACTGATTGGAGTGAGTGTCCTGAGCTTGGTGCCATTGGAGATTTGCTTGCTTCATCAGACTTTGCAGCTACTGTGTCGGTTCTTGTGGTTCAACAGTATGTTGGGTCATGGGCACAAGAAGATGATATGGATTTTCCTGAGAGTCCAGTACATTCACATGAAACAAAAGTCACATATGGTTTAGAGAATCCACGTTAG

SEQ ID NO: 1869 - DNA, 1506 bp, Arabidopsis thaliana
  misc_feature (1)..(1506): Ceres cDNA ID no. 12707699
  misc_feature (1)..(1506): Also known as  Ceres CDNA ID no. 23360242
atgcatctgaagaattctactgtagcagaacggcggtacatcggaaaagaaaccgccggttatttaacttcttcctccgatttggatccgaaacctaagattaaacatcatcgtcctcttcaggtacctgagattttgactccagacattggtgctggtgctggattcagtgtgtataataatcaagttcaagctcagagtcgtcatcatctgacggttgaaatcccagattcatcgtctcacaatcttacatctaagagacctgtggtggttcaatcttctaatccgttcaacgttgacgatttccgaagacaacaacgcgcaagcttgggtccgatttcatcttattgtccgtcgtatcttttatcgtggttttcttcttctcttccatcgatccatcgagtccgtttgatatgtttccatcttcgtttcttacttcttctctctgttcctcctctctacatcttcttcttgttgattagtttcagattcttccttctctttgtcttctcgattatcgctttttctttcgtcctttcgatctctctcaaattcgctcttcctcacttaccatcgattcgtttgattatcgctcggttactttctctcaagcttacccctaccagatcatcctcttcatctcaggagaacactaaacatgttatttggtcaattgggtctaagcctgtgactgagaagaagaccagctctggctcatgggttcagaagtacagctctggtgatgtatacgagggagagtttcatagggggaagtgttcaggaagtggagtttattactattctatgaagggtaaatacgaaggggattggattgatgggaagtatgatggatatggagttgaaacttgggctaaagggagtaggtaccgaggtcaatacaggcaagggatgagacatggaactggtatctacagattttatacaggggatgtatatgctggtgagtggtctaatggacagagccatggctgtggtgtgtatacctctgaggatggtagtcgttttgttggagagtttaaatggggtgtcaaacatggccttggtcattatcatttcagaaatggtgatacatatgctggggagtattttgcagacaggatgcatggttttggagtgtatcaatttggaaacgggcatcggtatgaaggagcctggcatgaggggagaaggcaaggacttggtatgtacacgttcaggaatggtgagacacaggcaggccattgggaagacggagttcttaactgtcctaccgagcagaccactcgccctgattcatcgttttccatcagtcattccaaggttgtcgacactgtccagcaagcaaggaaagcagccaagaaagcacgcgaagttgtgaaagttgaagagagagtgaacagagcagtgatggtcgcaaaccgagcagcaaatgctgctagagttgctgctacaaaggctgtccaaacccaaacatttcattgtagtagtggtgacgatcccttgtga

SEQ ID NO: 1870 - protein, 1506 aa, Arabidopsis thaliana
  misc_feature: PFam Name: peroxidase; PFam Description: Peroxidase
  misc_feature: GI Number: 21593467; NR Description: peroxidase ATP13a
  misc_feature: GI Number: 31745133; NR Description: putative peroxidase [Arabidopsis thaliana] >gi|9759059|dbj|BAB09581.1| peroxidase [Arabidopsis thaliana] >gi|1429219|emb|CAA67312.1| peroxidase ATP13a [Arabidopsis thaliana] >gi|1402900|emb|CAA66966.1|
  misc_feature: GI Number: 21593692; NR Description: putative peroxidase
  misc_feature: GI Number: 51970002; NR Description: putative peroxidase
ATGCATCTGAAGAATTCTACTGTAGCAGAACGGCGGTACATCGGAAAAGAAACCGCCGGTTATTTAACTTCTTCCTCCGATTTGGATCCGAAACCTAAGATTAAACATCATCGTCCTCTTCAGGTACCTGAGATTTTGACTCCAGACATTGGTGCTGGTGCTGGATTCAGTGTGTATAATAATCAAGTTCAAGCTCAGAGTCGTCATCATCTGACGGTTGAAATCCCAGATTCATCGTCTCACAATCTTACATCTAAGAGACCTGTGGTGGTTCAATCTTCTAATCCGTTCAACGTTGACGATTTCCGAAGACAACAACGCGCAAGCTTGGGTCCGATTTCATCTTATTGTCCGTCGTATCTTTTATCGTGGTTTTCTTCTTCTCTTCCATCGATCCATCGAGTCCGTTTGATATGTTTCCATCTTCGTTTCTTACTTCTTCTCTCTGTTCCTCCTCTCTACATCTTCTTCTTGTTGATTAGTTTCAGATTCTTCCTTCTCTTTGTCTTCTCGATTATCGCTTTTTCTTTCGTCCTTTCGATCTCTCTCAAATTCGCTCTTCCTCACTTACCATCGATTCGTTTGATTATCGCTCGGTTACTTTCTCTCAAGCTTACCCCTACCAGATCATCCTCTTCATCTCAGGAGAACACTAAACATGTTATTTGGTCAATTGGGTCTAAGCCTGTGACTGAGAAGAAGACCAGCTCTGGCTCATGGGTTCAGAAGTACAGCTCTGGTGATGTATACGAGGGAGAGTTTCATAGGGGGAAGTGTTCAGGAAGTGGAGTTTATTACTATTCTATGAAGGGTAAATACGAAGGGGATTGGATTGATGGGAAGTATGATGGATATGGAGTTGAAACTTGGGCTAAAGGGAGTAGGTACCGAGGTCAATACAGGCAAGGGATGAGACATGGAACTGGTATCTACAGATTTTATACAGGGGATGTATATGCTGGTGAGTGGTCTAATGGACAGAGCCATGGCTGTGGTGTGTATACCTCTGAGGATGGTAGTCGTTTTGTTGGAGAGTTTAAATGGGGTGTCAAACATGGCCTTGGTCATTATCATTTCAGAAATGGTGATACATATGCTGGGGAGTATTTTGCAGACAGGATGCATGGTTTTGGAGTGTATCAATTTGGAAACGGGCATCGGTATGAAGGAGCCTGGCATGAGGGGAGAAGGCAAGGACTTGGTATGTACACGTTCAGGAATGGTGAGACACAGGCAGGCCATTGGGAAGACGGAGTTCTTAACTGTCCTACCGAGCAGACCACTCGCCCTGATTCATCGTTTTCCATCAGTCATTCCAAGGTTGTCGACACTGTCCAGCAAGCAAGGAAAGCAGCCAAGAAAGCACGCGAAGTTGTGAAAGTTGAAGAGAGAGTGAACAGAGCAGTGATGGTCGCAAACCGAGCAGCAAATGCTGCTAGAGTTGCTGCTACAAAGGCTGTCCAAACCCAAACATTTCATTGTAGTAGTGGTGACGATCCCTTGTGA

SEQ ID NO: 1871 - DNA, 1182 bp, Arabidopsis thaliana
  misc_feature (1)..(1182): Ceres cDNA ID no. 12708157
  misc_feature (1)..(1182): Also known as  Ceres CDNA ID no. 23360242
atgaaatggttgctcgtcgccgtattgacctctcttacgatcttctccgccttaacacagtcccatctcctccatggatctccggtcaattctctctgcgctgatctcattcatcccgctaattactcctgcactgaacacagtattcaaacaaaggatggttacatattagctcttcaacgtgtagcttctcttggtccaagacttcaatctggtccacctgttttgcttcagcacggtctctttatggctggagatgtgtggttcttgaattcaccaaaagagtcactaggtttcattcttgctgatcatgggtttgatgtttgggttggaaatgttcgtggtacacgttacagttatggacatgtaactttgtctgacactgataaggagttttgggactggagttggcaagatttggcaatgtatgacttggcagaaatgattcagtatctgtattcaatttcaaactccaaaattttccttgttggacattctcaggggactatcatgtcttttgctgctcttactcagccgcatgttgcggaaatggttgaagcagctgcgttgctttgtccaatatcatatttggatcatgtcacagctcctcttgttgaaagaatggtttttatgcatctcgatcagatggtagttgctcttgggctgcatcaaataaactttagaagtgatatgttagttaaacttgttgattcgttatgcgaagggcatatggattgcactgatttcctcacatccataacagggacgaattgttgtttcaacgcctcgaagatagaatactatctagattacgagcctcacccatcatctgtcaagaatattcgacatcttttccaaatgattcggaagggaacctttgcacaatacgactacgggtatttcaaaaatctacggacttatgggctgtcgaaacctccagaattcatactaagccacatcccggcatcattaccaatgtggatggggtatggtggaactgatggtttagcagatgtgacagatgtggaacatactctcgcggaactaccttccagtccagagttactatatcttgaggattatggtcacattgactttgtgcttggctcaagtgctaaagaagatgtctataagcacatgattcaatttttcagagcaaaggttaagtctagtagttggtaa

SEQ ID NO: 1872 - protein, 1182 aa, Arabidopsis thaliana
  misc_feature: PFam Name: peroxidase; PFam Description: Peroxidase
  misc_feature: GI Number: 21593467; NR Description: peroxidase ATP13a
  misc_feature: GI Number: 31745133; NR Description: putative peroxidase [Arabidopsis thaliana] >gi|9759059|dbj|BAB09581.1| peroxidase [Arabidopsis thaliana] >gi|1429219|emb|CAA67312.1| peroxidase ATP13a [Arabidopsis thaliana] >gi|1402900|emb|CAA66966.1|
  misc_feature: GI Number: 21593692; NR Description: putative peroxidase
  misc_feature: GI Number: 51970002; NR Description: putative peroxidase
ATGAAATGGTTGCTCGTCGCCGTATTGACCTCTCTTACGATCTTCTCCGCCTTAACACAGTCCCATCTCCTCCATGGATCTCCGGTCAATTCTCTCTGCGCTGATCTCATTCATCCCGCTAATTACTCCTGCACTGAACACAGTATTCAAACAAAGGATGGTTACATATTAGCTCTTCAACGTGTAGCTTCTCTTGGTCCAAGACTTCAATCTGGTCCACCTGTTTTGCTTCAGCACGGTCTCTTTATGGCTGGAGATGTGTGGTTCTTGAATTCACCAAAAGAGTCACTAGGTTTCATTCTTGCTGATCATGGGTTTGATGTTTGGGTTGGAAATGTTCGTGGTACACGTTACAGTTATGGACATGTAACTTTGTCTGACACTGATAAGGAGTTTTGGGACTGGAGTTGGCAAGATTTGGCAATGTATGACTTGGCAGAAATGATTCAGTATCTGTATTCAATTTCAAACTCCAAAATTTTCCTTGTTGGACATTCTCAGGGGACTATCATGTCTTTTGCTGCTCTTACTCAGCCGCATGTTGCGGAAATGGTTGAAGCAGCTGCGTTGCTTTGTCCAATATCATATTTGGATCATGTCACAGCTCCTCTTGTTGAAAGAATGGTTTTTATGCATCTCGATCAGATGGTAGTTGCTCTTGGGCTGCATCAAATAAACTTTAGAAGTGATATGTTAGTTAAACTTGTTGATTCGTTATGCGAAGGGCATATGGATTGCACTGATTTCCTCACATCCATAACAGGGACGAATTGTTGTTTCAACGCCTCGAAGATAGAATACTATCTAGATTACGAGCCTCACCCATCATCTGTCAAGAATATTCGACATCTTTTCCAAATGATTCGGAAGGGAACCTTTGCACAATACGACTACGGGTATTTCAAAAATCTACGGACTTATGGGCTGTCGAAACCTCCAGAATTCATACTAAGCCACATCCCGGCATCATTACCAATGTGGATGGGGTATGGTGGAACTGATGGTTTAGCAGATGTGACAGATGTGGAACATACTCTCGCGGAACTACCTTCCAGTCCAGAGTTACTATATCTTGAGGATTATGGTCACATTGACTTTGTGCTTGGCTCAAGTGCTAAAGAAGATGTCTATAAGCACATGATTCAATTTTTCAGAGCAAAGGTTAAGTCTAGTAGTTGGTAA

SEQ ID NO: 1873 - DNA, 1581 bp, Arabidopsis thaliana
  misc_feature (1)..(1581): Ceres cDNA ID no. 12708513
  misc_feature (1)..(1581): Also known as  Ceres CDNA ID no. 23360242
atggctctgatgaattgtgcatattcatcttcttcttcgtcttcgtctacttcctctcccacttcttcatcatcttcttcttcatattctccaaggaacagagagagcatgtttttgcagagtgtagttgatgcgtcaccttcaagtttctcttccgacagaaaatctattttaccaattgagaagactttaataagacatcagaattccagtctctgcttgatcccaaagtcttcagaagaattgaagaaggagattgcatcaattgagatagagattctacacatggaacgatatctcttatctctttacagaaaatcatttgagcaacaacttcctaattccttctctaatctctctgttactactaccttacctcgttctgtgactacttcaccaacatcactaactcattatcaagcttaccaaaaaccaatctcatatcctcggagtttcaacactagtttaaaagccttatcttcaagggaagggactagagtagtttctggtactcacagtcttggagagcttttaggatcatctcatatagttgatcataacaacttcataaacccgaataaactctctgaagatatcatgagatgcatttcttctgtgtattgtacactttcaagaggatcaacgagtaccacttccacttgttttcctgcttctccggtttcctccaatgcctcaaccattttctcttccaaatttaattatgaagataaatggagcttgaatggcgcaagtgaggatcattttctgaatcactgtcaagatcaagacaatgttttgccttgtggtgttgttgtcatagaggctcttagagtacatttagacgatggtagtttcggttacgctgctcttatgcttcaaaacttcagatcactggttcaaaatcttgagaaagttgatccgagtagaatgaaacgcgaagagaagctcgcgttttggataaacattcacaatgctcttgtgatgcatgcttacttagcttatggaactcacaaccgcgcaagaaacacatcggttttgaaggcagcttatgatattggaggctatagaataaacccttatatcatccaaagctcaatcttaggaatcagacctcattacacatcaccatcacctttactccaaactctgttttccccttcaagaaagtcgaaaacttgcagtgttagacacatttacgcattggaataccccgaggctttagctcatttcgctatttcttcaggggcattcactgatcctacagttcgagtttacaccgcggatagaatcttccgggatctaagacaagcgaaacaagagtatatcagaagtaatgttcgtgtttacaaagggacaaagattttgttgccaaagatctttcaacattatgttaaagacatgtcaatggatgtgtctaagctcatggaagcaacatctcaatgtttaccagaagatgcaaggaaaattgctgagaaatgtttgaaagagaagaagagtaagaattttgaatggttaccggaaaatttgagcttccggtatgttatcgccggagaattggtcggagcaagaaataagacgtga

SEQ ID NO: 1874 - protein, 1581 aa, Arabidopsis thaliana
  misc_feature: PFam Name: peroxidase; PFam Description: Peroxidase
  misc_feature: GI Number: 21593467; NR Description: peroxidase ATP13a
  misc_feature: GI Number: 31745133; NR Description: putative peroxidase [Arabidopsis thaliana] >gi|9759059|dbj|BAB09581.1| peroxidase [Arabidopsis thaliana] >gi|1429219|emb|CAA67312.1| peroxidase ATP13a [Arabidopsis thaliana] >gi|1402900|emb|CAA66966.1|
  misc_feature: GI Number: 21593692; NR Description: putative peroxidase
  misc_feature: GI Number: 51970002; NR Description: putative peroxidase
ATGGCTCTGATGAATTGTGCATATTCATCTTCTTCTTCGTCTTCGTCTACTTCCTCTCCCACTTCTTCATCATCTTCTTCTTCATATTCTCCAAGGAACAGAGAGAGCATGTTTTTGCAGAGTGTAGTTGATGCGTCACCTTCAAGTTTCTCTTCCGACAGAAAATCTATTTTACCAATTGAGAAGACTTTAATAAGACATCAGAATTCCAGTCTCTGCTTGATCCCAAAGTCTTCAGAAGAATTGAAGAAGGAGATTGCATCAATTGAGATAGAGATTCTACACATGGAACGATATCTCTTATCTCTTTACAGAAAATCATTTGAGCAACAACTTCCTAATTCCTTCTCTAATCTCTCTGTTACTACTACCTTACCTCGTTCTGTGACTACTTCACCAACATCACTAACTCATTATCAAGCTTACCAAAAACCAATCTCATATCCTCGGAGTTTCAACACTAGTTTAAAAGCCTTATCTTCAAGGGAAGGGACTAGAGTAGTTTCTGGTACTCACAGTCTTGGAGAGCTTTTAGGATCATCTCATATAGTTGATCATAACAACTTCATAAACCCGAATAAACTCTCTGAAGATATCATGAGATGCATTTCTTCTGTGTATTGTACACTTTCAAGAGGATCAACGAGTACCACTTCCACTTGTTTTCCTGCTTCTCCGGTTTCCTCCAATGCCTCAACCATTTTCTCTTCCAAATTTAATTATGAAGATAAATGGAGCTTGAATGGCGCAAGTGAGGATCATTTTCTGAATCACTGTCAAGATCAAGACAATGTTTTGCCTTGTGGTGTTGTTGTCATAGAGGCTCTTAGAGTACATTTAGACGATGGTAGTTTCGGTTACGCTGCTCTTATGCTTCAAAACTTCAGATCACTGGTTCAAAATCTTGAGAAAGTTGATCCGAGTAGAATGAAACGCGAAGAGAAGCTCGCGTTTTGGATAAACATTCACAATGCTCTTGTGATGCATGCTTACTTAGCTTATGGAACTCACAACCGCGCAAGAAACACATCGGTTTTGAAGGCAGCTTATGATATTGGAGGCTATAGAATAAACCCTTATATCATCCAAAGCTCAATCTTAGGAATCAGACCTCATTACACATCACCATCACCTTTACTCCAAACTCTGTTTTCCCCTTCAAGAAAGTCGAAAACTTGCAGTGTTAGACACATTTACGCATTGGAATACCCCGAGGCTTTAGCTCATTTCGCTATTTCTTCAGGGGCATTCACTGATCCTACAGTTCGAGTTTACACCGCGGATAGAATCTTCCGGGATCTAAGACAAGCGAAACAAGAGTATATCAGAAGTAATGTTCGTGTTTACAAAGGGACAAAGATTTTGTTGCCAAAGATCTTTCAACATTATGTTAAAGACATGTCAATGGATGTGTCTAAGCTCATGGAAGCAACATCTCAATGTTTACCAGAAGATGCAAGGAAAATTGCTGAGAAATGTTTGAAAGAGAAGAAGAGTAAGAATTTTGAATGGTTACCGGAAAATTTGAGCTTCCGGTATGTTATCGCCGGAGAATTGGTCGGAGCAAGAAATAAGACGTGA

SEQ ID NO: 1875 - DNA, 2205 bp, Arabidopsis thaliana
  misc_feature (1)..(2205): Ceres cDNA ID no. 12709021
  misc_feature (1)..(2205): Also known as  Ceres CDNA ID no. 23360242
atggcagattcaagttcatctctccatcctctttgcgaaaggatctcacacaaaagctacgttttaagagctgtagatctcacgattctcggccttctctattctctcctcttgtatcgaatcctacatataagcgaaaacgacaacgtttggctcttggctttcttctgtgaatcttgtttctcattggtatgggttcatgaccttccttcattagatatgttcgtgcccacggcagatacggttagagagtcaccgattatcactgtgaacactgtgctttcgctattagctgtgaattatccagcgaataaactagcgtgttatgtgtcggacgatggatgttctcctctcacttacttttctctcaaggaagcttctaagttcgttaaaatttgggctcccttctgcaagaaatacaacgttagagttagagctccttttagatatttcttaaaccctttggttgcaacagatgattcagtattcagcaaagattggaaaatgatgaagagggagtacgtgaagttatgccggaaagttgaagatgccacaggagattcccattggttggatgcagacgatgattttgaagctttctcaaacacaaaaccaaatgatcattcaactattgttaaggtggtatgggagaacaagggaggtgtaggagacgagaaagaagtccctcatcttgtatacatttcaagagagaaaagaccaaattaccttcatcattacaaaactggagccatgaactttctgttaagagtctcagggttgatgacaaatgcaccatacacgttgaacgtagactgtgacatgtatgctaatgaaccagatgtggtgcgacaagcaatgtgtgtatttttacaaaactcgaagaactcaaaccattgtgcttttgttcaattccctcaaaagttctatgattcttacaccaacgaactcgccgtcttacaatcgattttgggacgaggagttgctggaatccaaggaccattttatattggaacaggatgcttccacactagaagagttatgtatggtttatcttcggacgatttagaagacaacggaaatatttctcaagttgctacaagggagtttttggctgaggatagtttagtgagaaaatatggaaattctaaagaattggtgaaatcggtggtggatgcattgcaaagaaaatcaaacccccaaaaaagtcttgcaaacctcattgaagcggctcaagaagtggggcattgtcattacgagtaccaaaccagttggggcaacctcggttggatgtacgattcagtggcagaagatataaacacgagtgttggaatccatttgaggggatggactagctcattcatttctccggatccacctgcgtttattggatccacgccgacgttaggattagaggctatagtccagcagcggcgatgggcgacgggagcaatcgaagtcctttttaacaaacaaagcccgttcatgggaatgttccacgggaaaataaaattccgtcaacgattagcttatttttgggccctcatgtgtttaaggtcaatccctgagcttatttattgcctcttgcctgcttattgcctactccacgactctgccttgtttcccaagggaccttgtctatgtacaatagtcacacttgtggggatgcactgtctctacagtctttggcaattcatgagccttggtttttcagtacaatcgtggtatgtcgttcaatcactttggagaattatagccactagcagttggttatttagcatccaagatatcatactcaagcttcttggaatctcgcaaatcgggtttgtaatcgctaaaaagacaatacccgagaccaagtcagtatatgagtctaaaccatctcaaggagaagatgatgttccaaaattaaatttaggtaaatttgaatttgatagctcgggtcttttcatacccggcacatttattatgttggtgaatcttgccgctctagctggttatttggttcgtctacaacggtcaagttgtagtcatggaggaggtggctcgggtttggcagaggcttgtggatgtatcttggtggttatgttattccttccatttctaaagggtttgtttgagcatggaaaatatagcatcccattgtctactctttctaaagctgcctttttgacagttttatttgtatttttctgtgtgggaaaatag

SEQ ID NO: 1876 - protein, 2205 aa, Arabidopsis thaliana
  misc_feature: PFam Name: peroxidase; PFam Description: Peroxidase
  misc_feature: GI Number: 21593467; NR Description: peroxidase ATP13a
  misc_feature: GI Number: 31745133; NR Description: putative peroxidase [Arabidopsis thaliana] >gi|9759059|dbj|BAB09581.1| peroxidase [Arabidopsis thaliana] >gi|1429219|emb|CAA67312.1| peroxidase ATP13a [Arabidopsis thaliana] >gi|1402900|emb|CAA66966.1|
  misc_feature: GI Number: 21593692; NR Description: putative peroxidase
  misc_feature: GI Number: 51970002; NR Description: putative peroxidase
ATGGCAGATTCAAGTTCATCTCTCCATCCTCTTTGCGAAAGGATCTCACACAAAAGCTACGTTTTAAGAGCTGTAGATCTCACGATTCTCGGCCTTCTCTATTCTCTCCTCTTGTATCGAATCCTACATATAAGCGAAAACGACAACGTTTGGCTCTTGGCTTTCTTCTGTGAATCTTGTTTCTCATTGGTATGGGTTCATGACCTTCCTTCATTAGATATGTTCGTGCCCACGGCAGATACGGTTAGAGAGTCACCGATTATCACTGTGAACACTGTGCTTTCGCTATTAGCTGTGAATTATCCAGCGAATAAACTAGCGTGTTATGTGTCGGACGATGGATGTTCTCCTCTCACTTACTTTTCTCTCAAGGAAGCTTCTAAGTTCGTTAAAATTTGGGCTCCCTTCTGCAAGAAATACAACGTTAGAGTTAGAGCTCCTTTTAGATATTTCTTAAACCCTTTGGTTGCAACAGATGATTCAGTATTCAGCAAAGATTGGAAAATGATGAAGAGGGAGTACGTGAAGTTATGCCGGAAAGTTGAAGATGCCACAGGAGATTCCCATTGGTTGGATGCAGACGATGATTTTGAAGCTTTCTCAAACACAAAACCAAATGATCATTCAACTATTGTTAAGGTGGTATGGGAGAACAAGGGAGGTGTAGGAGACGAGAAAGAAGTCCCTCATCTTGTATACATTTCAAGAGAGAAAAGACCAAATTACCTTCATCATTACAAAACTGGAGCCATGAACTTTCTGTTAAGAGTCTCAGGGTTGATGACAAATGCACCATACACGTTGAACGTAGACTGTGACATGTATGCTAATGAACCAGATGTGGTGCGACAAGCAATGTGTGTATTTTTACAAAACTCGAAGAACTCAAACCATTGTGCTTTTGTTCAATTCCCTCAAAAGTTCTATGATTCTTACACCAACGAACTCGCCGTCTTACAATCGATTTTGGGACGAGGAGTTGCTGGAATCCAAGGACCATTTTATATTGGAACAGGATGCTTCCACACTAGAAGAGTTATGTATGGTTTATCTTCGGACGATTTAGAAGACAACGGAAATATTTCTCAAGTTGCTACAAGGGAGTTTTTGGCTGAGGATAGTTTAGTGAGAAAATATGGAAATTCTAAAGAATTGGTGAAATCGGTGGTGGATGCATTGCAAAGAAAATCAAACCCCCAAAAAAGTCTTGCAAACCTCATTGAAGCGGCTCAAGAAGTGGGGCATTGTCATTACGAGTACCAAACCAGTTGGGGCAACCTCGGTTGGATGTACGATTCAGTGGCAGAAGATATAAACACGAGTGTTGGAATCCATTTGAGGGGATGGACTAGCTCATTCATTTCTCCGGATCCACCTGCGTTTATTGGATCCACGCCGACGTTAGGATTAGAGGCTATAGTCCAGCAGCGGCGATGGGCGACGGGAGCAATCGAAGTCCTTTTTAACAAACAAAGCCCGTTCATGGGAATGTTCCACGGGAAAATAAAATTCCGTCAACGATTAGCTTATTTTTGGGCCCTCATGTGTTTAAGGTCAATCCCTGAGCTTATTTATTGCCTCTTGCCTGCTTATTGCCTACTCCACGACTCTGCCTTGTTTCCCAAGGGACCTTGTCTATGTACAATAGTCACACTTGTGGGGATGCACTGTCTCTACAGTCTTTGGCAATTCATGAGCCTTGGTTTTTCAGTACAATCGTGGTATGTCGTTCAATCACTTTGGAGAATTATAGCCACTAGCAGTTGGTTATTTAGCATCCAAGATATCATACTCAAGCTTCTTGGAATCTCGCAAATCGGGTTTGTAATCGCTAAAAAGACAATACCCGAGACCAAGTCAGTATATGAGTCTAAACCATCTCAAGGAGAAGATGATGTTCCAAAATTAAATTTAGGTAAATTTGAATTTGATAGCTCGGGTCTTTTCATACCCGGCACATTTATTATGTTGGTGAATCTTGCCGCTCTAGCTGGTTATTTGGTTCGTCTACAACGGTCAAGTTGTAGTCATGGAGGAGGTGGCTCGGGTTTGGCAGAGGCTTGTGGATGTATCTTGGTGGTTATGTTATTCCTTCCATTTCTAAAGGGTTTGTTTGAGCATGGAAAATATAGCATCCCATTGTCTACTCTTTCTAAAGCTGCCTTTTTGACAGTTTTATTTGTATTTTTCTGTGTGGGAAAATAG

SEQ ID NO: 1877 - DNA, 2280 bp, Arabidopsis thaliana
  misc_feature (1)..(2280): Ceres cDNA ID no. 12709033
  misc_feature (1)..(2280): Also known as  Ceres CDNA ID no. 23360242
atggcagattcaagttcttctctccttcctctttgcgaaaggatttcacacaaaagctacattttaagaattgtcgatctcacaattctcgttcttctcttttctcttctctggtaccgaatcctacatatgtgcgaaaacaacaccatttggcttgtggcttttctctgtgaatcttgtttctcattcatgtggttgattattacctgcataaaatggagtcctgctgaagataaaccctatccaaatagacttgatgaaagggttcatgaccttccttcagtagatatgttcgtgcccacggcagatccggttagggagccgccgattattgttgtgaacactgtgctttcgctattagctgtgaattatccagcgaataaactagcgtgttatgtgtcggacgatggatgttctcctctcacttacttttctctcaaggaagcttctaagttcgttaaaatttgggctcccttctgcaagaaatacaacgttagagttagagctccttttagatatttcttaaaccctttggttgcaacagatgattcagtattcagcaaagattggaaaatgatgaagagggagtacgtgaagttatgccggaaagttgaagatgccacaggagattcccattggttggatgcagacgatgattttgaagctttctcaaacacaaaaccaaatgatcattcaactattgttaaggtggtatgggagaacaagggaggtgtaggagacgagaaagaagtccctcatcttgtatacatttcaagagagaaaagaccaaattaccttcatcattacaaaactggagccatgaactttctgttaagagtgtcaggattgatgacaaatgcaccatacatgttgaacgtagactgtgacatgtatgccaatgaaccagatgtggtgcgacaagcaatgtgtgtatttttacaaaactcaaagaactcaaaccattgtgcttttgttcagttccctcaaaacttctatgattcttacaccaacgaacttgtcgtcttacaacattatatgaaacgaggagttgcgggaatccaaggaccgatatatattggatcaggctgcttccacactagaagagttatgtacggtttatcttcagacgatttagaagacgatggaagtctttcttcggttgcttcaagggagtttttgtccgaggatagtttagtgaggaaatatgggagttccaaagagttggtgaaatcagtggtggatgcattgcaaagaaaatcaaacccccaaaaaagtcttgcaaacctcgtagaagcggcccaagaagtggggcattgtcactacgagtaccaaaccagttggggcaacctcggttggttatatgattcagtggcagaagatacaaacacgagtattggaatccatttgagaggatggactagttcattcatttctccggaccctcccgcgtttctaggatcaactccgtcggtaggaccagaggcgatagtccaacaccggcgatgggcaacgggatcgatcgaagtcctttttaacaaacaaagtccgttgatcggtttccgtcggaaaataaaattccgacaaagattagcttatttttgggttctcatgtgtataaggtcaatccctgagctcgtgtactgtctcttgcctgcttattgcctactcaacaactctgccttgtttcccaagggaccttgtctaggcataatagtcacacttgtggggatgcattgtctctacactctatggcaattcatgatccttggtttttcggtaaaatcgtggtatgtctcccaatcactttggagaataatagccactagcagttggttatttagcatccaagatatcatactcaagcttcttggaatctcgaaaatcggttttatagtcgcgaaaaagaatatgcctgagactaggtcaggatatgaatctaaatctaaaccatctcaaggagaagatgatggtctaaaattagagttaggtaaatttgaatttgacagctcgtgtcatttcatacccggcacatttattatgttggtgaatcttgccgctctagctggttttttggttcgtctacaacggtcaagttatagtcatggaggaggaggtggttcggctttggcagagacttgtggatgtatctcggtggttatgttattttttccatttctaaagggtttgtttgagcatggaaaatatggcatcccattatctactctttctaaagctgcgtttttaacggttttatttgttgttttctcggtgggaaaatag

SEQ ID NO: 1878 - protein, 2280 aa, Arabidopsis thaliana
  misc_feature: PFam Name: peroxidase; PFam Description: Peroxidase
  misc_feature: GI Number: 21593467; NR Description: peroxidase ATP13a
  misc_feature: GI Number: 31745133; NR Description: putative peroxidase [Arabidopsis thaliana] >gi|9759059|dbj|BAB09581.1| peroxidase [Arabidopsis thaliana] >gi|1429219|emb|CAA67312.1| peroxidase ATP13a [Arabidopsis thaliana] >gi|1402900|emb|CAA66966.1|
  misc_feature: GI Number: 21593692; NR Description: putative peroxidase
  misc_feature: GI Number: 51970002; NR Description: putative peroxidase
ATGGCAGATTCAAGTTCTTCTCTCCTTCCTCTTTGCGAAAGGATTTCACACAAAAGCTACATTTTAAGAATTGTCGATCTCACAATTCTCGTTCTTCTCTTTTCTCTTCTCTGGTACCGAATCCTACATATGTGCGAAAACAACACCATTTGGCTTGTGGCTTTTCTCTGTGAATCTTGTTTCTCATTCATGTGGTTGATTATTACCTGCATAAAATGGAGTCCTGCTGAAGATAAACCCTATCCAAATAGACTTGATGAAAGGGTTCATGACCTTCCTTCAGTAGATATGTTCGTGCCCACGGCAGATCCGGTTAGGGAGCCGCCGATTATTGTTGTGAACACTGTGCTTTCGCTATTAGCTGTGAATTATCCAGCGAATAAACTAGCGTGTTATGTGTCGGACGATGGATGTTCTCCTCTCACTTACTTTTCTCTCAAGGAAGCTTCTAAGTTCGTTAAAATTTGGGCTCCCTTCTGCAAGAAATACAACGTTAGAGTTAGAGCTCCTTTTAGATATTTCTTAAACCCTTTGGTTGCAACAGATGATTCAGTATTCAGCAAAGATTGGAAAATGATGAAGAGGGAGTACGTGAAGTTATGCCGGAAAGTTGAAGATGCCACAGGAGATTCCCATTGGTTGGATGCAGACGATGATTTTGAAGCTTTCTCAAACACAAAACCAAATGATCATTCAACTATTGTTAAGGTGGTATGGGAGAACAAGGGAGGTGTAGGAGACGAGAAAGAAGTCCCTCATCTTGTATACATTTCAAGAGAGAAAAGACCAAATTACCTTCATCATTACAAAACTGGAGCCATGAACTTTCTGTTAAGAGTGTCAGGATTGATGACAAATGCACCATACATGTTGAACGTAGACTGTGACATGTATGCCAATGAACCAGATGTGGTGCGACAAGCAATGTGTGTATTTTTACAAAACTCAAAGAACTCAAACCATTGTGCTTTTGTTCAGTTCCCTCAAAACTTCTATGATTCTTACACCAACGAACTTGTCGTCTTACAACATTATATGAAACGAGGAGTTGCGGGAATCCAAGGACCGATATATATTGGATCAGGCTGCTTCCACACTAGAAGAGTTATGTACGGTTTATCTTCAGACGATTTAGAAGACGATGGAAGTCTTTCTTCGGTTGCTTCAAGGGAGTTTTTGTCCGAGGATAGTTTAGTGAGGAAATATGGGAGTTCCAAAGAGTTGGTGAAATCAGTGGTGGATGCATTGCAAAGAAAATCAAACCCCCAAAAAAGTCTTGCAAACCTCGTAGAAGCGGCCCAAGAAGTGGGGCATTGTCACTACGAGTACCAAACCAGTTGGGGCAACCTCGGTTGGTTATATGATTCAGTGGCAGAAGATACAAACACGAGTATTGGAATCCATTTGAGAGGATGGACTAGTTCATTCATTTCTCCGGACCCTCCCGCGTTTCTAGGATCAACTCCGTCGGTAGGACCAGAGGCGATAGTCCAACACCGGCGATGGGCAACGGGATCGATCGAAGTCCTTTTTAACAAACAAAGTCCGTTGATCGGTTTCCGTCGGAAAATAAAATTCCGACAAAGATTAGCTTATTTTTGGGTTCTCATGTGTATAAGGTCAATCCCTGAGCTCGTGTACTGTCTCTTGCCTGCTTATTGCCTACTCAACAACTCTGCCTTGTTTCCCAAGGGACCTTGTCTAGGCATAATAGTCACACTTGTGGGGATGCATTGTCTCTACACTCTATGGCAATTCATGATCCTTGGTTTTTCGGTAAAATCGTGGTATGTCTCCCAATCACTTTGGAGAATAATAGCCACTAGCAGTTGGTTATTTAGCATCCAAGATATCATACTCAAGCTTCTTGGAATCTCGAAAATCGGTTTTATAGTCGCGAAAAAGAATATGCCTGAGACTAGGTCAGGATATGAATCTAAATCTAAACCATCTCAAGGAGAAGATGATGGTCTAAAATTAGAGTTAGGTAAATTTGAATTTGACAGCTCGTGTCATTTCATACCCGGCACATTTATTATGTTGGTGAATCTTGCCGCTCTAGCTGGTTTTTTGGTTCGTCTACAACGGTCAAGTTATAGTCATGGAGGAGGAGGTGGTTCGGCTTTGGCAGAGACTTGTGGATGTATCTCGGTGGTTATGTTATTTTTTCCATTTCTAAAGGGTTTGTTTGAGCATGGAAAATATGGCATCCCATTATCTACTCTTTCTAAAGCTGCGTTTTTAACGGTTTTATTTGTTGTTTTCTCGGTGGGAAAATAG

SEQ ID NO: 1879 - DNA, 1284 bp, Arabidopsis thaliana
  misc_feature (1)..(1284): Ceres cDNA ID no. 12709704
  misc_feature (1)..(1284): Also known as  Ceres CDNA ID no. 23360242
atgagccaaaagaaactgacgaggactcaatcgtcgttactcagatcatctccgacgattcgatcgtcgatccaaagcctttcttcaatcactgaatgtgatgacttcaacgaaacctctcaccaccgccgtgaacaagatctcgaagccggtgagaaagaggaaaaacagaggaggagaaaaccggttaaatcattcgggtcaatgaaccgaattaaaccgggtctcgcattcacactcgcttgtctctctttcctgagtctctcatctttcttactgttcttcgttgatgagattttcacgtcggagaatctcttactaggtttgattttcgtcgctcttgctctgttcttcgcgtcgagaaacatggcggttattaaccaaaccgtaatcgcaatcaagcagattcgtgtaaggtctcgaatcaaacacaaaccgaaaccggttcaatggtacatcggagattcaaaaccggaaccgatcaaagaagaagaaacaagacttgtcgttaaagaaggagttcaattctttagcaatggagatttctacgaaggtgaattcaacagagggaagtgtaacggaagtggagtttattattattacgttaatggaagatatgaaggagattggatcaatggaaggtacgatggttatggaatcgagtgttggtctaaaggaagtaaatataaaggacagtataagcaaggacttagacatggttttggagtttactggttttacaccggagattcttactctggtgaatggtttaacggtcaaagccatggctttggagttcaaacttgtgctgatggaagctcttttgtcggagaattcaaatttggtgtcaaacatggacttggttcttaccatttcaggaatggagataagtatgcaggagagtattttggagacaagattcatggatttggtgtttaccatttcgctaatggtcactattacgaaggagcttggcatgaaggtcgtaaacaaggctatggcacgtatagatttagaaccggtgatatcaaatccggtgaatgggatgatggtaatctcgttaaccatcttcctttagactctgacccggttcgtagggcggttcagagtgcacgagaaagagcaaagaatggagtgaatcagagacggatcgatgagcaggtgatacgagctgtggctgcagctaataaagctgcgacggctgctagagttgcagctgtgaaagcagttcaaaatcaaatggatgttaaatgcataatccaaatatttaaaggtgatagctaa

SEQ ID NO: 1880 - protein, 1284 aa, Arabidopsis thaliana
  misc_feature: PFam Name: peroxidase; PFam Description: Peroxidase
  misc_feature: GI Number: 21593467; NR Description: peroxidase ATP13a
  misc_feature: GI Number: 31745133; NR Description: putative peroxidase [Arabidopsis thaliana] >gi|9759059|dbj|BAB09581.1| peroxidase [Arabidopsis thaliana] >gi|1429219|emb|CAA67312.1| peroxidase ATP13a [Arabidopsis thaliana] >gi|1402900|emb|CAA66966.1|
  misc_feature: GI Number: 21593692; NR Description: putative peroxidase
  misc_feature: GI Number: 51970002; NR Description: putative peroxidase
ATGAGCCAAAAGAAACTGACGAGGACTCAATCGTCGTTACTCAGATCATCTCCGACGATTCGATCGTCGATCCAAAGCCTTTCTTCAATCACTGAATGTGATGACTTCAACGAAACCTCTCACCACCGCCGTGAACAAGATCTCGAAGCCGGTGAGAAAGAGGAAAAACAGAGGAGGAGAAAACCGGTTAAATCATTCGGGTCAATGAACCGAATTAAACCGGGTCTCGCATTCACACTCGCTTGTCTCTCTTTCCTGAGTCTCTCATCTTTCTTACTGTTCTTCGTTGATGAGATTTTCACGTCGGAGAATCTCTTACTAGGTTTGATTTTCGTCGCTCTTGCTCTGTTCTTCGCGTCGAGAAACATGGCGGTTATTAACCAAACCGTAATCGCAATCAAGCAGATTCGTGTAAGGTCTCGAATCAAACACAAACCGAAACCGGTTCAATGGTACATCGGAGATTCAAAACCGGAACCGATCAAAGAAGAAGAAACAAGACTTGTCGTTAAAGAAGGAGTTCAATTCTTTAGCAATGGAGATTTCTACGAAGGTGAATTCAACAGAGGGAAGTGTAACGGAAGTGGAGTTTATTATTATTACGTTAATGGAAGATATGAAGGAGATTGGATCAATGGAAGGTACGATGGTTATGGAATCGAGTGTTGGTCTAAAGGAAGTAAATATAAAGGACAGTATAAGCAAGGACTTAGACATGGTTTTGGAGTTTACTGGTTTTACACCGGAGATTCTTACTCTGGTGAATGGTTTAACGGTCAAAGCCATGGCTTTGGAGTTCAAACTTGTGCTGATGGAAGCTCTTTTGTCGGAGAATTCAAATTTGGTGTCAAACATGGACTTGGTTCTTACCATTTCAGGAATGGAGATAAGTATGCAGGAGAGTATTTTGGAGACAAGATTCATGGATTTGGTGTTTACCATTTCGCTAATGGTCACTATTACGAAGGAGCTTGGCATGAAGGTCGTAAACAAGGCTATGGCACGTATAGATTTAGAACCGGTGATATCAAATCCGGTGAATGGGATGATGGTAATCTCGTTAACCATCTTCCTTTAGACTCTGACCCGGTTCGTAGGGCGGTTCAGAGTGCACGAGAAAGAGCAAAGAATGGAGTGAATCAGAGACGGATCGATGAGCAGGTGATACGAGCTGTGGCTGCAGCTAATAAAGCTGCGACGGCTGCTAGAGTTGCAGCTGTGAAAGCAGTTCAAAATCAAATGGATGTTAAATGCATAATCCAAATATTTAAAGGTGATAGCTAA

SEQ ID NO: 1881 - DNA, 1767 bp, Arabidopsis thaliana
  misc_feature (1)..(1767): Ceres cDNA ID no. 12709994
  misc_feature (1)..(1767): Also known as  Ceres CDNA ID no. 23360242
atgaaacttcggcaaaaccctagtagattcacgtctgttctcaaatgggtatcacaactttctctagaaacccaattaaaaccctcaatttctggaactgggtttctcctccgatgtgcccaaacccctagatctttcgccaccgtcaccggtaacgaagtttgcagtgagaaatcgaaagtgaagagaacccgaaatgggtttaaaatcactcccaatgttaggaaattagctgaggaagcaatgttggattatttctattccactaggggtttacagtatatggttgcagagagtatgagcaagaacagtccaatttttattgataatcttttgaagaaagttgattgtgttactgcttctgatatcaaccaatctattactcgatatctacggtttcaccctgtcaatgaattcgagcctttccttgagagttcaggtttgaatcccagtgagtataatcatttggttccctgtgataaggtcttcttggatgaagaaggctttttgctggagaaccatcatgttttgtgttatagtggtgttgaccctaagaggattgggaagatcttcaaggaagctagggaagtttttagttatgaaaccggggttttagcttctaagattaaggcgtatgaggatttggggtttagcagattgtttctatctaagcttatcgtttgtagtccgagagtcttgatgggtcatacgaatattgaactggttcaggttgtaaagacgttgcaatctttagggtttgagttcgagtgggtaatggaaaacttgtcagatgagggacctgattggagctctgtgcatcgtgttttaagcttgcttagagaaatctgttttgatgaggaaaaactatatgggttaatcaggaactgtccaagtttgctttttgagaattcagggaaatggacagggattctagttgggtttgaaacaaagcttggggcatctagaagtgaactatgttcgttgtttcagaaattcccgctgattcaagtagagaaatgtgtttcgaatctaaggcagtgcttcttgttcttgaaagagatcgagatggaagatgatgagattcataaggttttccgttctcattcctggtggcttggttcatgtaagttaaagaaaaccagtagcttgcttgtgtttttgaaggctggtaaaactcgggtttgtcaggtcattcaagaaaaccctgaagagatgaaaaaatggacaatgggttcaaaaatccagccgttaccagctaccaacgtagacattgagtcgaaatcaatgaagactcagttcttattagacctcggatacaaagaaaactcagaggaaatggagacagcaatgaagaatttccgtggtaaaggatcagaactccgagagagatttaatgtcctcgtaagtttgggttttaccaagaaagatgtcaaagatatggtgaaagcatgtcctactatgctctcccagacctgtgatatcctagaatcaaaggtgaactaccttataaaggaattaggttatccgctttcgactttggtggatttcccttcatgtttaaagttcactcttcagcggatgaagctcagatttgcaatgttctcttggcttcaagcccgaggaaaagtagaccgcaagatcaaagttagcacaatgctcgcttgctcggacaaaatattcgtgagtttttttgtaaaccgtcatcctgatgggtctaagcatttagaggatctgaagaagctgcatctttcagttgaaacaaactaa

SEQ ID NO: 1882 - protein, 1767 aa, Arabidopsis thaliana
  misc_feature: PFam Name: peroxidase; PFam Description: Peroxidase
  misc_feature: GI Number: 21593467; NR Description: peroxidase ATP13a
  misc_feature: GI Number: 31745133; NR Description: putative peroxidase [Arabidopsis thaliana] >gi|9759059|dbj|BAB09581.1| peroxidase [Arabidopsis thaliana] >gi|1429219|emb|CAA67312.1| peroxidase ATP13a [Arabidopsis thaliana] >gi|1402900|emb|CAA66966.1|
  misc_feature: GI Number: 21593692; NR Description: putative peroxidase
  misc_feature: GI Number: 51970002; NR Description: putative peroxidase
ATGAAACTTCGGCAAAACCCTAGTAGATTCACGTCTGTTCTCAAATGGGTATCACAACTTTCTCTAGAAACCCAATTAAAACCCTCAATTTCTGGAACTGGGTTTCTCCTCCGATGTGCCCAAACCCCTAGATCTTTCGCCACCGTCACCGGTAACGAAGTTTGCAGTGAGAAATCGAAAGTGAAGAGAACCCGAAATGGGTTTAAAATCACTCCCAATGTTAGGAAATTAGCTGAGGAAGCAATGTTGGATTATTTCTATTCCACTAGGGGTTTACAGTATATGGTTGCAGAGAGTATGAGCAAGAACAGTCCAATTTTTATTGATAATCTTTTGAAGAAAGTTGATTGTGTTACTGCTTCTGATATCAACCAATCTATTACTCGATATCTACGGTTTCACCCTGTCAATGAATTCGAGCCTTTCCTTGAGAGTTCAGGTTTGAATCCCAGTGAGTATAATCATTTGGTTCCCTGTGATAAGGTCTTCTTGGATGAAGAAGGCTTTTTGCTGGAGAACCATCATGTTTTGTGTTATAGTGGTGTTGACCCTAAGAGGATTGGGAAGATCTTCAAGGAAGCTAGGGAAGTTTTTAGTTATGAAACCGGGGTTTTAGCTTCTAAGATTAAGGCGTATGAGGATTTGGGGTTTAGCAGATTGTTTCTATCTAAGCTTATCGTTTGTAGTCCGAGAGTCTTGATGGGTCATACGAATATTGAACTGGTTCAGGTTGTAAAGACGTTGCAATCTTTAGGGTTTGAGTTCGAGTGGGTAATGGAAAACTTGTCAGATGAGGGACCTGATTGGAGCTCTGTGCATCGTGTTTTAAGCTTGCTTAGAGAAATCTGTTTTGATGAGGAAAAACTATATGGGTTAATCAGGAACTGTCCAAGTTTGCTTTTTGAGAATTCAGGGAAATGGACAGGGATTCTAGTTGGGTTTGAAACAAAGCTTGGGGCATCTAGAAGTGAACTATGTTCGTTGTTTCAGAAATTCCCGCTGATTCAAGTAGAGAAATGTGTTTCGAATCTAAGGCAGTGCTTCTTGTTCTTGAAAGAGATCGAGATGGAAGATGATGAGATTCATAAGGTTTTCCGTTCTCATTCCTGGTGGCTTGGTTCATGTAAGTTAAAGAAAACCAGTAGCTTGCTTGTGTTTTTGAAGGCTGGTAAAACTCGGGTTTGTCAGGTCATTCAAGAAAACCCTGAAGAGATGAAAAAATGGACAATGGGTTCAAAAATCCAGCCGTTACCAGCTACCAACGTAGACATTGAGTCGAAATCAATGAAGACTCAGTTCTTATTAGACCTCGGATACAAAGAAAACTCAGAGGAAATGGAGACAGCAATGAAGAATTTCCGTGGTAAAGGATCAGAACTCCGAGAGAGATTTAATGTCCTCGTAAGTTTGGGTTTTACCAAGAAAGATGTCAAAGATATGGTGAAAGCATGTCCTACTATGCTCTCCCAGACCTGTGATATCCTAGAATCAAAGGTGAACTACCTTATAAAGGAATTAGGTTATCCGCTTTCGACTTTGGTGGATTTCCCTTCATGTTTAAAGTTCACTCTTCAGCGGATGAAGCTCAGATTTGCAATGTTCTCTTGGCTTCAAGCCCGAGGAAAAGTAGACCGCAAGATCAAAGTTAGCACAATGCTCGCTTGCTCGGACAAAATATTCGTGAGTTTTTTTGTAAACCGTCATCCTGATGGGTCTAAGCATTTAGAGGATCTGAAGAAGCTGCATCTTTCAGTTGAAACAAACTAA

SEQ ID NO: 1883 - DNA, 1209 bp, Arabidopsis thaliana
  misc_feature (1)..(1209): Ceres cDNA ID no. 12710006
  misc_feature (1)..(1209): Also known as  Ceres CDNA ID no. 23360242
atggggaagatctttaaggaagctagggaagttttcgggtatgaaaccggggttttagcttccaagattaagtcttatgaggatttggggtttagcaaattgtttctatcgaaacttatagtttgtagcccaagtatcttgattggggatatgaatgttggactggctaaggtcatggagatgctgaaagctattggttttggtgttgattgggtaacagagaacttgtcagaggaggtgtcttatgattggagctctatgcatagatgtctaagttttcttagagatttgtatgttgatgaaaatgagctatgtgagttaatcagaaagatgccaagacttattttcgaggattcaggggaatggacattgattctagctgggtttgaagcaaaactagggtcatccagaagtgaactctcttcgttgtttcagaaattccctcagtgtcagagtttaggtaaatttgttttgaatttaaggcattgcttcttgtttctgaaagatattgagatggatgatgacgagatcggtaagattttccgtttgcactctttgtggattggtgtatctcgtttgaagcaaaccagtaccttacttatcaatttgaagggtgggaaagggcggctatgtcaagtcattcaagaaaatccagaagagatgaaaaaatggattatggggttaagagtccagccattaccagctactggatacaaggtaaacacaaagtcgaaaacaatgaagactcagttcttgttagacctcggatacaaagaaaactctgaggaaatggagagagcactcaagaatttccgtggcaaaggatctgaactccgagagagatttaatgtcctcgtgagtttcggtcttactgagaaagatgtcaaagatatggtgaaagcatgtcctagtatcctcacccaggcatgtgatatcttagaatcaaaggtgaactaccttgtaaaggaattaggttatccgctttcgacattggtgactttcccaacatgtcttaagtacactcttcagcggatgaagcttcgattttcaatgttctcttggcttcaagatcgaggaaaagcagacccaaagcttcaagttagtactatacttgtgtgctcggacaagttctttgccactagatttgtaaaccgtcaccccgatgggcctaagcatttggaagacctgaagaaactacttgtgtgttag

SEQ ID NO: 1884 - protein, 1209 aa, Arabidopsis thaliana
  misc_feature: PFam Name: peroxidase; PFam Description: Peroxidase
  misc_feature: GI Number: 21593467; NR Description: peroxidase ATP13a
  misc_feature: GI Number: 31745133; NR Description: putative peroxidase [Arabidopsis thaliana] >gi|9759059|dbj|BAB09581.1| peroxidase [Arabidopsis thaliana] >gi|1429219|emb|CAA67312.1| peroxidase ATP13a [Arabidopsis thaliana] >gi|1402900|emb|CAA66966.1|
  misc_feature: GI Number: 21593692; NR Description: putative peroxidase
  misc_feature: GI Number: 51970002; NR Description: putative peroxidase
ATGGGGAAGATCTTTAAGGAAGCTAGGGAAGTTTTCGGGTATGAAACCGGGGTTTTAGCTTCCAAGATTAAGTCTTATGAGGATTTGGGGTTTAGCAAATTGTTTCTATCGAAACTTATAGTTTGTAGCCCAAGTATCTTGATTGGGGATATGAATGTTGGACTGGCTAAGGTCATGGAGATGCTGAAAGCTATTGGTTTTGGTGTTGATTGGGTAACAGAGAACTTGTCAGAGGAGGTGTCTTATGATTGGAGCTCTATGCATAGATGTCTAAGTTTTCTTAGAGATTTGTATGTTGATGAAAATGAGCTATGTGAGTTAATCAGAAAGATGCCAAGACTTATTTTCGAGGATTCAGGGGAATGGACATTGATTCTAGCTGGGTTTGAAGCAAAACTAGGGTCATCCAGAAGTGAACTCTCTTCGTTGTTTCAGAAATTCCCTCAGTGTCAGAGTTTAGGTAAATTTGTTTTGAATTTAAGGCATTGCTTCTTGTTTCTGAAAGATATTGAGATGGATGATGACGAGATCGGTAAGATTTTCCGTTTGCACTCTTTGTGGATTGGTGTATCTCGTTTGAAGCAAACCAGTACCTTACTTATCAATTTGAAGGGTGGGAAAGGGCGGCTATGTCAAGTCATTCAAGAAAATCCAGAAGAGATGAAAAAATGGATTATGGGGTTAAGAGTCCAGCCATTACCAGCTACTGGATACAAGGTAAACACAAAGTCGAAAACAATGAAGACTCAGTTCTTGTTAGACCTCGGATACAAAGAAAACTCTGAGGAAATGGAGAGAGCACTCAAGAATTTCCGTGGCAAAGGATCTGAACTCCGAGAGAGATTTAATGTCCTCGTGAGTTTCGGTCTTACTGAGAAAGATGTCAAAGATATGGTGAAAGCATGTCCTAGTATCCTCACCCAGGCATGTGATATCTTAGAATCAAAGGTGAACTACCTTGTAAAGGAATTAGGTTATCCGCTTTCGACATTGGTGACTTTCCCAACATGTCTTAAGTACACTCTTCAGCGGATGAAGCTTCGATTTTCAATGTTCTCTTGGCTTCAAGATCGAGGAAAAGCAGACCCAAAGCTTCAAGTTAGTACTATACTTGTGTGCTCGGACAAGTTCTTTGCCACTAGATTTGTAAACCGTCACCCCGATGGGCCTAAGCATTTGGAAGACCTGAAGAAACTACTTGTGTGTTAG

SEQ ID NO: 1885 - DNA, 1275 bp, Arabidopsis thaliana
  misc_feature (1)..(1275): Ceres cDNA ID no. 12710081
  misc_feature (1)..(1275): Also known as  Ceres CDNA ID no. 23360242
atggggcgattggcttggcgtgctttttttacatttcaaagttctctaagcttctctctctctctctcgcttttgagatcatcgaacacaatcgaaacgaagaatcatttgaagaagaagaagatcgtgagaagcttaatgggttggatcccgtgttctgggaaatcgagtgggaggaataagacaaggaggaacggtgaccacaaactcgacaggaagtcttctgattgttctgtgtctacttcagagaaatctagggccaagtcgtccttgagtgaatccaaaagtaaaggctctgatcacattgtggcacaaacgtttacattctctgagttagctactgccactagaaacttcagaaaagaatgtcttataggagaaggaggatttggtagagtttacaaaggatacttggccagcactagccagacagcggctatcaagcaacttgatcataatggtttacaaggaaacagggagttcctcgtcgaggttctcatgttgagtcttcttcatcacccgaatcttgttaacttaataggatattgtgctgatggagatcaaaggcttctagtctacgagtacatgcccctaggttcacttgaagatcatttgcacgacatttcacctggtaagcagccacttgactggaacaccagaatgaaaatagctgccggtgctgcaaaaggtttggagtatctgcatgacaaaaccatgcctccagtgatctatcgagatttgaaatgctcaaatattttgctcgatgatgattactttccaaagctatccgacttcgggttggctaaacttggcccagttggggacaagtctcatgtgtccactcgggttatgggaacatacggatactgtgctcccgagtatgcaatgacaggccagctaacactcaaatcagacgtttacagcttcggtgttgttctgttggagattataactggtcggaaagcaatagacagttcaagatctactggagaacagaatctagtcgcatgggcaaggcctttgtttaaagacaggaggaaattctctcagatggctgatccaatgcttcaaggtcaataccctccgcgagggttataccaagcactcgctgtagcagcgatgtgcgtacaagagcagccaaatcttagacctctcattgctgacgtcgtcactgcactttcttacctcgcctcccaaaagtttgatcctctggctcagccagtccaaggatcccttttcgctccagggactccacctagatcaaagagggtctga

SEQ ID NO: 1886 - protein, 1275 aa, Arabidopsis thaliana
  misc_feature: PFam Name: peroxidase; PFam Description: Peroxidase
  misc_feature: GI Number: 21593467; NR Description: peroxidase ATP13a
  misc_feature: GI Number: 31745133; NR Description: putative peroxidase [Arabidopsis thaliana] >gi|9759059|dbj|BAB09581.1| peroxidase [Arabidopsis thaliana] >gi|1429219|emb|CAA67312.1| peroxidase ATP13a [Arabidopsis thaliana] >gi|1402900|emb|CAA66966.1|
  misc_feature: GI Number: 21593692; NR Description: putative peroxidase
  misc_feature: GI Number: 51970002; NR Description: putative peroxidase
ATGGGGCGATTGGCTTGGCGTGCTTTTTTTACATTTCAAAGTTCTCTAAGCTTCTCTCTCTCTCTCTCGCTTTTGAGATCATCGAACACAATCGAAACGAAGAATCATTTGAAGAAGAAGAAGATCGTGAGAAGCTTAATGGGTTGGATCCCGTGTTCTGGGAAATCGAGTGGGAGGAATAAGACAAGGAGGAACGGTGACCACAAACTCGACAGGAAGTCTTCTGATTGTTCTGTGTCTACTTCAGAGAAATCTAGGGCCAAGTCGTCCTTGAGTGAATCCAAAAGTAAAGGCTCTGATCACATTGTGGCACAAACGTTTACATTCTCTGAGTTAGCTACTGCCACTAGAAACTTCAGAAAAGAATGTCTTATAGGAGAAGGAGGATTTGGTAGAGTTTACAAAGGATACTTGGCCAGCACTAGCCAGACAGCGGCTATCAAGCAACTTGATCATAATGGTTTACAAGGAAACAGGGAGTTCCTCGTCGAGGTTCTCATGTTGAGTCTTCTTCATCACCCGAATCTTGTTAACTTAATAGGATATTGTGCTGATGGAGATCAAAGGCTTCTAGTCTACGAGTACATGCCCCTAGGTTCACTTGAAGATCATTTGCACGACATTTCACCTGGTAAGCAGCCACTTGACTGGAACACCAGAATGAAAATAGCTGCCGGTGCTGCAAAAGGTTTGGAGTATCTGCATGACAAAACCATGCCTCCAGTGATCTATCGAGATTTGAAATGCTCAAATATTTTGCTCGATGATGATTACTTTCCAAAGCTATCCGACTTCGGGTTGGCTAAACTTGGCCCAGTTGGGGACAAGTCTCATGTGTCCACTCGGGTTATGGGAACATACGGATACTGTGCTCCCGAGTATGCAATGACAGGCCAGCTAACACTCAAATCAGACGTTTACAGCTTCGGTGTTGTTCTGTTGGAGATTATAACTGGTCGGAAAGCAATAGACAGTTCAAGATCTACTGGAGAACAGAATCTAGTCGCATGGGCAAGGCCTTTGTTTAAAGACAGGAGGAAATTCTCTCAGATGGCTGATCCAATGCTTCAAGGTCAATACCCTCCGCGAGGGTTATACCAAGCACTCGCTGTAGCAGCGATGTGCGTACAAGAGCAGCCAAATCTTAGACCTCTCATTGCTGACGTCGTCACTGCACTTTCTTACCTCGCCTCCCAAAAGTTTGATCCTCTGGCTCAGCCAGTCCAAGGATCCCTTTTCGCTCCAGGGACTCCACCTAGATCAAAGAGGGTCTGA

SEQ ID NO: 1887 - DNA, 1250 bp, Arabidopsis thaliana
  misc_feature (1)..(1250): Ceres cDNA ID no. 12710302
  misc_feature (1)..(1250): Also known as  Ceres CDNA ID no. 23360242
tgaaagttcttaagtggttccacgatgtttccattttgttctgacttccgaggccaacgagatgagtccaataaacaaagggcacggaaacattctttttaaattagtcttcttgagatcgaaggataacttcaattcaattctctccaaggtacacacagctgatttttgtgataagaagattgattgagatgggtactagagctcagcagattcctttacttgaaggtgagactgataattacgatggtgttactgtaaccatggtggaacctatggattctgaggtttttactgaaagtcttagggcttctctttcgcattggagagaagaggggaagaagggaatttggataaagctgcctcttggattggctaatcttgtggaggctgcagttagtgaaggatttagatatcaccacgcggagcctgagtacttgatgcttgtatcttggatctctgaaactcctgatacaatcccagccaatgcttctcatgttgtaggtgctggtgctttggtcatcaacaaaaatactaaagaggtcctcgttgtccaggagaggagtgggtttttcaaagataaaaatgtgtggaagctgcctactggtgttatcaacgagggcgaggatatatggactggagtagctagggaagtggaagaagaaactggaattattgcagattttgtcgaagtactggctttcaggcaaagccacaaagccatcttaaaaaagaaaacagatatgtttttcctgtgtgtcttaagtccgcgctcttacgatattactgaacaaaaatctgagatcttgcaagctaagtggatgccgatccaagagtatgtagaccaaccatggaacaagaagaacgagatgttcaagttcatggctaacatttgccaaaagaagtgtgaggaagaatacttgggattcgccattgtgccaactaccacatcatctggtaaagagagctttatctactgcaatgcggatcatgccaagcgccttaaagtatcgcgtgaccaagcctctgcttctctctgaaaacattctcatctgattctgtttgatctcggcatgtgtgtgtccagtgtgtacaaaacaggaaactttcttctatattattccgattctacaaaattgcgtctaaatatttaagtttataccatctctatgagccactgtaaaacttgccatcgacttctagtctatttccagtgatggtttgattctcccaacgcttacgtgcttttt

SEQ ID NO: 1888 - protein, 1250 aa, Arabidopsis thaliana
  misc_feature: PFam Name: peroxidase; PFam Description: Peroxidase
  misc_feature: GI Number: 21593467; NR Description: peroxidase ATP13a
  misc_feature: GI Number: 31745133; NR Description: putative peroxidase [Arabidopsis thaliana] >gi|9759059|dbj|BAB09581.1| peroxidase [Arabidopsis thaliana] >gi|1429219|emb|CAA67312.1| peroxidase ATP13a [Arabidopsis thaliana] >gi|1402900|emb|CAA66966.1|
  misc_feature: GI Number: 21593692; NR Description: putative peroxidase
  misc_feature: GI Number: 51970002; NR Description: putative peroxidase
TGAAAGTTCTTAAGTGGTTCCACGATGTTTCCATTTTGTTCTGACTTCCGAGGCCAACGAGATGAGTCCAATAAACAAAGGGCACGGAAACATTCTTTTTAAATTAGTCTTCTTGAGATCGAAGGATAACTTCAATTCAATTCTCTCCAAGGTACACACAGCTGATTTTTGTGATAAGAAGATTGATTGAGATGGGTACTAGAGCTCAGCAGATTCCTTTACTTGAAGGTGAGACTGATAATTACGATGGTGTTACTGTAACCATGGTGGAACCTATGGATTCTGAGGTTTTTACTGAAAGTCTTAGGGCTTCTCTTTCGCATTGGAGAGAAGAGGGGAAGAAGGGAATTTGGATAAAGCTGCCTCTTGGATTGGCTAATCTTGTGGAGGCTGCAGTTAGTGAAGGATTTAGATATCACCACGCGGAGCCTGAGTACTTGATGCTTGTATCTTGGATCTCTGAAACTCCTGATACAATCCCAGCCAATGCTTCTCATGTTGTAGGTGCTGGTGCTTTGGTCATCAACAAAAATACTAAAGAGGTCCTCGTTGTCCAGGAGAGGAGTGGGTTTTTCAAAGATAAAAATGTGTGGAAGCTGCCTACTGGTGTTATCAACGAGGGCGAGGATATATGGACTGGAGTAGCTAGGGAAGTGGAAGAAGAAACTGGAATTATTGCAGATTTTGTCGAAGTACTGGCTTTCAGGCAAAGCCACAAAGCCATCTTAAAAAAGAAAACAGATATGTTTTTCCTGTGTGTCTTAAGTCCGCGCTCTTACGATATTACTGAACAAAAATCTGAGATCTTGCAAGCTAAGTGGATGCCGATCCAAGAGTATGTAGACCAACCATGGAACAAGAAGAACGAGATGTTCAAGTTCATGGCTAACATTTGCCAAAAGAAGTGTGAGGAAGAATACTTGGGATTCGCCATTGTGCCAACTACCACATCATCTGGTAAAGAGAGCTTTATCTACTGCAATGCGGATCATGCCAAGCGCCTTAAAGTATCGCGTGACCAAGCCTCTGCTTCTCTCTGAAAACATTCTCATCTGATTCTGTTTGATCTCGGCATGTGTGTGTCCAGTGTGTACAAAACAGGAAACTTTCTTCTATATTATTCCGATTCTACAAAATTGCGTCTAAATATTTAAGTTTATACCATCTCTATGAGCCACTGTAAAACTTGCCATCGACTTCTAGTCTATTTCCAGTGATGGTTTGATTCTCCCAACGCTTACGTGCTTTTT

SEQ ID NO: 1889 - DNA, 1469 bp, Arabidopsis thaliana
  misc_feature (1)..(1469): Ceres cDNA ID no. 12712025
  misc_feature (1)..(1469): Also known as  Ceres CDNA ID no. 23360242
aacactctcctccaaatcccagatctctctctgtctctgtcccgcggagtccccgagagattgatcaccatcacttttgtaccttccttgtactacctatggcgtctgctagcttcgttaagcctaacaccctctcttctccatggatcggccaacgctcctttgctcacacctctgcttcttcttctcctcctcctcgagtctccttcgcgatccgcgccggtgcttactccgacgagcttgttaaaaccgccaaaagcattgcatcccctgggagaggtatcttggcgatcgatgagtccaatgcaacctgtgggaagaggcttgcttctatcggcttggataacaccgaggacaaccgtcaggcctacaggcaacttctgcttaccactcctggcctcggcgattacatctctggttccattctcttcgaggagactctttaccagtccaccaaggacggtaagacctttgtcgattgcttgcgcgatgccaacatcgtccctggcatcaaagttgacaagggcttgtctcccctagccggttccaacgaagagtcttggtgccaaggcttggatggattggcctcacgctctgctgagtactacaagcaaggcgctcgttttgccaagtggaggacagtggtgagtgttccctgcggtccttcagcactggctgtgaaggaagctgcgtgggggctggctcgctatgcagccatctctcaggataatggtcttgtccccattgtggagccagagatccttctggacggggaccacccaatagagaggactctggaggtggcagagaaagtgtggtcagaggtgttcttctacttggcacagaacaacgtcatgtttgagggcattctgttgaagccgagcatggtcaccccaggcgctgagcacaagaacaaggcctctcccgagaccgttgcagatttcacgctcaccatgctgaaaaggagggttcctccggctgtcccagggatcatgtttctgtcaggaggacaatcagaggcagaggccacactgaacctgaacgccatgaaccagagcccaaacccatggcatgtgtccttctcatacgcacgtgccctgcagaactccgtgctcagaacatggcaaggcaagccggagaagattgaggcctcgcagaaggcactgttggtgagggcaaaggccaactcactggcccagctcggcaaatactcagccgagggagagaacgaggatgccaagaaaggaatgtttgtcaagggttacacctactgatttgttaatttcagagatcgtaataaggattaaggaccattgttgtcttttgtttttttttcccttttttgttttgtctctgagaaagaaagacagtcacgagtcacgatcatatcatatatgtatgtgagcaacgtgaaaacatcctcttaaatctatatttcctctcagaaagactgattactgtttgactgc

SEQ ID NO: 1890 - protein, 1469 aa, Arabidopsis thaliana
  misc_feature: PFam Name: peroxidase; PFam Description: Peroxidase
  misc_feature: GI Number: 21593467; NR Description: peroxidase ATP13a
  misc_feature: GI Number: 31745133; NR Description: putative peroxidase [Arabidopsis thaliana] >gi|9759059|dbj|BAB09581.1| peroxidase [Arabidopsis thaliana] >gi|1429219|emb|CAA67312.1| peroxidase ATP13a [Arabidopsis thaliana] >gi|1402900|emb|CAA66966.1|
  misc_feature: GI Number: 21593692; NR Description: putative peroxidase
  misc_feature: GI Number: 51970002; NR Description: putative peroxidase
AACACTCTCCTCCAAATCCCAGATCTCTCTCTGTCTCTGTCCCGCGGAGTCCCCGAGAGATTGATCACCATCACTTTTGTACCTTCCTTGTACTACCTATGGCGTCTGCTAGCTTCGTTAAGCCTAACACCCTCTCTTCTCCATGGATCGGCCAACGCTCCTTTGCTCACACCTCTGCTTCTTCTTCTCCTCCTCCTCGAGTCTCCTTCGCGATCCGCGCCGGTGCTTACTCCGACGAGCTTGTTAAAACCGCCAAAAGCATTGCATCCCCTGGGAGAGGTATCTTGGCGATCGATGAGTCCAATGCAACCTGTGGGAAGAGGCTTGCTTCTATCGGCTTGGATAACACCGAGGACAACCGTCAGGCCTACAGGCAACTTCTGCTTACCACTCCTGGCCTCGGCGATTACATCTCTGGTTCCATTCTCTTCGAGGAGACTCTTTACCAGTCCACCAAGGACGGTAAGACCTTTGTCGATTGCTTGCGCGATGCCAACATCGTCCCTGGCATCAAAGTTGACAAGGGCTTGTCTCCCCTAGCCGGTTCCAACGAAGAGTCTTGGTGCCAAGGCTTGGATGGATTGGCCTCACGCTCTGCTGAGTACTACAAGCAAGGCGCTCGTTTTGCCAAGTGGAGGACAGTGGTGAGTGTTCCCTGCGGTCCTTCAGCACTGGCTGTGAAGGAAGCTGCGTGGGGGCTGGCTCGCTATGCAGCCATCTCTCAGGATAATGGTCTTGTCCCCATTGTGGAGCCAGAGATCCTTCTGGACGGGGACCACCCAATAGAGAGGACTCTGGAGGTGGCAGAGAAAGTGTGGTCAGAGGTGTTCTTCTACTTGGCACAGAACAACGTCATGTTTGAGGGCATTCTGTTGAAGCCGAGCATGGTCACCCCAGGCGCTGAGCACAAGAACAAGGCCTCTCCCGAGACCGTTGCAGATTTCACGCTCACCATGCTGAAAAGGAGGGTTCCTCCGGCTGTCCCAGGGATCATGTTTCTGTCAGGAGGACAATCAGAGGCAGAGGCCACACTGAACCTGAACGCCATGAACCAGAGCCCAAACCCATGGCATGTGTCCTTCTCATACGCACGTGCCCTGCAGAACTCCGTGCTCAGAACATGGCAAGGCAAGCCGGAGAAGATTGAGGCCTCGCAGAAGGCACTGTTGGTGAGGGCAAAGGCCAACTCACTGGCCCAGCTCGGCAAATACTCAGCCGAGGGAGAGAACGAGGATGCCAAGAAAGGAATGTTTGTCAAGGGTTACACCTACTGATTTGTTAATTTCAGAGATCGTAATAAGGATTAAGGACCATTGTTGTCTTTTGTTTTTTTTTCCCTTTTTTGTTTTGTCTCTGAGAAAGAAAGACAGTCACGAGTCACGATCATATCATATATGTATGTGAGCAACGTGAAAACATCCTCTTAAATCTATATTTCCTCTCAGAAAGACTGATTACTGTTTGACTGC

SEQ ID NO: 1891 - DNA, 894 bp, Arabidopsis thaliana
  misc_feature (1)..(894): Ceres cDNA ID no. 12712240
  misc_feature (1)..(894): Also known as  Ceres CDNA ID no. 23360242
atggagactccatatccgaaactcatcgatccttcaaagactcgaataggatggattggcatcgggataatgggatcggccatggtttctcatattatcgccgcaggctattctgtcacagtttacgctcgcgacctccggaaaacaaaagatctgcaaaccaaaggagctcgcatagccaatagccccaaagagttagcggagatgagcgacgttgtgttcacgattgttggaaacttcaacgatgtccgatcattgcttctcggtgacgatggtgtactctctggtcttacgcccggtggagtaacagtggacatgactagtagcaaaccaggattggcgcgtgaaatacacgcagaagcgaggcgtaggaattgttgggcggtggatgcgccggtatcaggtggagacgctggagcacgagaggggacgttagggattttcgccggcggagattcagagattgtggagtggttgtccccggtgatgaagaatatagggactgttacttatatgggagaagcagggagtgggcaaagctgcaagatagggaatcagattgctggtgcgagcaacctggttggacttgctgaagggatagtgttcgctgagaaagcgggtttagatacagtgaaatggctcgaggcggtgaaggatggtgcagctggatcggcggttatgcggctgtttggggagatgattgtgaagagggattatagggcgactggctttgcggagtatatggtgaaagatttgggaatggctgcagaggcggcgatgcctggtgctgctctgagcaagcagttgttcactggaatggtggctaatggagatggcaagttaggtattcaaggcgtcgtctctgttattagaagacttaacggcatatcctga

SEQ ID NO: 1892 - protein, 894 aa, Arabidopsis thaliana
  misc_feature: PFam Name: peroxidase; PFam Description: Peroxidase
  misc_feature: GI Number: 21593467; NR Description: peroxidase ATP13a
  misc_feature: GI Number: 31745133; NR Description: putative peroxidase [Arabidopsis thaliana] >gi|9759059|dbj|BAB09581.1| peroxidase [Arabidopsis thaliana] >gi|1429219|emb|CAA67312.1| peroxidase ATP13a [Arabidopsis thaliana] >gi|1402900|emb|CAA66966.1|
  misc_feature: GI Number: 21593692; NR Description: putative peroxidase
  misc_feature: GI Number: 51970002; NR Description: putative peroxidase
ATGGAGACTCCATATCCGAAACTCATCGATCCTTCAAAGACTCGAATAGGATGGATTGGCATCGGGATAATGGGATCGGCCATGGTTTCTCATATTATCGCCGCAGGCTATTCTGTCACAGTTTACGCTCGCGACCTCCGGAAAACAAAAGATCTGCAAACCAAAGGAGCTCGCATAGCCAATAGCCCCAAAGAGTTAGCGGAGATGAGCGACGTTGTGTTCACGATTGTTGGAAACTTCAACGATGTCCGATCATTGCTTCTCGGTGACGATGGTGTACTCTCTGGTCTTACGCCCGGTGGAGTAACAGTGGACATGACTAGTAGCAAACCAGGATTGGCGCGTGAAATACACGCAGAAGCGAGGCGTAGGAATTGTTGGGCGGTGGATGCGCCGGTATCAGGTGGAGACGCTGGAGCACGAGAGGGGACGTTAGGGATTTTCGCCGGCGGAGATTCAGAGATTGTGGAGTGGTTGTCCCCGGTGATGAAGAATATAGGGACTGTTACTTATATGGGAGAAGCAGGGAGTGGGCAAAGCTGCAAGATAGGGAATCAGATTGCTGGTGCGAGCAACCTGGTTGGACTTGCTGAAGGGATAGTGTTCGCTGAGAAAGCGGGTTTAGATACAGTGAAATGGCTCGAGGCGGTGAAGGATGGTGCAGCTGGATCGGCGGTTATGCGGCTGTTTGGGGAGATGATTGTGAAGAGGGATTATAGGGCGACTGGCTTTGCGGAGTATATGGTGAAAGATTTGGGAATGGCTGCAGAGGCGGCGATGCCTGGTGCTGCTCTGAGCAAGCAGTTGTTCACTGGAATGGTGGCTAATGGAGATGGCAAGTTAGGTATTCAAGGCGTCGTCTCTGTTATTAGAAGACTTAACGGCATATCCTGA

SEQ ID NO: 1893 - DNA, 1061 bp, Arabidopsis thaliana
  misc_feature (1)..(1061): Ceres cDNA ID no. 12712255
  misc_feature (1)..(1061): Also known as  Ceres CDNA ID no. 23360242
atggagactcagtatccgaaactaatcgaaccatccaagacccgaattggatggattgggatcgggataatgggatcagcgatggtttctcatatcctcgccgcaggctattcagtcaccgtttatgctcgcgatcttcgtaaaacaaaggatctgcaaaccaaaggaggtcgtaccgccaatagccccaaagagttaggggagatgagcgacgttgtgttcacgatcgttggaaactctaacgatgttagatcgttgcttcttggggatgatggtgtactctctggtcttaaacccggtggagtaacagtggacatgactagtagcaagccaggattggcgcgtgagatatacgcggaggcgaggcggagggattgctgggcggtggatgcgcctgtatcgggtggagacgctggagcacgtgaggggaagctaacgatattcgccggcggagattccgagattgtggagtggttggctccggtgatgaaaacgatgggaattgtgaggtttatgggaggagctgggagtggacagagctgtaaaattgggaatcagatttgtgttggaagcaacatgattggattagctgaagggattgtgtttgctgagaaggcgggtttagatccggtgaaatggcttgaggcggttaaggacggtgcagctggatcggcggttatgcggcttttcggggagatgatggcggtgagggactataaggcgacggggtttgcggagtatatggtgaaagatttgggaatggcggcggaggcggcaatggcgatgcctggaactgctttgaacaagcagttgttcactgtaatggtggcaaatggagatgggaagttaggatttcaaggcgtcgtcgatgttattaggagacttaacggcttatcctgataaaactagtgttaactaggcaagcttgttttccatttggttagaagttgctaataagaacatggagtctcaccaatctcgagaactatagttacaagagtgtgtaacattagtttccaattggattatcaacttctacctcctataactatttctctgtt

SEQ ID NO: 1894 - protein, 1061 aa, Arabidopsis thaliana
  misc_feature: PFam Name: peroxidase; PFam Description: Peroxidase
  misc_feature: GI Number: 21593467; NR Description: peroxidase ATP13a
  misc_feature: GI Number: 31745133; NR Description: putative peroxidase [Arabidopsis thaliana] >gi|9759059|dbj|BAB09581.1| peroxidase [Arabidopsis thaliana] >gi|1429219|emb|CAA67312.1| peroxidase ATP13a [Arabidopsis thaliana] >gi|1402900|emb|CAA66966.1|
  misc_feature: GI Number: 21593692; NR Description: putative peroxidase
  misc_feature: GI Number: 51970002; NR Description: putative peroxidase
ATGGAGACTCAGTATCCGAAACTAATCGAACCATCCAAGACCCGAATTGGATGGATTGGGATCGGGATAATGGGATCAGCGATGGTTTCTCATATCCTCGCCGCAGGCTATTCAGTCACCGTTTATGCTCGCGATCTTCGTAAAACAAAGGATCTGCAAACCAAAGGAGGTCGTACCGCCAATAGCCCCAAAGAGTTAGGGGAGATGAGCGACGTTGTGTTCACGATCGTTGGAAACTCTAACGATGTTAGATCGTTGCTTCTTGGGGATGATGGTGTACTCTCTGGTCTTAAACCCGGTGGAGTAACAGTGGACATGACTAGTAGCAAGCCAGGATTGGCGCGTGAGATATACGCGGAGGCGAGGCGGAGGGATTGCTGGGCGGTGGATGCGCCTGTATCGGGTGGAGACGCTGGAGCACGTGAGGGGAAGCTAACGATATTCGCCGGCGGAGATTCCGAGATTGTGGAGTGGTTGGCTCCGGTGATGAAAACGATGGGAATTGTGAGGTTTATGGGAGGAGCTGGGAGTGGACAGAGCTGTAAAATTGGGAATCAGATTTGTGTTGGAAGCAACATGATTGGATTAGCTGAAGGGATTGTGTTTGCTGAGAAGGCGGGTTTAGATCCGGTGAAATGGCTTGAGGCGGTTAAGGACGGTGCAGCTGGATCGGCGGTTATGCGGCTTTTCGGGGAGATGATGGCGGTGAGGGACTATAAGGCGACGGGGTTTGCGGAGTATATGGTGAAAGATTTGGGAATGGCGGCGGAGGCGGCAATGGCGATGCCTGGAACTGCTTTGAACAAGCAGTTGTTCACTGTAATGGTGGCAAATGGAGATGGGAAGTTAGGATTTCAAGGCGTCGTCGATGTTATTAGGAGACTTAACGGCTTATCCTGATAAAACTAGTGTTAACTAGGCAAGCTTGTTTTCCATTTGGTTAGAAGTTGCTAATAAGAACATGGAGTCTCACCAATCTCGAGAACTATAGTTACAAGAGTGTGTAACATTAGTTTCCAATTGGATTATCAACTTCTACCTCCTATAACTATTTCTCTGTT

SEQ ID NO: 1895 - DNA, 1546 bp, Arabidopsis thaliana
  misc_feature (1)..(1546): Ceres cDNA ID no. 12712755
  misc_feature (1)..(1546): Ceres CLONE  ID no. 262351
  misc_feature (1)..(1546): Also known as  Ceres CDNA ID no. 23388476
agagcttccacttccatcgtcgtcttctattttttcttctttcttcgatttcataccaaaacaagaactctctgttttcgacaaaaacgaaaccttgagatctattttgattgacttttaagaaagagagagatctttcttagaagattttgtctcgtcggcattgaagatccagggtttgtctttcgaaattcagagagaaaatgggtgatgaggcagagatcaaggaacatttaaagccacaagcttcatctgaaacaatggacaagaaacataatgtgaaagggaagaggttatggcagaaagtcaagtatcaattggtggagtttcattcattgcctgcttatttaagagacaatgagtacatcattggtcattaccgatccgaatggccgatcaaacagattcttctcagcatctttaccattcataatgagactttgaatgtttggacgcacttgattgggtttttcctgtttttggcgctcactatatacactgcaacgaaagtaccgagtgtcgtggatcttcattcgcttcaacaccgtttacccgatttgttgaggaaaacagatctccacaaacttcattctgagctcatggctcgccttccttctagtccatctagttggcatgtgatggaccttctttataactgtttgcctgaaagattttctcatggcaactacactgacatgtgtgttctgcattctgtgagggaagatcttgcaaacttgatagctcctttgatcttcaggccaattactcgatggccgttttatgcatttctaggtggtgctatgttctgtctattagcaagcagcacgtgccacctcctctcatgtcactccgagcgagtctcctacataatgcttaggcttgattacgccggcatcgcagctctaatagcgacttccttctaccctccggtttattactccttcatgtgtgatcctttcttctgcaacctctacttaggattcataaccatcttaggaatcgccactgtgcttgtttctctcctcccggttttccaaagcccggagtttcgggtggtgagggcgtctctgttctttggaatgggattctctggcttagctccgattcttcacaagctgataatcttttgggaccaacctgaagcccttcacacgacaggttatgagattttgatgggtttgctttatgggttaggagctctggtttatgcaactaggatcccagagagatggatgccgggtaaattcgatatagcaggacatagccatcagttgtttcatgttctggttgttgctggtgcgttcacgcactatagagctgggctagtgtatcttaagtggagagatattgaaggatgttgaagatgaagattgaagattagatggaatctttgaatcttgtttgtagtagcttcatataaaagttggattatgtaaagtcttatatgtaatcaaacgtttaattgtttcctttattcaacaaaggatttatattgttaatccacatatgtattactggttaaagaagctgaaggattcatattttt

SEQ ID NO: 1896 - protein, 1546 aa, Arabidopsis thaliana
  misc_feature: PFam Name: HlyIII; PFam Description: Haemolysin-III related
  misc_feature: GI Number: 51535508; NR Description: putative adiponectin receptor 1 [Oryza sativa (japonica cultivar-group)] >gi|51535474|dbj|BAD37371.1| putative adiponectin receptor 1 [Oryza
  misc_feature: GI Number: 31209635; NR Description: ENSANGP00000012224 [Anopheles gambiae] >gi|30176836|gb|EAA09141.2| ENSANGP00000012224
  misc_feature: GI Number: 25396071; NR Description: protein C43G2.1
  misc_feature: GI Number: 17555616; NR Description: i-45 protein (3G466)
  misc_feature: GI Number: 51593696; NR Description: MGC85478 protein
AGAGCTTCCACTTCCATCGTCGTCTTCTATTTTTTCTTCTTTCTTCGATTTCATACCAAAACAAGAACTCTCTGTTTTCGACAAAAACGAAACCTTGAGATCTATTTTGATTGACTTTTAAGAAAGAGAGAGATCTTTCTTAGAAGATTTTGTCTCGTCGGCATTGAAGATCCAGGGTTTGTCTTTCGAAATTCAGAGAGAAAATGGGTGATGAGGCAGAGATCAAGGAACATTTAAAGCCACAAGCTTCATCTGAAACAATGGACAAGAAACATAATGTGAAAGGGAAGAGGTTATGGCAGAAAGTCAAGTATCAATTGGTGGAGTTTCATTCATTGCCTGCTTATTTAAGAGACAATGAGTACATCATTGGTCATTACCGATCCGAATGGCCGATCAAACAGATTCTTCTCAGCATCTTTACCATTCATAATGAGACTTTGAATGTTTGGACGCACTTGATTGGGTTTTTCCTGTTTTTGGCGCTCACTATATACACTGCAACGAAAGTACCGAGTGTCGTGGATCTTCATTCGCTTCAACACCGTTTACCCGATTTGTTGAGGAAAACAGATCTCCACAAACTTCATTCTGAGCTCATGGCTCGCCTTCCTTCTAGTCCATCTAGTTGGCATGTGATGGACCTTCTTTATAACTGTTTGCCTGAAAGATTTTCTCATGGCAACTACACTGACATGTGTGTTCTGCATTCTGTGAGGGAAGATCTTGCAAACTTGATAGCTCCTTTGATCTTCAGGCCAATTACTCGATGGCCGTTTTATGCATTTCTAGGTGGTGCTATGTTCTGTCTATTAGCAAGCAGCACGTGCCACCTCCTCTCATGTCACTCCGAGCGAGTCTCCTACATAATGCTTAGGCTTGATTACGCCGGCATCGCAGCTCTAATAGCGACTTCCTTCTACCCTCCGGTTTATTACTCCTTCATGTGTGATCCTTTCTTCTGCAACCTCTACTTAGGATTCATAACCATCTTAGGAATCGCCACTGTGCTTGTTTCTCTCCTCCCGGTTTTCCAAAGCCCGGAGTTTCGGGTGGTGAGGGCGTCTCTGTTCTTTGGAATGGGATTCTCTGGCTTAGCTCCGATTCTTCACAAGCTGATAATCTTTTGGGACCAACCTGAAGCCCTTCACACGACAGGTTATGAGATTTTGATGGGTTTGCTTTATGGGTTAGGAGCTCTGGTTTATGCAACTAGGATCCCAGAGAGATGGATGCCGGGTAAATTCGATATAGCAGGACATAGCCATCAGTTGTTTCATGTTCTGGTTGTTGCTGGTGCGTTCACGCACTATAGAGCTGGGCTAGTGTATCTTAAGTGGAGAGATATTGAAGGATGTTGAAGATGAAGATTGAAGATTAGATGGAATCTTTGAATCTTGTTTGTAGTAGCTTCATATAAAAGTTGGATTATGTAAAGTCTTATATGTAATCAAACGTTTAATTGTTTCCTTTATTCAACAAAGGATTTATATTGTTAATCCACATATGTATTACTGGTTAAAGAAGCTGAAGGATTCATATTTTT

SEQ ID NO: 1897 - DNA, 1293 bp, Arabidopsis thaliana
  misc_feature (1)..(1293): Ceres cDNA ID no. 12713545
  misc_feature (1)..(1293): Also known as  Ceres CDNA ID no. 23388476
atgctgagacttagaaagaagcaacatttggtgtttctactatgcgtgtggtgtttggtggtggattggagcaaagcagaaacagaggaaagtgatggaagtcccatggagaaaacagagcaagctgctctatactctaccattcaaggctttgttggtgaatcttggaatggctcttatctttatcctgacccttgtggctggactcctatccagggtgtgacttgtgatatctatgatgagctttggtatgtaactgctctaagctttgggactatgaaagacaactctcttgcttgttctgaaagtccagtgatcagaccacaactctttgagctcaagcacctcaagtctctctctcttttcaactgcttcacaacgcctaaccgatatctagcttcaatctccgatgaaaagtggttggatctctctaaaagcttggagagacttgagatcagatcaaacccgggactgataggtgaactcccttctgtcatcactaacctcaccaaccttcaatctctggtggtgctagaaaacaagttaacaggtccattgccagtgaatttggccaagttaaccagattgagacgtttagtactgtctggaaaccggttcacagggagaatacctgaggtctacgggttaaccggattgttgatattggatgtgagcaggaatttcttatctggggcgttgcctttaagcgttggaggattgtattctctgctgaaacttgatcttagtaacaattacttggaaggaaagttacctagagagctagagtccttgaagaatctcactctattggacttgagaaacaacagattatcaggtgggttgagtaaagagatccaagagatgacttctttggtagaactggttctgtccaataatcgcctagccggggacttgacaggaataaagtggagaaatctgaagaatttagtggttcttgatctctccaacacaggcttaaaaggggagattcctggttcaatcttggagctcaagaaactgaggtttttgggtttgagcaacaacaatctcggaggcaaactcattccacaaatggaaaccgaaatgcctagtctcagcgcgctttacgtgaatggaaataacatcagcggagagttggaattctctaggtacttttatgagagaatgggaaggagacttggtgtttgggggaaccctaatctgtgttacaacggagatgagaccaagaaccttagcgatcatgttcctttcggagtgaaccaatgtaagagaattaaggcagataaatattag

SEQ ID NO: 1898 - protein, 1293 aa, Arabidopsis thaliana
  misc_feature: PFam Name: HlyIII; PFam Description: Haemolysin-III related
  misc_feature: GI Number: 51535508; NR Description: putative adiponectin receptor 1 [Oryza sativa (japonica cultivar-group)] >gi|51535474|dbj|BAD37371.1| putative adiponectin receptor 1 [Oryza
  misc_feature: GI Number: 31209635; NR Description: ENSANGP00000012224 [Anopheles gambiae] >gi|30176836|gb|EAA09141.2| ENSANGP00000012224
  misc_feature: GI Number: 25396071; NR Description: protein C43G2.1
  misc_feature: GI Number: 17555616; NR Description: i-45 protein (3G466)
  misc_feature: GI Number: 51593696; NR Description: MGC85478 protein
ATGCTGAGACTTAGAAAGAAGCAACATTTGGTGTTTCTACTATGCGTGTGGTGTTTGGTGGTGGATTGGAGCAAAGCAGAAACAGAGGAAAGTGATGGAAGTCCCATGGAGAAAACAGAGCAAGCTGCTCTATACTCTACCATTCAAGGCTTTGTTGGTGAATCTTGGAATGGCTCTTATCTTTATCCTGACCCTTGTGGCTGGACTCCTATCCAGGGTGTGACTTGTGATATCTATGATGAGCTTTGGTATGTAACTGCTCTAAGCTTTGGGACTATGAAAGACAACTCTCTTGCTTGTTCTGAAAGTCCAGTGATCAGACCACAACTCTTTGAGCTCAAGCACCTCAAGTCTCTCTCTCTTTTCAACTGCTTCACAACGCCTAACCGATATCTAGCTTCAATCTCCGATGAAAAGTGGTTGGATCTCTCTAAAAGCTTGGAGAGACTTGAGATCAGATCAAACCCGGGACTGATAGGTGAACTCCCTTCTGTCATCACTAACCTCACCAACCTTCAATCTCTGGTGGTGCTAGAAAACAAGTTAACAGGTCCATTGCCAGTGAATTTGGCCAAGTTAACCAGATTGAGACGTTTAGTACTGTCTGGAAACCGGTTCACAGGGAGAATACCTGAGGTCTACGGGTTAACCGGATTGTTGATATTGGATGTGAGCAGGAATTTCTTATCTGGGGCGTTGCCTTTAAGCGTTGGAGGATTGTATTCTCTGCTGAAACTTGATCTTAGTAACAATTACTTGGAAGGAAAGTTACCTAGAGAGCTAGAGTCCTTGAAGAATCTCACTCTATTGGACTTGAGAAACAACAGATTATCAGGTGGGTTGAGTAAAGAGATCCAAGAGATGACTTCTTTGGTAGAACTGGTTCTGTCCAATAATCGCCTAGCCGGGGACTTGACAGGAATAAAGTGGAGAAATCTGAAGAATTTAGTGGTTCTTGATCTCTCCAACACAGGCTTAAAAGGGGAGATTCCTGGTTCAATCTTGGAGCTCAAGAAACTGAGGTTTTTGGGTTTGAGCAACAACAATCTCGGAGGCAAACTCATTCCACAAATGGAAACCGAAATGCCTAGTCTCAGCGCGCTTTACGTGAATGGAAATAACATCAGCGGAGAGTTGGAATTCTCTAGGTACTTTTATGAGAGAATGGGAAGGAGACTTGGTGTTTGGGGGAACCCTAATCTGTGTTACAACGGAGATGAGACCAAGAACCTTAGCGATCATGTTCCTTTCGGAGTGAACCAATGTAAGAGAATTAAGGCAGATAAATATTAG

SEQ ID NO: 1899 - DNA, 1029 bp, Arabidopsis thaliana
  misc_feature (1)..(1029): Ceres cDNA ID no. 12713791
  misc_feature (1)..(1029): Also known as  Ceres CDNA ID no. 23388476
atgaaagtcaagtatcaattggtggagtttcattcattgcctgcttatttaagagacaatgagtacatcattggtcattaccgatccgaatggccgatcaaacagattcttctcagcatctttaccattcataatgagactttgaatgtttggacgcatttgattgggtttttcctgtttttggcactcactatatacactgcaacgaaagtaccgagtgtcgtggatcttcattcgcttcaacaccgtttacccgatttgttgaggaaaacagatctccacaaacttcattctgagctcatgtctcgccttccttctagtccatctagttggcatgtgatggaccttctttataactgtttgcctgaaagattttctcatggcaactacactgacatgtgtgttctgcattctgtgagggaagatcttgcaaacttgatagctcctttgatcttcaggccaattactcgatggccgttttatgcatttctaggtggtgctatattctgtctattagcaagcagcacgtgccacctcctctcatgtcactccgagcgagtctcctacataatgcttaggcttgattacgccggcatcgcagctctaatagcgacttccttctaccctccggtttattactccttcatgtgtgatcctttcttctgcaacctctacttaggattcataaccatcttaggaatcgccactgtgcttgtttctctcctcccggttttccaaagcctggagtttcgggtggtgagggcgtctctgttctttggaatgggattctctggcttagctccgattcttcacaagctgatcatcttttgggaccaacctgaagcccttcacatgacaggttatgagattttgatgggtttgctttatgggttaggagctgtggtttatgcaactaggatcccagagagatggatgccgggtaaattcgatatagcaggacatagccatcagttgtttcatgttctggttgttgctggtgcgttaacgcactatagagctgggctatga

SEQ ID NO: 1900 - protein, 1029 aa, Arabidopsis thaliana
  misc_feature: PFam Name: HlyIII; PFam Description: Haemolysin-III related
  misc_feature: GI Number: 51535508; NR Description: putative adiponectin receptor 1 [Oryza sativa (japonica cultivar-group)] >gi|51535474|dbj|BAD37371.1| putative adiponectin receptor 1 [Oryza
  misc_feature: GI Number: 31209635; NR Description: ENSANGP00000012224 [Anopheles gambiae] >gi|30176836|gb|EAA09141.2| ENSANGP00000012224
  misc_feature: GI Number: 25396071; NR Description: protein C43G2.1
  misc_feature: GI Number: 17555616; NR Description: i-45 protein (3G466)
  misc_feature: GI Number: 51593696; NR Description: MGC85478 protein
ATGAAAGTCAAGTATCAATTGGTGGAGTTTCATTCATTGCCTGCTTATTTAAGAGACAATGAGTACATCATTGGTCATTACCGATCCGAATGGCCGATCAAACAGATTCTTCTCAGCATCTTTACCATTCATAATGAGACTTTGAATGTTTGGACGCATTTGATTGGGTTTTTCCTGTTTTTGGCACTCACTATATACACTGCAACGAAAGTACCGAGTGTCGTGGATCTTCATTCGCTTCAACACCGTTTACCCGATTTGTTGAGGAAAACAGATCTCCACAAACTTCATTCTGAGCTCATGTCTCGCCTTCCTTCTAGTCCATCTAGTTGGCATGTGATGGACCTTCTTTATAACTGTTTGCCTGAAAGATTTTCTCATGGCAACTACACTGACATGTGTGTTCTGCATTCTGTGAGGGAAGATCTTGCAAACTTGATAGCTCCTTTGATCTTCAGGCCAATTACTCGATGGCCGTTTTATGCATTTCTAGGTGGTGCTATATTCTGTCTATTAGCAAGCAGCACGTGCCACCTCCTCTCATGTCACTCCGAGCGAGTCTCCTACATAATGCTTAGGCTTGATTACGCCGGCATCGCAGCTCTAATAGCGACTTCCTTCTACCCTCCGGTTTATTACTCCTTCATGTGTGATCCTTTCTTCTGCAACCTCTACTTAGGATTCATAACCATCTTAGGAATCGCCACTGTGCTTGTTTCTCTCCTCCCGGTTTTCCAAAGCCTGGAGTTTCGGGTGGTGAGGGCGTCTCTGTTCTTTGGAATGGGATTCTCTGGCTTAGCTCCGATTCTTCACAAGCTGATCATCTTTTGGGACCAACCTGAAGCCCTTCACATGACAGGTTATGAGATTTTGATGGGTTTGCTTTATGGGTTAGGAGCTGTGGTTTATGCAACTAGGATCCCAGAGAGATGGATGCCGGGTAAATTCGATATAGCAGGACATAGCCATCAGTTGTTTCATGTTCTGGTTGTTGCTGGTGCGTTAACGCACTATAGAGCTGGGCTATGA

SEQ ID NO: 1901 - DNA, 876 bp, Arabidopsis thaliana
  misc_feature (1)..(876): Ceres cDNA ID no. 12714246
  misc_feature (1)..(876): Also known as  Ceres CDNA ID no. 23388476
atgggttgcgtctcatctaacctcctaaaccacgacgaagacttctctcaaatcggcggtggaagctccgccttcggtcaccacatcgtcaaactaacctccaccacttatggtcttctcacactcgatcctcctcctcctccttctcctcctatgacgccgccggagaaattcacagtcgatacaaaatctaagtcaatatggtctgagccaagggtgataaagtcggaaccggagattattaactcttgggagttaatgtctggtctcgacggagagagtttccgattcacagaggattcggattctaattcgagaagccctagaaaatcgtttaaaccgttagatttgaaattggatgagaaatttgagaggatttgtccaccaggaggagagaatcgtgtggtgatgtacacgacgtcgttgcgaggtgttcgtcaaacgtttgaggcgtgtaacgctgtgagagcggcggtggagagttttggtgttgtggtttgcgagagagatgtgtcgatggatagaaggtttagagaagagcttgtgagtctaatggcgaagagagttggggatgagggagtggctgcattgccgcctcgggtttttgtgaagggaaggtacattggtggaggagaggaagtgttgagactagttgaggaaggttctttcggagagctgatcagcgggattccgagaaagaaagcgggaggatgcgagagcggcgcgtgtgatggttgcggcggtttgtttttcttgccgtgttttcggtgtaatggaagctgtaagatggtgaaaggatggggtagtgcttcggtggttgtgagatgtaatgagtgtaatgagaatggtcttgttccatgtcctatttgcagttga

SEQ ID NO: 1902 - protein, 876 aa, Arabidopsis thaliana
  misc_feature: PFam Name: HlyIII; PFam Description: Haemolysin-III related
  misc_feature: GI Number: 51535508; NR Description: putative adiponectin receptor 1 [Oryza sativa (japonica cultivar-group)] >gi|51535474|dbj|BAD37371.1| putative adiponectin receptor 1 [Oryza
  misc_feature: GI Number: 31209635; NR Description: ENSANGP00000012224 [Anopheles gambiae] >gi|30176836|gb|EAA09141.2| ENSANGP00000012224
  misc_feature: GI Number: 25396071; NR Description: protein C43G2.1
  misc_feature: GI Number: 17555616; NR Description: i-45 protein (3G466)
  misc_feature: GI Number: 51593696; NR Description: MGC85478 protein
ATGGGTTGCGTCTCATCTAACCTCCTAAACCACGACGAAGACTTCTCTCAAATCGGCGGTGGAAGCTCCGCCTTCGGTCACCACATCGTCAAACTAACCTCCACCACTTATGGTCTTCTCACACTCGATCCTCCTCCTCCTCCTTCTCCTCCTATGACGCCGCCGGAGAAATTCACAGTCGATACAAAATCTAAGTCAATATGGTCTGAGCCAAGGGTGATAAAGTCGGAACCGGAGATTATTAACTCTTGGGAGTTAATGTCTGGTCTCGACGGAGAGAGTTTCCGATTCACAGAGGATTCGGATTCTAATTCGAGAAGCCCTAGAAAATCGTTTAAACCGTTAGATTTGAAATTGGATGAGAAATTTGAGAGGATTTGTCCACCAGGAGGAGAGAATCGTGTGGTGATGTACACGACGTCGTTGCGAGGTGTTCGTCAAACGTTTGAGGCGTGTAACGCTGTGAGAGCGGCGGTGGAGAGTTTTGGTGTTGTGGTTTGCGAGAGAGATGTGTCGATGGATAGAAGGTTTAGAGAAGAGCTTGTGAGTCTAATGGCGAAGAGAGTTGGGGATGAGGGAGTGGCTGCATTGCCGCCTCGGGTTTTTGTGAAGGGAAGGTACATTGGTGGAGGAGAGGAAGTGTTGAGACTAGTTGAGGAAGGTTCTTTCGGAGAGCTGATCAGCGGGATTCCGAGAAAGAAAGCGGGAGGATGCGAGAGCGGCGCGTGTGATGGTTGCGGCGGTTTGTTTTTCTTGCCGTGTTTTCGGTGTAATGGAAGCTGTAAGATGGTGAAAGGATGGGGTAGTGCTTCGGTGGTTGTGAGATGTAATGAGTGTAATGAGAATGGTCTTGTTCCATGTCCTATTTGCAGTTGA

SEQ ID NO: 1903 - DNA, 1245 bp, Arabidopsis thaliana
  misc_feature (1)..(1245): Ceres cDNA ID no. 12714490
  misc_feature (1)..(1245): Ceres CLONE  ID no. 35499
  misc_feature (1)..(1245): Also known as  Ceres CDNA ID no. 23369361
ctcataagtcattataatagtttcccccggattgttttttctttctttttgctaatcatcatcggtttcttctaatcaaaaaaaaaaacaaaaaaaaaagagggactacgttcgtacaatcccatccttggtatggatttctggccggagtttatggcgaccagctggggaagagagttcgtcgccggtggtttcggtggcgtcgccggcatcatctccggctaccccttggacaccctcagaattcgccagcaacagagctcgaaatctggatctgccttctccattctccggcggatgctcgccattgagggtccctcctctctctacagaggcatggctgcgcctttggcctccgtcacttttcagaatgctatggtattccagatatacgccatattctctcgctcttttgattcctctgttcctctggtagagcctccttcctacagaggcgttgctcttggtggtgttgccaccggtgctgtacagagcctcttgctcacccctgtcgagctcatcaagattcgtctccagcttcagcagactaagtctggtcccatcaccttggccaagagcatccttaggagacagggccttcaggggctttacagaggcctcaccatcaccgtgctccgagatgctcccgctcatggcctctacttctggacctatgagtacgtcagagaaaggcttcaccccggctgcagaaagaccggacaagaaaacctcaggaccatgctcgtggctggtggccttgctggagtggccagctgggtcgcttgttatcctcttgatgtcgtcaagaccagactccaacaaggtcatggggcttacgagggcattgccgattgttttcgcaagagcgtcaaacaggaaggctatacggttctctggcgtggcctcgggactgcagttgccagggcctttgtggtcaacggtgctatctttgctgcttatgaggtagccttgcggtgtctattcaatcaatcgccatccccagatattgtcacaggagattgagtgagtaaagggcaaagaaggttcattagttgcagtctggacctgtgaatgtagttaatattagcacatagtttgagatggatttggattgcatagcattggtcaaacaaatctgactcgctttagggatcaggcagtttactaatcacagttgatcatagagacgttccagaaatgattacaaaccccaaagaaaacagatgaaatgaaaattctgttact

SEQ ID NO: 1904 - protein, 1245 aa, Arabidopsis thaliana
  misc_feature: PFam Name: Mito_carr; PFam Description: Mitochondrial
  misc_feature: GI Number: 21593041; NR Description: putative
  misc_feature: GI Number: 34904170; NR Description: putative carnitine/acylcarnitine translocase [Oryza sativa (japonica cultivar-group)] >gi|13027346|dbj|BAB32707.1| putative carnitine/acylcarnitine translocase [Oryza sativa (japonica
  misc_feature: GI Number: 56784159; NR Description: putative carnitine/acylcarnitine carrier protein [Oryza sativa (japonica cultivar-group)] gi|56784116|dbj|BAD81501.1| putative carnitine/acylcarnitine carrier protein [Oryza sativa (japonica
  misc_feature: GI Number: 13879465; NR Description: Solute carrier family 25 (mitochondrial carrier, palmitoylcarnitine transporter), member 29
  misc_feature: GI Number: 34867789; NR Description: similar to chromosome 14
CTCATAAGTCATTATAATAGTTTCCCCCGGATTGTTTTTTCTTTCTTTTTGCTAATCATCATCGGTTTCTTCTAATCAAAAAAAAAAACAAAAAAAAAAGAGGGACTACGTTCGTACAATCCCATCCTTGGTATGGATTTCTGGCCGGAGTTTATGGCGACCAGCTGGGGAAGAGAGTTCGTCGCCGGTGGTTTCGGTGGCGTCGCCGGCATCATCTCCGGCTACCCCTTGGACACCCTCAGAATTCGCCAGCAACAGAGCTCGAAATCTGGATCTGCCTTCTCCATTCTCCGGCGGATGCTCGCCATTGAGGGTCCCTCCTCTCTCTACAGAGGCATGGCTGCGCCTTTGGCCTCCGTCACTTTTCAGAATGCTATGGTATTCCAGATATACGCCATATTCTCTCGCTCTTTTGATTCCTCTGTTCCTCTGGTAGAGCCTCCTTCCTACAGAGGCGTTGCTCTTGGTGGTGTTGCCACCGGTGCTGTACAGAGCCTCTTGCTCACCCCTGTCGAGCTCATCAAGATTCGTCTCCAGCTTCAGCAGACTAAGTCTGGTCCCATCACCTTGGCCAAGAGCATCCTTAGGAGACAGGGCCTTCAGGGGCTTTACAGAGGCCTCACCATCACCGTGCTCCGAGATGCTCCCGCTCATGGCCTCTACTTCTGGACCTATGAGTACGTCAGAGAAAGGCTTCACCCCGGCTGCAGAAAGACCGGACAAGAAAACCTCAGGACCATGCTCGTGGCTGGTGGCCTTGCTGGAGTGGCCAGCTGGGTCGCTTGTTATCCTCTTGATGTCGTCAAGACCAGACTCCAACAAGGTCATGGGGCTTACGAGGGCATTGCCGATTGTTTTCGCAAGAGCGTCAAACAGGAAGGCTATACGGTTCTCTGGCGTGGCCTCGGGACTGCAGTTGCCAGGGCCTTTGTGGTCAACGGTGCTATCTTTGCTGCTTATGAGGTAGCCTTGCGGTGTCTATTCAATCAATCGCCATCCCCAGATATTGTCACAGGAGATTGAGTGAGTAAAGGGCAAAGAAGGTTCATTAGTTGCAGTCTGGACCTGTGAATGTAGTTAATATTAGCACATAGTTTGAGATGGATTTGGATTGCATAGCATTGGTCAAACAAATCTGACTCGCTTTAGGGATCAGGCAGTTTACTAATCACAGTTGATCATAGAGACGTTCCAGAAATGATTACAAACCCCAAAGAAAACAGATGAAATGAAAATTCTGTTACT

SEQ ID NO: 1905 - DNA, 741 bp, Arabidopsis thaliana
  misc_feature (1)..(741): Ceres cDNA ID no. 12714698
  misc_feature (1)..(741): Also known as  Ceres CDNA ID no. 23369361
atggcgaattactcaagtattcacattctcttcttggtcttcatcacaagcggcattgctgtttccgccgccaccgtcttcactttacagaacagttgtccttacaccgtttggcctggaattctctccggcaacgacaacaccctcggcgacggcggatttcccttaacaccaggcgcttccgtacagctcacggctcctgcaggatggtcaggacggttctgggctcgtaccggctgcaacttcgacgcctccggccacggtaactgcggcaccggagactgcggcggtgttcttaaatgtaacggcggcggagttccaccagtcactctggctgaattcacacttgtaggcgacggcggcaaggatttctacgacgtgagtctcgtcgacggttacaatgtcgagatggggattaaacctcaaggaggttccggtgattgccattacgccggctgcgtcgccgacgtcaacgcggtttgccctaacgagcttcggctcatggatccacatacaggaatcatcgcggcgtgtaaaagcgcttgtgcggcgtttaattctgaggagttctgttgtaccggtgctcacgcgacgccgcaaacttgttctccgacgcattactcggcgatgtttaaaagcgcttgccctggtgcttacagttacgcctacgacgacgccacgagcaccttcacttgtaccggctctaactacttgatctctttctgccccacccggaactaa

SEQ ID NO: 1906 - protein, 741 aa, Arabidopsis thaliana
  misc_feature: PFam Name: Mito_carr; PFam Description: Mitochondrial
  misc_feature: GI Number: 21593041; NR Description: putative
  misc_feature: GI Number: 34904170; NR Description: putative carnitine/acylcarnitine translocase [Oryza sativa (japonica cultivar-group)] >gi|13027346|dbj|BAB32707.1| putative carnitine/acylcarnitine translocase [Oryza sativa (japonica
  misc_feature: GI Number: 56784159; NR Description: putative carnitine/acylcarnitine carrier protein [Oryza sativa (japonica cultivar-group)] gi|56784116|dbj|BAD81501.1| putative carnitine/acylcarnitine carrier protein [Oryza sativa (japonica
  misc_feature: GI Number: 13879465; NR Description: Solute carrier family 25 (mitochondrial carrier, palmitoylcarnitine transporter), member 29
  misc_feature: GI Number: 34867789; NR Description: similar to chromosome 14
ATGGCGAATTACTCAAGTATTCACATTCTCTTCTTGGTCTTCATCACAAGCGGCATTGCTGTTTCCGCCGCCACCGTCTTCACTTTACAGAACAGTTGTCCTTACACCGTTTGGCCTGGAATTCTCTCCGGCAACGACAACACCCTCGGCGACGGCGGATTTCCCTTAACACCAGGCGCTTCCGTACAGCTCACGGCTCCTGCAGGATGGTCAGGACGGTTCTGGGCTCGTACCGGCTGCAACTTCGACGCCTCCGGCCACGGTAACTGCGGCACCGGAGACTGCGGCGGTGTTCTTAAATGTAACGGCGGCGGAGTTCCACCAGTCACTCTGGCTGAATTCACACTTGTAGGCGACGGCGGCAAGGATTTCTACGACGTGAGTCTCGTCGACGGTTACAATGTCGAGATGGGGATTAAACCTCAAGGAGGTTCCGGTGATTGCCATTACGCCGGCTGCGTCGCCGACGTCAACGCGGTTTGCCCTAACGAGCTTCGGCTCATGGATCCACATACAGGAATCATCGCGGCGTGTAAAAGCGCTTGTGCGGCGTTTAATTCTGAGGAGTTCTGTTGTACCGGTGCTCACGCGACGCCGCAAACTTGTTCTCCGACGCATTACTCGGCGATGTTTAAAAGCGCTTGCCCTGGTGCTTACAGTTACGCCTACGACGACGCCACGAGCACCTTCACTTGTACCGGCTCTAACTACTTGATCTCTTTCTGCCCCACCCGGAACTAA

SEQ ID NO: 1907 - DNA, 1616 bp, Arabidopsis thaliana
  misc_feature (1)..(1616): Ceres cDNA ID no. 12714839
agtctacctgtaacgacgtcgtatcaccgatcatccgccggattcttatttggcggtgtaatcgttggagctcttctactaattctgttaggtcttctctttgtcttctacagagctaccagaaatagaaataacaacagcagctctgctcatcatcaatccaaaactccctcaaaagttcaacatcatcggggcggtaatgctggtacgaaccaggcacatgttatcacaatgccaccaccaatccatgctaaatatatatctagtggaggttgtgatacgaaggagaacaattctgttgcgaaaaacatttcaatgccatctggaatgttctcctacgaagaactttcaaaagcaactggtggattttcagaggagaaccttttgggagaaggcggtttcggatatgttcacaaaggagtgttgaaaaacgggacagaagttgcggtgaagcagctgaagattgggagctatcaaggggaaagagaattccaagctgaggttgacacaatcagtagggttcatcataagcacctcgtttcattggttggttattgcgttaatggagataaaagactcttggtttacgagtttgttcctaaagataccttggagttccacttgcatgagaacagaggaagcgtgttggaatgggaaatgaggctcaggattgctgtaggagcagcaaaaggattagcttatcttcatgaggattgcagtccaactataattcaccgtgatatcaaagcagctaatatccttctagattccaaatttgaggcaaaggtctctgactttggactagccaagtttttctcagacaccaattcatcattcactcatatctctactcgagtggtaggaactttcggatacatggctccagaatacgcgtccagtggtaaagtaactgataaatcagatgtatattcctttggggtcgtgcttctagaactcatcactggacgtccatcaattttcgccaaagattcttccacaaaccagagtttagtagactgggcgaggccattgcttacgaaagcaatctctggagaaagttttgactttcttgtagactcaaggttggagaagaattacgatacaactcagatggcaaacatggctgcttgtgctgctgcttgcatacgccaatcagcttggcttcggcctagaatgagccaggtagtacgtgctcttgaaggcgaggtggccctgagaaaggtcgaagagactgggaatagcgtgacctatagctcttctgaaaacccgaatgacatcacaccacggtatggaacaaataagaggagattcgacacaggttcaagcgatggttacacttcagaatatggagttaacccttctcagtcgagcagtgaacatcaacaggtgaatacttagttcacaggttcaatagggcaagtttcaccacaattattgggttttcggatacagtcatcttgggttaacataaaatgttgtaagaaattagactacttcattcatttgtagttaaggggtccgaagaacactgcttgtgttttgttaaatgtataaattggttgtaatattggggcacaagtttaattatgttgcaaatactttgtttgcttctgatc

SEQ ID NO: 1908 - protein, 465 aa, Arabidopsis thaliana
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 13447449; NR Description: receptor protein kinase
  misc_feature: GI Number: 29367569; NR Description: putative receptor
  misc_feature: GI Number: 34904234; NR Description: putative receptor protein kinase PERK1 [Oryza sativa (japonica cultivar-group)] >gi|17385728|dbj|BAB78668.1| putative receptor protein kinase PERK1
  misc_feature: GI Number: 11994703; NR Description: somatic embryogenesis
  misc_feature: GI Number: 12323130; NR Description: protein kinase, putative; 60711-62822 [Arabidopsis thaliana] gi|44917591|gb|AAS49120.1| At1g52290 [Arabidopsis thaliana] gi|25405539|pir||A96563 probable protein kinase 60711-62822
SLPVTTSYHRSSAGFLFGGVIVGALLLILLGLLFVFYRATRNRNNNSSSAHHQSKTPSKVQHHRGGNAGTNQAHVITMPPPIHAKYISSGGCDTKENNSVAKNISMPSGMFSYEELSKATGGFSEENLLGEGGFGYVHKGVLKNGTEVAVKQLKIGSYQGEREFQAEVDTISRVHHKHLVSLVGYCVNGDKRLLVYEFVPKDTLEFHLHENRGSVLEWEMRLRIAVGAAKGLAYLHEDCSPTIIHRDIKAANILLDSKFEAKVSDFGLAKFFSDTNSSFTHISTRVVGTFGYMAPEYASSGKVTDKSDVYSFGVVLLELITGRPSIFAKDSSTNQSLVDWARPLLTKAISGESFDFLVDSRLEKNYDTTQMANMAACAAACIRQSAWLRPRMSQVVRALEGEVALRKVEETGNSVTYSSSENPNDITPRYGTNKRRFDTGSSDGYTSEYGVNPSQSSSEHQQVNT

SEQ ID NO: 1909 - DNA, 1089 bp, Arabidopsis thaliana
  misc_feature (1)..(1089): Ceres cDNA ID no. 12716049
  misc_feature (1)..(1089): Also known as  Ceres CDNA ID no. 23369361
atggaagaaagtaaaaggaatttattagatgaagaagcgaaagcttctttagacatatggagatatgtttttgggtttgcagatattgcagctgcaaagtgtgccattgatctcaaaataccagaagccattgaaaaccatccttcgtcacagcccgtgacactatccgaactctcctctgccgtctctgcttctccttcacatctccgccgtataatgcggtttcttgtgcaccaaggactcttcaaagaagtccccacaaaagatggtttagccactggctacactaacacgccactctctcgccgtatgatgatcacaaaacctcctttgcttctcttggaaacaagtcccgagatgcttgctccatggttgaagctgagctcagtcgtttcttcgccggtcaatgtttcaactccaccgccgtttgatgcagtgcatggtaaggacttgtgggcgttcgcacaggataatctgtgccacagccagctgatcaacgaggccatggcttgtgatgcaaggcgcgtggtgccacgtgtagctggagcttgtcaaggcttgtttgacggcgtggctacggtggttgacgtaggaggaggtaccggagagacgatgggaatacttgtaaaggagtttccttggatcaaaggatttaactttgaccttcctcatgttattgaagttgctcaagtcttggacggtgttgagaatgttgagggcgatatgtttgattctattccggcaagcgacgctgttatcatcaagtgggtgttacacgattggggagacaaagattgcataaagatattgaagaattgcaaagaagctgttctaccaaatatcggcaaagtgttgatagtggagtgtgttatcggagagaagaaaaacacgatgatagcggaagaaagagatgacaagttagagcacgtgagattgcagcttgacatggtgatgatggttcacacaagcacaggcaaagaacgaactttgaaagaatgggactttgttcttacagaagctggctttgctcgatatgaggttagagactttgatgatgttcagtctcttatcatcgcatatcgatcttaa

SEQ ID NO: 1910 - protein, 1089 aa, Arabidopsis thaliana
  misc_feature: PFam Name: Mito_carr; PFam Description: Mitochondrial
  misc_feature: GI Number: 21593041; NR Description: putative
  misc_feature: GI Number: 34904170; NR Description: putative carnitine/acylcarnitine translocase [Oryza sativa (japonica cultivar-group)] >gi|13027346|dbj|BAB32707.1| putative carnitine/acylcarnitine translocase [Oryza sativa (japonica
  misc_feature: GI Number: 56784159; NR Description: putative carnitine/acylcarnitine carrier protein [Oryza sativa (japonica cultivar-group)] gi|56784116|dbj|BAD81501.1| putative carnitine/acylcarnitine carrier protein [Oryza sativa (japonica
  misc_feature: GI Number: 13879465; NR Description: Solute carrier family 25 (mitochondrial carrier, palmitoylcarnitine transporter), member 29
  misc_feature: GI Number: 34867789; NR Description: similar to chromosome 14
ATGGAAGAAAGTAAAAGGAATTTATTAGATGAAGAAGCGAAAGCTTCTTTAGACATATGGAGATATGTTTTTGGGTTTGCAGATATTGCAGCTGCAAAGTGTGCCATTGATCTCAAAATACCAGAAGCCATTGAAAACCATCCTTCGTCACAGCCCGTGACACTATCCGAACTCTCCTCTGCCGTCTCTGCTTCTCCTTCACATCTCCGCCGTATAATGCGGTTTCTTGTGCACCAAGGACTCTTCAAAGAAGTCCCCACAAAAGATGGTTTAGCCACTGGCTACACTAACACGCCACTCTCTCGCCGTATGATGATCACAAAACCTCCTTTGCTTCTCTTGGAAACAAGTCCCGAGATGCTTGCTCCATGGTTGAAGCTGAGCTCAGTCGTTTCTTCGCCGGTCAATGTTTCAACTCCACCGCCGTTTGATGCAGTGCATGGTAAGGACTTGTGGGCGTTCGCACAGGATAATCTGTGCCACAGCCAGCTGATCAACGAGGCCATGGCTTGTGATGCAAGGCGCGTGGTGCCACGTGTAGCTGGAGCTTGTCAAGGCTTGTTTGACGGCGTGGCTACGGTGGTTGACGTAGGAGGAGGTACCGGAGAGACGATGGGAATACTTGTAAAGGAGTTTCCTTGGATCAAAGGATTTAACTTTGACCTTCCTCATGTTATTGAAGTTGCTCAAGTCTTGGACGGTGTTGAGAATGTTGAGGGCGATATGTTTGATTCTATTCCGGCAAGCGACGCTGTTATCATCAAGTGGGTGTTACACGATTGGGGAGACAAAGATTGCATAAAGATATTGAAGAATTGCAAAGAAGCTGTTCTACCAAATATCGGCAAAGTGTTGATAGTGGAGTGTGTTATCGGAGAGAAGAAAAACACGATGATAGCGGAAGAAAGAGATGACAAGTTAGAGCACGTGAGATTGCAGCTTGACATGGTGATGATGGTTCACACAAGCACAGGCAAAGAACGAACTTTGAAAGAATGGGACTTTGTTCTTACAGAAGCTGGCTTTGCTCGATATGAGGTTAGAGACTTTGATGATGTTCAGTCTCTTATCATCGCATATCGATCTTAA

SEQ ID NO: 1911 - DNA, 1434 bp, Arabidopsis thaliana
  misc_feature (1)..(1434): Ceres cDNA ID no. 12716650
  misc_feature (1)..(1434): Also known as  Ceres CDNA ID no. 23369361
atgatgatgggaaatacatttggttcaagtttggcgagtttattcttcttgtgggcaactattcaacaaatcttcccaaaccatctcagaatcgccattaaagagtttcttatctccacaatacaacaactctcatttgtccagagattttccgacagattcatcaacttcttttcgccttatgtcgaaatcagcttctctcaatacgaagattatcaattcaatcacgcatttgcagccattgagacttaccttggggcaaaagcaactgataaagccaagcatctaagagcaagccaagttaaagagagtaaaggtttggtcttgaaacgagacgagactaaagtccgagatgagtatgaaggaggtactgtctggtgggagatggaaaccgactccacaggatatagaacattcaaactcactttccatagacgctcgcgagatattgtaaccgactcttacataaaatatgtttttgaagaaggcaaatcgattcaagccaagagcaagcagatgaagttgttcacaaataatccgagttctcactggggcactagcaagaagagtttttggagatatattgattttgagcatcccgcaagttttcacacgctagctatggatacaaagaagaaagaggagatcttgaatgatcttgctgcgtttagcaatggtaaagagtattacaagaaaataggtaaagcttggaagaggggttacttgctacatggaccaccagggaccggtaaatcaacaatgatcgctgcaatggcgaatcatttaaactatagtatctatgatcttgaactcacggctatacgtaacaactcggagttgaggaagctactcactgctacttctagcaagtcgatcatcgtgattgaagatatagattgttctttggatcttacgggaaagagaaagaaagagaaaaacttgatgacctcgagagaagatggagaacaaggtaccgaagaagacaagagttttgtaacactctcggggcttttgaacttcattgatggcatttggtctgcttgtggacaagagaggattattatcttcactacgaatcactttgagaaacttgacccggctttgatcaggagagggagaatggacatgcatattgagttgtcatactgttctttcgaggcgtttaagattctcgccaagaactatcttgatcttgatactcatcctctattcaagaagatcgaatcattattgaaggaaacgaagatcgcaccagctgatgttgctgagaacttgatgaagaagaatactgaaatagatgctgatggatctcttaaagatctaattcaagctctggaggggaagaagaagattcatggagctcaagtagatgaaccgaaggacaaatataccaagaagttttataaagcattttgcatgtcatctaaagcctga

SEQ ID NO: 1912 - protein, 1434 aa, Arabidopsis thaliana
  misc_feature: PFam Name: Mito_carr; PFam Description: Mitochondrial
  misc_feature: GI Number: 21593041; NR Description: putative
  misc_feature: GI Number: 34904170; NR Description: putative carnitine/acylcarnitine translocase [Oryza sativa (japonica cultivar-group)] >gi|13027346|dbj|BAB32707.1| putative carnitine/acylcarnitine translocase [Oryza sativa (japonica
  misc_feature: GI Number: 56784159; NR Description: putative carnitine/acylcarnitine carrier protein [Oryza sativa (japonica cultivar-group)] gi|56784116|dbj|BAD81501.1| putative carnitine/acylcarnitine carrier protein [Oryza sativa (japonica
  misc_feature: GI Number: 13879465; NR Description: Solute carrier family 25 (mitochondrial carrier, palmitoylcarnitine transporter), member 29
  misc_feature: GI Number: 34867789; NR Description: similar to chromosome 14
ATGATGATGGGAAATACATTTGGTTCAAGTTTGGCGAGTTTATTCTTCTTGTGGGCAACTATTCAACAAATCTTCCCAAACCATCTCAGAATCGCCATTAAAGAGTTTCTTATCTCCACAATACAACAACTCTCATTTGTCCAGAGATTTTCCGACAGATTCATCAACTTCTTTTCGCCTTATGTCGAAATCAGCTTCTCTCAATACGAAGATTATCAATTCAATCACGCATTTGCAGCCATTGAGACTTACCTTGGGGCAAAAGCAACTGATAAAGCCAAGCATCTAAGAGCAAGCCAAGTTAAAGAGAGTAAAGGTTTGGTCTTGAAACGAGACGAGACTAAAGTCCGAGATGAGTATGAAGGAGGTACTGTCTGGTGGGAGATGGAAACCGACTCCACAGGATATAGAACATTCAAACTCACTTTCCATAGACGCTCGCGAGATATTGTAACCGACTCTTACATAAAATATGTTTTTGAAGAAGGCAAATCGATTCAAGCCAAGAGCAAGCAGATGAAGTTGTTCACAAATAATCCGAGTTCTCACTGGGGCACTAGCAAGAAGAGTTTTTGGAGATATATTGATTTTGAGCATCCCGCAAGTTTTCACACGCTAGCTATGGATACAAAGAAGAAAGAGGAGATCTTGAATGATCTTGCTGCGTTTAGCAATGGTAAAGAGTATTACAAGAAAATAGGTAAAGCTTGGAAGAGGGGTTACTTGCTACATGGACCACCAGGGACCGGTAAATCAACAATGATCGCTGCAATGGCGAATCATTTAAACTATAGTATCTATGATCTTGAACTCACGGCTATACGTAACAACTCGGAGTTGAGGAAGCTACTCACTGCTACTTCTAGCAAGTCGATCATCGTGATTGAAGATATAGATTGTTCTTTGGATCTTACGGGAAAGAGAAAGAAAGAGAAAAACTTGATGACCTCGAGAGAAGATGGAGAACAAGGTACCGAAGAAGACAAGAGTTTTGTAACACTCTCGGGGCTTTTGAACTTCATTGATGGCATTTGGTCTGCTTGTGGACAAGAGAGGATTATTATCTTCACTACGAATCACTTTGAGAAACTTGACCCGGCTTTGATCAGGAGAGGGAGAATGGACATGCATATTGAGTTGTCATACTGTTCTTTCGAGGCGTTTAAGATTCTCGCCAAGAACTATCTTGATCTTGATACTCATCCTCTATTCAAGAAGATCGAATCATTATTGAAGGAAACGAAGATCGCACCAGCTGATGTTGCTGAGAACTTGATGAAGAAGAATACTGAAATAGATGCTGATGGATCTCTTAAAGATCTAATTCAAGCTCTGGAGGGGAAGAAGAAGATTCATGGAGCTCAAGTAGATGAACCGAAGGACAAATATACCAAGAAGTTTTATAAAGCATTTTGCATGTCATCTAAAGCCTGA

SEQ ID NO: 1913 - DNA, 1172 bp, Arabidopsis thaliana
  misc_feature (1)..(1172): Ceres cDNA ID no. 12717216
  misc_feature (1)..(1172): Ceres CLONE  ID no. 38925
  misc_feature (1)..(1172): Also known as  Ceres CDNA ID no. 23539064
aaacaatgccacttctcctccgtcgatttccctctccctccgtcgtctcctccttcttcctccgtcgctcaatggcttcctcaacaatctcctcggatataatcactccatcaaacaccaaaatcggatggatcggaaccggagtcatgggccgatcaatgtgtggacacttaatcaaagccggttacacagtcaccgtcttcaatcgaaccatctccaaagctcaaactctcatcgacatgggtgctaacgtcgccgactcaccaaactcagtcgctgaacaatccgacgtcgttttcaccatcgttggttatccttccgatgtccgtcacgtccttctcgatccaaagtccggagctttatctggtctccgtcaaggaggtgttctcgttgatatgactacttctgagccttctttagcagaggagatagctaaagctgcttcctttaagaattgtttctcaatagacgctcctgtctcaggtggagatttaggagctaagaatgggaagctatctatattcgccggaggtgatgaaaccaccgtgaaacgtttagatccgttgttttcgttaatgggtaaagtcaacttcatgggaacaagtgggaaaggtcaatttgcgaaattggctaatcagataactattgcttcgactatgttaggacttgtggaaggtttgatttatgctcataaagctggacttgatgttaagaagtttcttgaagcgatttctactggtgctgctggttctaagtctatagatttgtatggagataggattctgaagagggattttgatcctggtttttatgtgaatcattttgtgaaagatttagggatttgtttgaatgaatgtcagaggatgggtttggctttgcctggtttagctcttgctcaacagctttacttgtctcttaaggctcatggtgaaggtgatcttggtactcaagctcttctcttggctcttgaacgtctcaacaatgtctctgttcaatcatctgactcttgatttaggttctgttccactttctgataatgcatctgttggagattttatgttgttatgaagtaaagatttgatcttttgtgtacccatttgttggtaaaacatgatttgaagtaaacttttgtgtacgcatatgagattcatacacagtagttttatgtgtac

SEQ ID NO: 1914 - protein, 1172 aa, Arabidopsis thaliana
  misc_feature: PFam Name: NAD_binding_2; PFam Description: NAD binding
  misc_feature: GI Number: 34909392; NR Description: putative dehydrogenase [Oryza sativa (japonica cultivar-group)] >gi|20521418|dbj|BAB91928.1| putative dehydrogenase [Oryza sativa
  misc_feature: GI Number: 32472744; NR Description: 3-hydroxyisobutyrate dehydrogenase [Pirellula sp. 1] >gi|32443981|emb|CAD73423.1|
  misc_feature: GI Number: 21281068; NR Description: putative dehydrogenase [Arabidopsis thaliana] >gi|15293143|gb|AAK93682.1| putative dehydrogenase [Arabidopsis thaliana] >gi|18409781|ref|NP_565014.1| 6-phosphogluconate dehydrogenase
AAACAATGCCACTTCTCCTCCGTCGATTTCCCTCTCCCTCCGTCGTCTCCTCCTTCTTCCTCCGTCGCTCAATGGCTTCCTCAACAATCTCCTCGGATATAATCACTCCATCAAACACCAAAATCGGATGGATCGGAACCGGAGTCATGGGCCGATCAATGTGTGGACACTTAATCAAAGCCGGTTACACAGTCACCGTCTTCAATCGAACCATCTCCAAAGCTCAAACTCTCATCGACATGGGTGCTAACGTCGCCGACTCACCAAACTCAGTCGCTGAACAATCCGACGTCGTTTTCACCATCGTTGGTTATCCTTCCGATGTCCGTCACGTCCTTCTCGATCCAAAGTCCGGAGCTTTATCTGGTCTCCGTCAAGGAGGTGTTCTCGTTGATATGACTACTTCTGAGCCTTCTTTAGCAGAGGAGATAGCTAAAGCTGCTTCCTTTAAGAATTGTTTCTCAATAGACGCTCCTGTCTCAGGTGGAGATTTAGGAGCTAAGAATGGGAAGCTATCTATATTCGCCGGAGGTGATGAAACCACCGTGAAACGTTTAGATCCGTTGTTTTCGTTAATGGGTAAAGTCAACTTCATGGGAACAAGTGGGAAAGGTCAATTTGCGAAATTGGCTAATCAGATAACTATTGCTTCGACTATGTTAGGACTTGTGGAAGGTTTGATTTATGCTCATAAAGCTGGACTTGATGTTAAGAAGTTTCTTGAAGCGATTTCTACTGGTGCTGCTGGTTCTAAGTCTATAGATTTGTATGGAGATAGGATTCTGAAGAGGGATTTTGATCCTGGTTTTTATGTGAATCATTTTGTGAAAGATTTAGGGATTTGTTTGAATGAATGTCAGAGGATGGGTTTGGCTTTGCCTGGTTTAGCTCTTGCTCAACAGCTTTACTTGTCTCTTAAGGCTCATGGTGAAGGTGATCTTGGTACTCAAGCTCTTCTCTTGGCTCTTGAACGTCTCAACAATGTCTCTGTTCAATCATCTGACTCTTGATTTAGGTTCTGTTCCACTTTCTGATAATGCATCTGTTGGAGATTTTATGTTGTTATGAAGTAAAGATTTGATCTTTTGTGTACCCATTTGTTGGTAAAACATGATTTGAAGTAAACTTTTGTGTACGCATATGAGATTCATACACAGTAGTTTTATGTGTAC

SEQ ID NO: 1915 - DNA, 3159 bp, Arabidopsis thaliana
  misc_feature (1)..(3159): Ceres cDNA ID no. 12718179
  misc_feature (1)..(3159): Also known as  Ceres CDNA ID no. 23539064
atgtctggtttgttcggtatattatctccggccaaacgggtcaatggcgatggcctccctctgttttacaatatccacaagtcagtggagcttcagagatgtcacagagacactgcgcgggtgtctgtcacacttgcagaacttctcatgagtgtggaagatgagggggatgaccagagtcgggctatggatattgcggttgcgtccaatttctggtcctcggttccgtcttctcgtgtgccttcttcttctccgtttgttctttccttcaaagacttgacttacagcgtgaagatcaagaagaagtttaagccctttccttgttgtgggaattcaccttttgatggtaatgatatggagatgaatactaaggtgctcctgaatggtatttctggtgaagcccgggaaggagagatgatggctgttcttggagcgagcgggtcagggaaatcaacgcttatcgatgcattagccaatcggatttcaaaagagagcctacgcggtgatattactttaaatggggaagttcttgaatctagcctgcataaagtcatatcagcttatgtgatgcaagatgatcttctcttcccgatgctcaccgtggaagagacgttgatgttttctgctgagttcaggcttccaagctcgctttctaagaagaaaaagaaggcacgggttcaagctctgattgatcagctcggcctgaggaacgcagcaaaaaccgtgatcggtgatgagggacacagaggtgtgtctggaggagaaaggagaagggtctcaattggaaccgatataatccatgacccgattattctctttctcgatgagccaacttctggtcttgactctaccagtgcatacatggttgtcaaagtgcttcagagaatcgcacaaagcggcagcatagttatcatgtccatccatcagccgagttacagaatcttgggattactcgataagttaatcttcctatctaggggaaacaccgtttacagcggctccccgacacacctccctcagttcttctcagaattcggtcacccaattcctgaaaacgagaacaagccggagtttgcactcgatcttatccgtgagctggaagattcgccagaaggaacgaaatccttagtcgagttccacaagcaatggcgagcaaagcaaacctcaagccagagcagaagaaacaccaatgtatctctcaaagatgcaatcagcgcaagtatctcgagaggtaagcttgtctccggagcaacaaacctaagatcatcatttcaaacctttgcaaacccattctggactgaaatgctcgtaattggtaaacgatctatactaaactcaagaagacaaccagagctattcggaatccgcctaggagctgtactagtcaccggaatgatcctagccacaatattctggaaactagacaattcaccaagaggtatacaagaacgcttagggttcttcgcattcgcaatgtccacaacattctacacatgtgcagaagcaataccagtctttctacaggaacgttacatattcatgagagaaacagcttacaacgcttaccggcgatcatcatacgtcctcgctcacacaataatctccatccctgctctcataatcttatccgccgcattcgccgcctcaacattctcggccgtaggactcgccggaggctccgagggattcctcttcttcttcttcacaatcctcaccgcgttttgggccggaagttccttcgtgacgttcttatccggcgtagtctcacacgtgatgatcggattcacggtggttgtagcaatcctcgcttatttcctcctcttctccggattcttcatctctagagatcgaatcccactctactggatctggttccattacctctccctagtgaaatacccttacgaaggtgttctacagaacgaattcgaagatccgacgaaatgcttcgtcagagggatccagatgttcgacaattcgccgctgggacaagttccaaccgccgtgaaaatcagcctcctgaagagcatgagcggcgttttggggatcaacgtgacggcggagacttgcgtaacgacgggaatcgatatactgaaacagcaaggaatcacggagataagcaaatggaattgcttgtggatcactgtagcttggggattcttctttagggttctcttctacttcacactcttgatcggaagcaagaacaagcgtcggtatcatccgcggttcacttccttcgtttcgaaattattagggttactgcgtatttgcactctccttcttcgtctctccagcttgacaatgcctcgctatgatgatcgctatggaaacactcgcctctatgttggtcgcttatcatctagaactcgtaccagagaccttgagcgtctctttagcagatacggaagagtacgagatgtggatatgaagcgtgattatgcctttgttgaatttagtgatcctcgtgatgctgatgacgcaagatattacttggatggacgggatttcgatggaagtcgcatcactgtggaggcatcaagaggggctcctcgtggttcgcgggacaatggtagcagaggcccacctcctggttctggtcgctgttttaattgtggtgtcgatggccactgggcccgagactgcacagcaggagactggaagaataaatgttaccgctgtggtgaaagaggacacattgagagaaactgcaaaaacagtcctagtccaaagaaggccaggcagggtggaagctattccaggtcaccagtcaaatcccgctcccctcgtcgccgaaggagcccaagccgtagccgtagttacagtcgaggtcgcagctacagtcgatcgcgatccccagtgagaagagagaaaagcgtggaggacagatcacgcagtcctaaggcaatggagcgatctgtatctcccaaaggtagggaccaaagcctgagtccagaccgaaaagtgatagatgcaagcccaaagcgtggatcagactatgatggtagcccaaaagagaatggtaatggcaggaactctgcgagtcccattgttggaggtggtgaaagtcctgttggacttaatggtcaagacaggagcccgattgatgatgaggctgagcttagccgtccttcccctaaaggcagtgagtcaccttga

SEQ ID NO: 1916 - protein, 3159 aa, Arabidopsis thaliana
  misc_feature: PFam Name: NAD_binding_2; PFam Description: NAD binding
  misc_feature: GI Number: 34909392; NR Description: putative dehydrogenase [Oryza sativa (japonica cultivar-group)] >gi|20521418|dbj|BAB91928.1| putative dehydrogenase [Oryza sativa
  misc_feature: GI Number: 32472744; NR Description: 3-hydroxyisobutyrate dehydrogenase [Pirellula sp. 1] >gi|32443981|emb|CAD73423.1|
  misc_feature: GI Number: 21281068; NR Description: putative dehydrogenase [Arabidopsis thaliana] >gi|15293143|gb|AAK93682.1| putative dehydrogenase [Arabidopsis thaliana] >gi|18409781|ref|NP_565014.1| 6-phosphogluconate dehydrogenase
ATGTCTGGTTTGTTCGGTATATTATCTCCGGCCAAACGGGTCAATGGCGATGGCCTCCCTCTGTTTTACAATATCCACAAGTCAGTGGAGCTTCAGAGATGTCACAGAGACACTGCGCGGGTGTCTGTCACACTTGCAGAACTTCTCATGAGTGTGGAAGATGAGGGGGATGACCAGAGTCGGGCTATGGATATTGCGGTTGCGTCCAATTTCTGGTCCTCGGTTCCGTCTTCTCGTGTGCCTTCTTCTTCTCCGTTTGTTCTTTCCTTCAAAGACTTGACTTACAGCGTGAAGATCAAGAAGAAGTTTAAGCCCTTTCCTTGTTGTGGGAATTCACCTTTTGATGGTAATGATATGGAGATGAATACTAAGGTGCTCCTGAATGGTATTTCTGGTGAAGCCCGGGAAGGAGAGATGATGGCTGTTCTTGGAGCGAGCGGGTCAGGGAAATCAACGCTTATCGATGCATTAGCCAATCGGATTTCAAAAGAGAGCCTACGCGGTGATATTACTTTAAATGGGGAAGTTCTTGAATCTAGCCTGCATAAAGTCATATCAGCTTATGTGATGCAAGATGATCTTCTCTTCCCGATGCTCACCGTGGAAGAGACGTTGATGTTTTCTGCTGAGTTCAGGCTTCCAAGCTCGCTTTCTAAGAAGAAAAAGAAGGCACGGGTTCAAGCTCTGATTGATCAGCTCGGCCTGAGGAACGCAGCAAAAACCGTGATCGGTGATGAGGGACACAGAGGTGTGTCTGGAGGAGAAAGGAGAAGGGTCTCAATTGGAACCGATATAATCCATGACCCGATTATTCTCTTTCTCGATGAGCCAACTTCTGGTCTTGACTCTACCAGTGCATACATGGTTGTCAAAGTGCTTCAGAGAATCGCACAAAGCGGCAGCATAGTTATCATGTCCATCCATCAGCCGAGTTACAGAATCTTGGGATTACTCGATAAGTTAATCTTCCTATCTAGGGGAAACACCGTTTACAGCGGCTCCCCGACACACCTCCCTCAGTTCTTCTCAGAATTCGGTCACCCAATTCCTGAAAACGAGAACAAGCCGGAGTTTGCACTCGATCTTATCCGTGAGCTGGAAGATTCGCCAGAAGGAACGAAATCCTTAGTCGAGTTCCACAAGCAATGGCGAGCAAAGCAAACCTCAAGCCAGAGCAGAAGAAACACCAATGTATCTCTCAAAGATGCAATCAGCGCAAGTATCTCGAGAGGTAAGCTTGTCTCCGGAGCAACAAACCTAAGATCATCATTTCAAACCTTTGCAAACCCATTCTGGACTGAAATGCTCGTAATTGGTAAACGATCTATACTAAACTCAAGAAGACAACCAGAGCTATTCGGAATCCGCCTAGGAGCTGTACTAGTCACCGGAATGATCCTAGCCACAATATTCTGGAAACTAGACAATTCACCAAGAGGTATACAAGAACGCTTAGGGTTCTTCGCATTCGCAATGTCCACAACATTCTACACATGTGCAGAAGCAATACCAGTCTTTCTACAGGAACGTTACATATTCATGAGAGAAACAGCTTACAACGCTTACCGGCGATCATCATACGTCCTCGCTCACACAATAATCTCCATCCCTGCTCTCATAATCTTATCCGCCGCATTCGCCGCCTCAACATTCTCGGCCGTAGGACTCGCCGGAGGCTCCGAGGGATTCCTCTTCTTCTTCTTCACAATCCTCACCGCGTTTTGGGCCGGAAGTTCCTTCGTGACGTTCTTATCCGGCGTAGTCTCACACGTGATGATCGGATTCACGGTGGTTGTAGCAATCCTCGCTTATTTCCTCCTCTTCTCCGGATTCTTCATCTCTAGAGATCGAATCCCACTCTACTGGATCTGGTTCCATTACCTCTCCCTAGTGAAATACCCTTACGAAGGTGTTCTACAGAACGAATTCGAAGATCCGACGAAATGCTTCGTCAGAGGGATCCAGATGTTCGACAATTCGCCGCTGGGACAAGTTCCAACCGCCGTGAAAATCAGCCTCCTGAAGAGCATGAGCGGCGTTTTGGGGATCAACGTGACGGCGGAGACTTGCGTAACGACGGGAATCGATATACTGAAACAGCAAGGAATCACGGAGATAAGCAAATGGAATTGCTTGTGGATCACTGTAGCTTGGGGATTCTTCTTTAGGGTTCTCTTCTACTTCACACTCTTGATCGGAAGCAAGAACAAGCGTCGGTATCATCCGCGGTTCACTTCCTTCGTTTCGAAATTATTAGGGTTACTGCGTATTTGCACTCTCCTTCTTCGTCTCTCCAGCTTGACAATGCCTCGCTATGATGATCGCTATGGAAACACTCGCCTCTATGTTGGTCGCTTATCATCTAGAACTCGTACCAGAGACCTTGAGCGTCTCTTTAGCAGATACGGAAGAGTACGAGATGTGGATATGAAGCGTGATTATGCCTTTGTTGAATTTAGTGATCCTCGTGATGCTGATGACGCAAGATATTACTTGGATGGACGGGATTTCGATGGAAGTCGCATCACTGTGGAGGCATCAAGAGGGGCTCCTCGTGGTTCGCGGGACAATGGTAGCAGAGGCCCACCTCCTGGTTCTGGTCGCTGTTTTAATTGTGGTGTCGATGGCCACTGGGCCCGAGACTGCACAGCAGGAGACTGGAAGAATAAATGTTACCGCTGTGGTGAAAGAGGACACATTGAGAGAAACTGCAAAAACAGTCCTAGTCCAAAGAAGGCCAGGCAGGGTGGAAGCTATTCCAGGTCACCAGTCAAATCCCGCTCCCCTCGTCGCCGAAGGAGCCCAAGCCGTAGCCGTAGTTACAGTCGAGGTCGCAGCTACAGTCGATCGCGATCCCCAGTGAGAAGAGAGAAAAGCGTGGAGGACAGATCACGCAGTCCTAAGGCAATGGAGCGATCTGTATCTCCCAAAGGTAGGGACCAAAGCCTGAGTCCAGACCGAAAAGTGATAGATGCAAGCCCAAAGCGTGGATCAGACTATGATGGTAGCCCAAAAGAGAATGGTAATGGCAGGAACTCTGCGAGTCCCATTGTTGGAGGTGGTGAAAGTCCTGTTGGACTTAATGGTCAAGACAGGAGCCCGATTGATGATGAGGCTGAGCTTAGCCGTCCTTCCCCTAAAGGCAGTGAGTCACCTTGA

SEQ ID NO: 1917 - DNA, 1143 bp, Arabidopsis thaliana
  misc_feature (1)..(1143): Ceres cDNA ID no. 12718425
  misc_feature (1)..(1143): Also known as  Ceres CDNA ID no. 23539064
atggattcaaataatcatctctacgacccgaatcccaccgggtcgggtcttcttcgttttagatcagctccgagctctgttctcgccgcttttgttgacgacgacaagattggtttcgactccgataggttgctttcaagattcgtgacctctaatggcgttaacggagatctgggttcacctaaattcgaggataagtctccggtttcgttaacgaacacctctgtttcatacgccgccactctgccgccaccgccgcagcttgagccgtcgagttttctgggtttgccgccgcattacccgaggcagagtaaagggataatgaactcggttggtttggatcagtttctcggtatcaataatcatcacaccaaaccagttgaatctaatcttctccgtcaaagcagctctccagccggaatgtttactaatctctctgaccaaaacgagttaaagcactttggactcaacaaatctaataagtgtttactatatacttacaaatttgcaggttatggttcaatgaggaatttgatgaattacgaagaagatgaagagagtccatctaattccaatggattaagacgccattgcagtctctcttcaaggccaccttcttcacttggaatgctttctcaaatacctgaaatcgcacccgaaactaattttccatatagccattggaatgatccatccagctttattgataacttatcctcacttaaaagagaagccgaggacgatggaaaattgtttctcggagctcagaacggagagtccgggaatcgtatgcagttactgtcgcatcatttgagcctaccaaagtcatcatcgacagcctcggacatggtttcagtggataagtatcttcagctacaagattctgttccttgtaaaatcagagccaaacgtggttgcgctacacatcctcgaagcatcgctgaacgggtaagaagaacgcggataagcgagcgaatgaggaagttacaagagcttgttcctaacatggacaagcaaaccaacacttcggatatgttggatttagctgtggattacatcaaagatttacaaagacagtataagattttaaacgacaacagagctaactgtaagtgtatgaacaaggagaagaagtcaatatag

SEQ ID NO: 1918 - protein, 1143 aa, Arabidopsis thaliana
  misc_feature: PFam Name: NAD_binding_2; PFam Description: NAD binding
  misc_feature: GI Number: 34909392; NR Description: putative dehydrogenase [Oryza sativa (japonica cultivar-group)] >gi|20521418|dbj|BAB91928.1| putative dehydrogenase [Oryza sativa
  misc_feature: GI Number: 32472744; NR Description: 3-hydroxyisobutyrate dehydrogenase [Pirellula sp. 1] >gi|32443981|emb|CAD73423.1|
  misc_feature: GI Number: 21281068; NR Description: putative dehydrogenase [Arabidopsis thaliana] >gi|15293143|gb|AAK93682.1| putative dehydrogenase [Arabidopsis thaliana] >gi|18409781|ref|NP_565014.1| 6-phosphogluconate dehydrogenase
ATGGATTCAAATAATCATCTCTACGACCCGAATCCCACCGGGTCGGGTCTTCTTCGTTTTAGATCAGCTCCGAGCTCTGTTCTCGCCGCTTTTGTTGACGACGACAAGATTGGTTTCGACTCCGATAGGTTGCTTTCAAGATTCGTGACCTCTAATGGCGTTAACGGAGATCTGGGTTCACCTAAATTCGAGGATAAGTCTCCGGTTTCGTTAACGAACACCTCTGTTTCATACGCCGCCACTCTGCCGCCACCGCCGCAGCTTGAGCCGTCGAGTTTTCTGGGTTTGCCGCCGCATTACCCGAGGCAGAGTAAAGGGATAATGAACTCGGTTGGTTTGGATCAGTTTCTCGGTATCAATAATCATCACACCAAACCAGTTGAATCTAATCTTCTCCGTCAAAGCAGCTCTCCAGCCGGAATGTTTACTAATCTCTCTGACCAAAACGAGTTAAAGCACTTTGGACTCAACAAATCTAATAAGTGTTTACTATATACTTACAAATTTGCAGGTTATGGTTCAATGAGGAATTTGATGAATTACGAAGAAGATGAAGAGAGTCCATCTAATTCCAATGGATTAAGACGCCATTGCAGTCTCTCTTCAAGGCCACCTTCTTCACTTGGAATGCTTTCTCAAATACCTGAAATCGCACCCGAAACTAATTTTCCATATAGCCATTGGAATGATCCATCCAGCTTTATTGATAACTTATCCTCACTTAAAAGAGAAGCCGAGGACGATGGAAAATTGTTTCTCGGAGCTCAGAACGGAGAGTCCGGGAATCGTATGCAGTTACTGTCGCATCATTTGAGCCTACCAAAGTCATCATCGACAGCCTCGGACATGGTTTCAGTGGATAAGTATCTTCAGCTACAAGATTCTGTTCCTTGTAAAATCAGAGCCAAACGTGGTTGCGCTACACATCCTCGAAGCATCGCTGAACGGGTAAGAAGAACGCGGATAAGCGAGCGAATGAGGAAGTTACAAGAGCTTGTTCCTAACATGGACAAGCAAACCAACACTTCGGATATGTTGGATTTAGCTGTGGATTACATCAAAGATTTACAAAGACAGTATAAGATTTTAAACGACAACAGAGCTAACTGTAAGTGTATGAACAAGGAGAAGAAGTCAATATAG

SEQ ID NO: 1919 - DNA, 1463 bp, Arabidopsis thaliana
  misc_feature (1)..(1463): Ceres cDNA ID no. 12719461
  misc_feature (1)..(1463): Also known as  Ceres CDNA ID no. 23539064
gttcatatgatgaagaagtttctctcgttctcctccaacgcgtagaaaattctgacggcttaacgatgtggcgaagatctgttgtttatcgtttctcttcaagaatctctgtttcttcttcgttaccaaaccctagactgattccttggtcccgcgaattatgtgccgttaatagcttctcccagcctccggtctcgacggaatcaactgctaagttagggatcactggtgttagatctgatgccaatcgagtttttgccactgctactgccgccgctacagctacagctaccaccggtgagatttcgtctagagttgcggctttggctggattagggcatcactacgctcgttgttattgggagctttctaaagctaaacttagtatgcttgtggttgcaacttctggaactgggtatattctgggtacgggaaatgctgcaattagcttcccggggctttgttacacatgtgcaggaaccatgatgattgctgcatctgctaattccttgaatcagatttttgagataagcaatgattctaagatgaaaagaacgatgctaaggccattgccttcaggacgtattagtgttccacacgctgttgcatgggctactattgctggtgcttctggtgcttgtttgttggccagcaagactaatatgttggctgctggacttgcatctgccaatcttgtactttatgcgtttgtttatactccgttgaagcaacttcaccctatcaatacatgggttggcgctgttgttggtgctatcccacccttgcttgggtgggcggcagcgtctggtcagatttcatacaattcgatgattcttccagctgctctttacttttggcagatacctcattttatggcccttgcacatctctgccgcaatgattatgcagctggaggttacaagatgttgtcactctttgatccgtcagggaagagaatagcagcagtggctctaaggaactgcttttacatgatccctctcggtttcatcgcctatgactgggggttaacctcaagttggttttgcctcgaatcaacacttctcacactagcaatcgctgcaacagcattttcattctaccgagaccggaccatgcataaagcaaggaaaatgttccatgccagtcttctcttccttcctgttttcatgtctggtcttcttctacaccgtgtctctaatgataatcagcaacaactcgtagaagaagccggattaacaaattctgtatctggtgaagtcaaaactcagaggcgaaagaaacgtgtggctcaacctccggtggcttatgcctctgctgcaccgtttcctttcctcccagctccttccttctactctccatgataacctttaagcaagctattgaatttttggaaacagaaattaaaaaaaaaatctgaaaagttcttaagtttaatctttggttaataatgaagtggagaacgc

SEQ ID NO: 1920 - protein, 1463 aa, Arabidopsis thaliana
  misc_feature: PFam Name: NAD_binding_2; PFam Description: NAD binding
  misc_feature: GI Number: 34909392; NR Description: putative dehydrogenase [Oryza sativa (japonica cultivar-group)] >gi|20521418|dbj|BAB91928.1| putative dehydrogenase [Oryza sativa
  misc_feature: GI Number: 32472744; NR Description: 3-hydroxyisobutyrate dehydrogenase [Pirellula sp. 1] >gi|32443981|emb|CAD73423.1|
  misc_feature: GI Number: 21281068; NR Description: putative dehydrogenase [Arabidopsis thaliana] >gi|15293143|gb|AAK93682.1| putative dehydrogenase [Arabidopsis thaliana] >gi|18409781|ref|NP_565014.1| 6-phosphogluconate dehydrogenase
GTTCATATGATGAAGAAGTTTCTCTCGTTCTCCTCCAACGCGTAGAAAATTCTGACGGCTTAACGATGTGGCGAAGATCTGTTGTTTATCGTTTCTCTTCAAGAATCTCTGTTTCTTCTTCGTTACCAAACCCTAGACTGATTCCTTGGTCCCGCGAATTATGTGCCGTTAATAGCTTCTCCCAGCCTCCGGTCTCGACGGAATCAACTGCTAAGTTAGGGATCACTGGTGTTAGATCTGATGCCAATCGAGTTTTTGCCACTGCTACTGCCGCCGCTACAGCTACAGCTACCACCGGTGAGATTTCGTCTAGAGTTGCGGCTTTGGCTGGATTAGGGCATCACTACGCTCGTTGTTATTGGGAGCTTTCTAAAGCTAAACTTAGTATGCTTGTGGTTGCAACTTCTGGAACTGGGTATATTCTGGGTACGGGAAATGCTGCAATTAGCTTCCCGGGGCTTTGTTACACATGTGCAGGAACCATGATGATTGCTGCATCTGCTAATTCCTTGAATCAGATTTTTGAGATAAGCAATGATTCTAAGATGAAAAGAACGATGCTAAGGCCATTGCCTTCAGGACGTATTAGTGTTCCACACGCTGTTGCATGGGCTACTATTGCTGGTGCTTCTGGTGCTTGTTTGTTGGCCAGCAAGACTAATATGTTGGCTGCTGGACTTGCATCTGCCAATCTTGTACTTTATGCGTTTGTTTATACTCCGTTGAAGCAACTTCACCCTATCAATACATGGGTTGGCGCTGTTGTTGGTGCTATCCCACCCTTGCTTGGGTGGGCGGCAGCGTCTGGTCAGATTTCATACAATTCGATGATTCTTCCAGCTGCTCTTTACTTTTGGCAGATACCTCATTTTATGGCCCTTGCACATCTCTGCCGCAATGATTATGCAGCTGGAGGTTACAAGATGTTGTCACTCTTTGATCCGTCAGGGAAGAGAATAGCAGCAGTGGCTCTAAGGAACTGCTTTTACATGATCCCTCTCGGTTTCATCGCCTATGACTGGGGGTTAACCTCAAGTTGGTTTTGCCTCGAATCAACACTTCTCACACTAGCAATCGCTGCAACAGCATTTTCATTCTACCGAGACCGGACCATGCATAAAGCAAGGAAAATGTTCCATGCCAGTCTTCTCTTCCTTCCTGTTTTCATGTCTGGTCTTCTTCTACACCGTGTCTCTAATGATAATCAGCAACAACTCGTAGAAGAAGCCGGATTAACAAATTCTGTATCTGGTGAAGTCAAAACTCAGAGGCGAAAGAAACGTGTGGCTCAACCTCCGGTGGCTTATGCCTCTGCTGCACCGTTTCCTTTCCTCCCAGCTCCTTCCTTCTACTCTCCATGATAACCTTTAAGCAAGCTATTGAATTTTTGGAAACAGAAATTAAAAAAAAAATCTGAAAAGTTCTTAAGTTTAATCTTTGGTTAATAATGAAGTGGAGAACGC

SEQ ID NO: 1921 - DNA, 954 bp, Arabidopsis thaliana
  misc_feature (1)..(954): Ceres cDNA ID no. 12719504
  misc_feature (1)..(954): Also known as  Ceres CDNA ID no. 23539064
atggctaattcctcctccttctccccctctaccaccgtaacagatttaatctccaccgtccatgacgacatcatagagtctcacatcttgacacgtctcgacggcgcaaccttagcatccgtctcttgcgcctcctcacatcttcatcatctcgcttccaatgagatcctctggtccaaaatctgccgatccacgtggccttcttgctccggtggttctcgttctttcttctccgacgcttattctatggtggaaaccgccggtacagtctctgatctcgaccgtccgtttccggaattgatctccgccgtggatcttcactacagagggaagttgatttttagtagagtcgtgaagacggagactacgacggcgtggtttaagagttcgccgttgaggattgatctggtggatacaaaggatacggtggcgacgccgattaagagaagacagaggacggaagacacgtgtcgtgatctagagaaggatttgactttgagctggatcgtgattgatccgatcgggaaacgagcggcgaatatttcgagtcaccggccggtgtcggtgcagaggaactggataagcggagaagtggaggcgcaattcgcgacggtggtgggggcggtggagtgtgtgatcacggtggtcacgtgcggtgaggaggagatgcacgtgagggaagtgagtctcaaggtagagaagatggagggaacgcatttaaacgggagggacagtttggttattttaaggagtgtcatggagggtaaaagggtaaatggaagtaggagggaagtagaatcgaagaagagacacgaagagtttatggagaagaagagagagatgaaggagaagaagatgagggtagaatcggtatttgacattttgactgtagcttttggtattttaggctttgtgttgcttgttgtgttttgtctttggagaacctctatatga

SEQ ID NO: 1922 - protein, 954 aa, Arabidopsis thaliana
  misc_feature: PFam Name: NAD_binding_2; PFam Description: NAD binding
  misc_feature: GI Number: 34909392; NR Description: putative dehydrogenase [Oryza sativa (japonica cultivar-group)] >gi|20521418|dbj|BAB91928.1| putative dehydrogenase [Oryza sativa
  misc_feature: GI Number: 32472744; NR Description: 3-hydroxyisobutyrate dehydrogenase [Pirellula sp. 1] >gi|32443981|emb|CAD73423.1|
  misc_feature: GI Number: 21281068; NR Description: putative dehydrogenase [Arabidopsis thaliana] >gi|15293143|gb|AAK93682.1| putative dehydrogenase [Arabidopsis thaliana] >gi|18409781|ref|NP_565014.1| 6-phosphogluconate dehydrogenase
ATGGCTAATTCCTCCTCCTTCTCCCCCTCTACCACCGTAACAGATTTAATCTCCACCGTCCATGACGACATCATAGAGTCTCACATCTTGACACGTCTCGACGGCGCAACCTTAGCATCCGTCTCTTGCGCCTCCTCACATCTTCATCATCTCGCTTCCAATGAGATCCTCTGGTCCAAAATCTGCCGATCCACGTGGCCTTCTTGCTCCGGTGGTTCTCGTTCTTTCTTCTCCGACGCTTATTCTATGGTGGAAACCGCCGGTACAGTCTCTGATCTCGACCGTCCGTTTCCGGAATTGATCTCCGCCGTGGATCTTCACTACAGAGGGAAGTTGATTTTTAGTAGAGTCGTGAAGACGGAGACTACGACGGCGTGGTTTAAGAGTTCGCCGTTGAGGATTGATCTGGTGGATACAAAGGATACGGTGGCGACGCCGATTAAGAGAAGACAGAGGACGGAAGACACGTGTCGTGATCTAGAGAAGGATTTGACTTTGAGCTGGATCGTGATTGATCCGATCGGGAAACGAGCGGCGAATATTTCGAGTCACCGGCCGGTGTCGGTGCAGAGGAACTGGATAAGCGGAGAAGTGGAGGCGCAATTCGCGACGGTGGTGGGGGCGGTGGAGTGTGTGATCACGGTGGTCACGTGCGGTGAGGAGGAGATGCACGTGAGGGAAGTGAGTCTCAAGGTAGAGAAGATGGAGGGAACGCATTTAAACGGGAGGGACAGTTTGGTTATTTTAAGGAGTGTCATGGAGGGTAAAAGGGTAAATGGAAGTAGGAGGGAAGTAGAATCGAAGAAGAGACACGAAGAGTTTATGGAGAAGAAGAGAGAGATGAAGGAGAAGAAGATGAGGGTAGAATCGGTATTTGACATTTTGACTGTAGCTTTTGGTATTTTAGGCTTTGTGTTGCTTGTTGTGTTTTGTCTTTGGAGAACCTCTATATGA

SEQ ID NO: 1923 - DNA, 1029 bp, Arabidopsis thaliana
  misc_feature (1)..(1029): Ceres cDNA ID no. 12719513
  misc_feature (1)..(1029): Also known as  Ceres CDNA ID no. 23539064
acaactaaatcttaagtagaaagagtgaaacatggctaatcacaaaaatctcttctttctatgtttcttaataggtttagggttatgttctgctagacgagcactactctcctcctctgaatccgaggctgaagtcgctgcctatggcgtgaatagtggtttaagtgctggtcttggtgttggtattggtggtggtcctggaggaggatctggttacggaggtggaagcggtgaaggcggtggagctggtgggcatggcgagggacatattggtgggggcggaggtggtggacatggtggtggtgctggcggaggaggaggtggtggccctggaggaggctacggaggtggaagcggtgaaggtggtggagctggatacggaggcggagaagctggtgggcatggcggaggtggaggaggcggagcaggcggcggtggaggtggtggtggtggtgcacatggtggaggatacggtggtggacaaggtgctggtgctggaggaggatatggaggtggaggtgccgggggacatggaggtggtggaggcggtggaaatggtgggggtggaggaggaggttctggcgaaggaggagctcatggtggtggttacggagcaggaggtggagctggagagggatacggtggtggtgctggagctggtggacatggtggtggaggaggaggcggtggtggttccggaggtggaggaggaggaggtggaggttatgctgctgcttctggatacggtcacggtgggggtgctggtggtggagaaggaagcggtggctatgtaccatgaaaaattatctatatggagtgtaacggcaattgagtgaagtgtcatatctcgtaagggactatatagtttcacgatttatatgtggcaataaatagagtaatccttcgtataataagccgtagaaaggcggctattgttgaagtttttaaattgtaccacgaccaatattgttgtaagctactactacgtgtgtatcaagtttttataaatggaaatcatagttgttccta

SEQ ID NO: 1924 - protein, 1029 aa, Arabidopsis thaliana
  misc_feature: PFam Name: NAD_binding_2; PFam Description: NAD binding
  misc_feature: GI Number: 34909392; NR Description: putative dehydrogenase [Oryza sativa (japonica cultivar-group)] >gi|20521418|dbj|BAB91928.1| putative dehydrogenase [Oryza sativa
  misc_feature: GI Number: 32472744; NR Description: 3-hydroxyisobutyrate dehydrogenase [Pirellula sp. 1] >gi|32443981|emb|CAD73423.1|
  misc_feature: GI Number: 21281068; NR Description: putative dehydrogenase [Arabidopsis thaliana] >gi|15293143|gb|AAK93682.1| putative dehydrogenase [Arabidopsis thaliana] >gi|18409781|ref|NP_565014.1| 6-phosphogluconate dehydrogenase
ACAACTAAATCTTAAGTAGAAAGAGTGAAACATGGCTAATCACAAAAATCTCTTCTTTCTATGTTTCTTAATAGGTTTAGGGTTATGTTCTGCTAGACGAGCACTACTCTCCTCCTCTGAATCCGAGGCTGAAGTCGCTGCCTATGGCGTGAATAGTGGTTTAAGTGCTGGTCTTGGTGTTGGTATTGGTGGTGGTCCTGGAGGAGGATCTGGTTACGGAGGTGGAAGCGGTGAAGGCGGTGGAGCTGGTGGGCATGGCGAGGGACATATTGGTGGGGGCGGAGGTGGTGGACATGGTGGTGGTGCTGGCGGAGGAGGAGGTGGTGGCCCTGGAGGAGGCTACGGAGGTGGAAGCGGTGAAGGTGGTGGAGCTGGATACGGAGGCGGAGAAGCTGGTGGGCATGGCGGAGGTGGAGGAGGCGGAGCAGGCGGCGGTGGAGGTGGTGGTGGTGGTGCACATGGTGGAGGATACGGTGGTGGACAAGGTGCTGGTGCTGGAGGAGGATATGGAGGTGGAGGTGCCGGGGGACATGGAGGTGGTGGAGGCGGTGGAAATGGTGGGGGTGGAGGAGGAGGTTCTGGCGAAGGAGGAGCTCATGGTGGTGGTTACGGAGCAGGAGGTGGAGCTGGAGAGGGATACGGTGGTGGTGCTGGAGCTGGTGGACATGGTGGTGGAGGAGGAGGCGGTGGTGGTTCCGGAGGTGGAGGAGGAGGAGGTGGAGGTTATGCTGCTGCTTCTGGATACGGTCACGGTGGGGGTGCTGGTGGTGGAGAAGGAAGCGGTGGCTATGTACCATGAAAAATTATCTATATGGAGTGTAACGGCAATTGAGTGAAGTGTCATATCTCGTAAGGGACTATATAGTTTCACGATTTATATGTGGCAATAAATAGAGTAATCCTTCGTATAATAAGCCGTAGAAAGGCGGCTATTGTTGAAGTTTTTAAATTGTACCACGACCAATATTGTTGTAAGCTACTACTACGTGTGTATCAAGTTTTTATAAATGGAAATCATAGTTGTTCCTA

SEQ ID NO: 1925 - DNA, 1572 bp, Arabidopsis thaliana
  misc_feature (1)..(1572): Ceres cDNA ID no. 12719572
  misc_feature (1)..(1572): Also known as  Ceres CDNA ID no. 23539064
taaaatcgtaaagttctaaagcggtttttcatcaattttcaagcaatcgagaaaaaagcaatggcgtcagacaaacaaaaggcggagagagccgaggttgcggcgaggctagcggctgaggacttgcatgacattaacaaatccggtggtgctgatgtcacaatgtataaggtgacggagagaacaactgaacatccaccggagcaagataggcccggtgtgataggatcagtgttcagggctgtccaaggaacgtatgagcatgcgagagacgctgtagttggaaaaacccacgaagcggctgagtctaccaaagaaggagctcagatagcttcagagaaagcggttggagcaaaggacgcaaccgtcgagaaagctaaggaaaccgctgattatactgcggagaaggtgggtgagtataaagactatacggttgataaagctaaagaggctaaggacacaactgcagagaaggcgaaggagactgctaattatactgcggataaggcggtggaagcaaaggataagacggcggagaagattggtgagtacaaagactatgcggtggataaggcagtagaagctaaagataagacagcggagaaggcgaaggagactgcgaattatacggcggataaggctaaagaggctaaggacaagacggctgagaaggttggtgagtataaggattacacggtggacaaggccgtggaagctagggattacacagcggagaaggctattgaagcaaaggataagacagctgagaagactggagagtataaggactatacggtggagaaggcgacggaggggaaagatgttacggtgagtaagctaggagagctgaaggatagtgccgttgagacagcgaagagagctatgggtttcttgtcggggaagacagaggaggccaaaggaaaagctgtggagaccaaagatactgccaaggaaaacatggagaaagctggagaagtaacaagacaaaagatggaggaaatgagattggaaggtaaagagctcaaagaagaagctggagcaaaagcccaagaggcatctcaaaagactagggagagtactgagtcgggagctcaaaaagccgaagagaccaaagattctgctgccgtgaggggaaatgaagcgaaagggactatttttggtgcattagggaatgtaacggaagcaataaagagcaaactgacaatgccatcagacattgtggaggaaacacgcgcggcacgtgagcatggagggacgggtaggactgtggttgaagtcaaggtcgaggattcaaagccgggtaaggtggcgacttcactgaaggcgtcggatcaaatgaccggtcaaacattcaacgacgttggacggatggatgatgatgctcggaaagataagggaaagctgtgagaatactagaaaaatgacaatgttttttgggccttttgttctggatgaatatctctgttgttttttgggccttttgttttggatacgtctgttatagcagataacgttttctgatagtttctatgtttgtattcttgttttggaataggaaagctttcttcagtt

SEQ ID NO: 1926 - protein, 1572 aa, Arabidopsis thaliana
  misc_feature: PFam Name: NAD_binding_2; PFam Description: NAD binding
  misc_feature: GI Number: 34909392; NR Description: putative dehydrogenase [Oryza sativa (japonica cultivar-group)] >gi|20521418|dbj|BAB91928.1| putative dehydrogenase [Oryza sativa
  misc_feature: GI Number: 32472744; NR Description: 3-hydroxyisobutyrate dehydrogenase [Pirellula sp. 1] >gi|32443981|emb|CAD73423.1|
  misc_feature: GI Number: 21281068; NR Description: putative dehydrogenase [Arabidopsis thaliana] >gi|15293143|gb|AAK93682.1| putative dehydrogenase [Arabidopsis thaliana] >gi|18409781|ref|NP_565014.1| 6-phosphogluconate dehydrogenase
TAAAATCGTAAAGTTCTAAAGCGGTTTTTCATCAATTTTCAAGCAATCGAGAAAAAAGCAATGGCGTCAGACAAACAAAAGGCGGAGAGAGCCGAGGTTGCGGCGAGGCTAGCGGCTGAGGACTTGCATGACATTAACAAATCCGGTGGTGCTGATGTCACAATGTATAAGGTGACGGAGAGAACAACTGAACATCCACCGGAGCAAGATAGGCCCGGTGTGATAGGATCAGTGTTCAGGGCTGTCCAAGGAACGTATGAGCATGCGAGAGACGCTGTAGTTGGAAAAACCCACGAAGCGGCTGAGTCTACCAAAGAAGGAGCTCAGATAGCTTCAGAGAAAGCGGTTGGAGCAAAGGACGCAACCGTCGAGAAAGCTAAGGAAACCGCTGATTATACTGCGGAGAAGGTGGGTGAGTATAAAGACTATACGGTTGATAAAGCTAAAGAGGCTAAGGACACAACTGCAGAGAAGGCGAAGGAGACTGCTAATTATACTGCGGATAAGGCGGTGGAAGCAAAGGATAAGACGGCGGAGAAGATTGGTGAGTACAAAGACTATGCGGTGGATAAGGCAGTAGAAGCTAAAGATAAGACAGCGGAGAAGGCGAAGGAGACTGCGAATTATACGGCGGATAAGGCTAAAGAGGCTAAGGACAAGACGGCTGAGAAGGTTGGTGAGTATAAGGATTACACGGTGGACAAGGCCGTGGAAGCTAGGGATTACACAGCGGAGAAGGCTATTGAAGCAAAGGATAAGACAGCTGAGAAGACTGGAGAGTATAAGGACTATACGGTGGAGAAGGCGACGGAGGGGAAAGATGTTACGGTGAGTAAGCTAGGAGAGCTGAAGGATAGTGCCGTTGAGACAGCGAAGAGAGCTATGGGTTTCTTGTCGGGGAAGACAGAGGAGGCCAAAGGAAAAGCTGTGGAGACCAAAGATACTGCCAAGGAAAACATGGAGAAAGCTGGAGAAGTAACAAGACAAAAGATGGAGGAAATGAGATTGGAAGGTAAAGAGCTCAAAGAAGAAGCTGGAGCAAAAGCCCAAGAGGCATCTCAAAAGACTAGGGAGAGTACTGAGTCGGGAGCTCAAAAAGCCGAAGAGACCAAAGATTCTGCTGCCGTGAGGGGAAATGAAGCGAAAGGGACTATTTTTGGTGCATTAGGGAATGTAACGGAAGCAATAAAGAGCAAACTGACAATGCCATCAGACATTGTGGAGGAAACACGCGCGGCACGTGAGCATGGAGGGACGGGTAGGACTGTGGTTGAAGTCAAGGTCGAGGATTCAAAGCCGGGTAAGGTGGCGACTTCACTGAAGGCGTCGGATCAAATGACCGGTCAAACATTCAACGACGTTGGACGGATGGATGATGATGCTCGGAAAGATAAGGGAAAGCTGTGAGAATACTAGAAAAATGACAATGTTTTTTGGGCCTTTTGTTCTGGATGAATATCTCTGTTGTTTTTTGGGCCTTTTGTTTTGGATACGTCTGTTATAGCAGATAACGTTTTCTGATAGTTTCTATGTTTGTATTCTTGTTTTGGAATAGGAAAGCTTTCTTCAGTT

SEQ ID NO: 1927 - DNA, 1522 bp, Arabidopsis thaliana
  misc_feature (1)..(1522): Ceres cDNA ID no. 12719634
  misc_feature (1)..(1522): Also known as  Ceres CDNA ID no. 23539064
aaaacttcaagaaaaaaagattcttcaaaagagcaaaaaaatcaatggagagagcaaagtcgaggaagcctcatatcatgatgataccatacccacttcaaggtcacgttatcccttttgtccacttagccatcaaacttgcttctcatggcttcaccatcactttcgtcaacaccgactccatccaccaccacatctccaccgctcaccaagatgacgccggtgacatcttctccgccgctcgcagctccggccagcacgacatacgttacaccaccgtgagcgacggcttccctttagactttgaccggtcactgaaccatgaccagtttttcgaaggcattctccacgtcttctctgcccacgtggatgatctcatcgccaaactctcccgccgtgatgatcctcccgtgacttgcttgatcgccgacacgttttatgtttggtcatctatgatttgcgacaagcacaaccttgtaaatgtctcgttttggaccgaacctgccttggtcctcaatctctattatcacatggatctcctcatatctaacggtcatttcaaatctcttgataatcgtaaagacgtgatcgattacgtaccaggggttaaagcaatagaaccaaaggacttgatgtcatatcttcaagtaagcgacaaagacgtagacacaaatacagtagtatacagaatattattcaaggcctttaaagacgtcaagagagccgacttcgtcgtatgcaacacggtgcaagagctcgaaccagactctctctcggctctacaagccaaacaaccggtttacgctatcggtccggttttctcaactgattcggtagttcccacaagcttatgggccgagtcagactgtaccgagtggcttaagggccggcccactgggtcagttctctacgtctcgtttggtagctatgcacatgttggtaagaaggagattgttgagatagctcatgggcttttgcttagtgggattagtttcatttgggttttacgtccggatatagttggatccaacgtaccagattttcttccagccgggtttgtggaccaagcccaagatcgaggtcttgtggtccaatggtgctgccagatggaagttatttcaaatccggccgtgggagggtttttcacacattgtggatggaattcaattctagagagcgtttggtgtggtttgcctttgttgtgttatccacttttgacagatcagttcacgaataggaagcttgtggtcgatgattggtgcattgggattaatctttgtgagaagaagacaatcacaagggaccaagtctcagcgaatgttaaaagattgatgaatggagaaacttcaagtgagctaagaaacaatgttgaaaaggttaaacgtcatctcaaagatgcggttacaaccgttggatcttcggagacgaattttaacttgtttgttagtgaggtccgaaatagaatagaaactaaattgtgtaatgtaaatggactagaaataagtccatcaaactaaacaat

SEQ ID NO: 1928 - protein, 1522 aa, Arabidopsis thaliana
  misc_feature: PFam Name: NAD_binding_2; PFam Description: NAD binding
  misc_feature: GI Number: 34909392; NR Description: putative dehydrogenase [Oryza sativa (japonica cultivar-group)] >gi|20521418|dbj|BAB91928.1| putative dehydrogenase [Oryza sativa
  misc_feature: GI Number: 32472744; NR Description: 3-hydroxyisobutyrate dehydrogenase [Pirellula sp. 1] >gi|32443981|emb|CAD73423.1|
  misc_feature: GI Number: 21281068; NR Description: putative dehydrogenase [Arabidopsis thaliana] >gi|15293143|gb|AAK93682.1| putative dehydrogenase [Arabidopsis thaliana] >gi|18409781|ref|NP_565014.1| 6-phosphogluconate dehydrogenase
AAAACTTCAAGAAAAAAAGATTCTTCAAAAGAGCAAAAAAATCAATGGAGAGAGCAAAGTCGAGGAAGCCTCATATCATGATGATACCATACCCACTTCAAGGTCACGTTATCCCTTTTGTCCACTTAGCCATCAAACTTGCTTCTCATGGCTTCACCATCACTTTCGTCAACACCGACTCCATCCACCACCACATCTCCACCGCTCACCAAGATGACGCCGGTGACATCTTCTCCGCCGCTCGCAGCTCCGGCCAGCACGACATACGTTACACCACCGTGAGCGACGGCTTCCCTTTAGACTTTGACCGGTCACTGAACCATGACCAGTTTTTCGAAGGCATTCTCCACGTCTTCTCTGCCCACGTGGATGATCTCATCGCCAAACTCTCCCGCCGTGATGATCCTCCCGTGACTTGCTTGATCGCCGACACGTTTTATGTTTGGTCATCTATGATTTGCGACAAGCACAACCTTGTAAATGTCTCGTTTTGGACCGAACCTGCCTTGGTCCTCAATCTCTATTATCACATGGATCTCCTCATATCTAACGGTCATTTCAAATCTCTTGATAATCGTAAAGACGTGATCGATTACGTACCAGGGGTTAAAGCAATAGAACCAAAGGACTTGATGTCATATCTTCAAGTAAGCGACAAAGACGTAGACACAAATACAGTAGTATACAGAATATTATTCAAGGCCTTTAAAGACGTCAAGAGAGCCGACTTCGTCGTATGCAACACGGTGCAAGAGCTCGAACCAGACTCTCTCTCGGCTCTACAAGCCAAACAACCGGTTTACGCTATCGGTCCGGTTTTCTCAACTGATTCGGTAGTTCCCACAAGCTTATGGGCCGAGTCAGACTGTACCGAGTGGCTTAAGGGCCGGCCCACTGGGTCAGTTCTCTACGTCTCGTTTGGTAGCTATGCACATGTTGGTAAGAAGGAGATTGTTGAGATAGCTCATGGGCTTTTGCTTAGTGGGATTAGTTTCATTTGGGTTTTACGTCCGGATATAGTTGGATCCAACGTACCAGATTTTCTTCCAGCCGGGTTTGTGGACCAAGCCCAAGATCGAGGTCTTGTGGTCCAATGGTGCTGCCAGATGGAAGTTATTTCAAATCCGGCCGTGGGAGGGTTTTTCACACATTGTGGATGGAATTCAATTCTAGAGAGCGTTTGGTGTGGTTTGCCTTTGTTGTGTTATCCACTTTTGACAGATCAGTTCACGAATAGGAAGCTTGTGGTCGATGATTGGTGCATTGGGATTAATCTTTGTGAGAAGAAGACAATCACAAGGGACCAAGTCTCAGCGAATGTTAAAAGATTGATGAATGGAGAAACTTCAAGTGAGCTAAGAAACAATGTTGAAAAGGTTAAACGTCATCTCAAAGATGCGGTTACAACCGTTGGATCTTCGGAGACGAATTTTAACTTGTTTGTTAGTGAGGTCCGAAATAGAATAGAAACTAAATTGTGTAATGTAAATGGACTAGAAATAAGTCCATCAAACTAAACAAT

SEQ ID NO: 1929 - DNA, 1077 bp, Arabidopsis thaliana
  misc_feature (1)..(1077): Ceres cDNA ID no. 12719900
  misc_feature (1)..(1077): Also known as  Ceres CDNA ID no. 23539064
atgaagatgaagacagttcttgtaatcataaactgtatattcttggccattggaaactgtggaggccctctaatgatgcgtctctacttccaaaatggtggcgaaaggatctggtttccaagcttccttcaaaccgttggttgtccactcattttcttccctcttctcttatctttcctccgccgtcgtcgttgccttgaagaacaagaaacgactccatttttcctcatgaaacctcctctctttatcgccgctatcgttgttggtttgctcgtgggatttgacaattacctctactcttacgggttagcttatatccctgtttctactgcgtctttgatcatctccgcgcaattaggcttcactgctctctttgcattttttatggtgaagcaaaagttcacacctttcactataaacgctatcgttttgctcactggtggtgccgtagtccttgcccttaactctgatagtgacaagcttgcaaacgagacacacaaggaatatgttgttgggttcatcatgactcttggtgcagctcttctctatgggtttatattgccacttgtcgagctttcttacaagaaatctggtcagcgaatcacgtatacgctcgcgctcgagttccagatggtcttatgctttgctgccacttgtgtctgcctcgtggggatgctagccgctggcgatttcaaggtaaaacatgctttgtttattttcaagaatagggtgatagcaggagaagcaagagattttaagcttggagagtctttgtactatgtggtgattgtgttcacggccataatctggcaagcattttttgtgggagctattgggttgatcttctgtgcatcgtctctggtctctggaattatggtcagtgctctgcttccggtgacggtgatcttggccgtcatttgcttccaggagaagtttcaggcggggaaaggtgtcgctttggctctctccctctggggatcagtctcttatttctatggacaggttaaatccgaggagaagactaaggctcaggatacacaactgtctcagcttccagttactgattatgtagcttaa

SEQ ID NO: 1930 - protein, 1077 aa, Arabidopsis thaliana
  misc_feature: PFam Name: NAD_binding_2; PFam Description: NAD binding
  misc_feature: GI Number: 34909392; NR Description: putative dehydrogenase [Oryza sativa (japonica cultivar-group)] >gi|20521418|dbj|BAB91928.1| putative dehydrogenase [Oryza sativa
  misc_feature: GI Number: 32472744; NR Description: 3-hydroxyisobutyrate dehydrogenase [Pirellula sp. 1] >gi|32443981|emb|CAD73423.1|
  misc_feature: GI Number: 21281068; NR Description: putative dehydrogenase [Arabidopsis thaliana] >gi|15293143|gb|AAK93682.1| putative dehydrogenase [Arabidopsis thaliana] >gi|18409781|ref|NP_565014.1| 6-phosphogluconate dehydrogenase
ATGAAGATGAAGACAGTTCTTGTAATCATAAACTGTATATTCTTGGCCATTGGAAACTGTGGAGGCCCTCTAATGATGCGTCTCTACTTCCAAAATGGTGGCGAAAGGATCTGGTTTCCAAGCTTCCTTCAAACCGTTGGTTGTCCACTCATTTTCTTCCCTCTTCTCTTATCTTTCCTCCGCCGTCGTCGTTGCCTTGAAGAACAAGAAACGACTCCATTTTTCCTCATGAAACCTCCTCTCTTTATCGCCGCTATCGTTGTTGGTTTGCTCGTGGGATTTGACAATTACCTCTACTCTTACGGGTTAGCTTATATCCCTGTTTCTACTGCGTCTTTGATCATCTCCGCGCAATTAGGCTTCACTGCTCTCTTTGCATTTTTTATGGTGAAGCAAAAGTTCACACCTTTCACTATAAACGCTATCGTTTTGCTCACTGGTGGTGCCGTAGTCCTTGCCCTTAACTCTGATAGTGACAAGCTTGCAAACGAGACACACAAGGAATATGTTGTTGGGTTCATCATGACTCTTGGTGCAGCTCTTCTCTATGGGTTTATATTGCCACTTGTCGAGCTTTCTTACAAGAAATCTGGTCAGCGAATCACGTATACGCTCGCGCTCGAGTTCCAGATGGTCTTATGCTTTGCTGCCACTTGTGTCTGCCTCGTGGGGATGCTAGCCGCTGGCGATTTCAAGGTAAAACATGCTTTGTTTATTTTCAAGAATAGGGTGATAGCAGGAGAAGCAAGAGATTTTAAGCTTGGAGAGTCTTTGTACTATGTGGTGATTGTGTTCACGGCCATAATCTGGCAAGCATTTTTTGTGGGAGCTATTGGGTTGATCTTCTGTGCATCGTCTCTGGTCTCTGGAATTATGGTCAGTGCTCTGCTTCCGGTGACGGTGATCTTGGCCGTCATTTGCTTCCAGGAGAAGTTTCAGGCGGGGAAAGGTGTCGCTTTGGCTCTCTCCCTCTGGGGATCAGTCTCTTATTTCTATGGACAGGTTAAATCCGAGGAGAAGACTAAGGCTCAGGATACACAACTGTCTCAGCTTCCAGTTACTGATTATGTAGCTTAA

SEQ ID NO: 1931 - DNA, 1802 bp, Arabidopsis thaliana
  misc_feature (1)..(1802): Ceres cDNA ID no. 12720123
  misc_feature (1)..(1802): Also known as  Ceres CDNA ID no. 23539064
cttcttcttcttcttcgcgaaaacttggaaactgttttaggaacaaaaaccagaggctttgatttggaaaaaaccctaattttcaacaaccctaaatcccctaccatttctccccaaatcctctttccaagttccatactctttatgtaaatgcatctgaagaaatcatctgtaacagaacgacgattaatcgggaaagacgattccgatccaaaccaaatccccaatccgattcatcatcatcatcagacccagaataaaaatcgaaccgccattgataataaaggctctggcttcactaagtataatcatccccaaggtcagaatcatcatcacacggttgatatcccaaccggtgttgaccatttccgacgaagaagcgcacgggcacgatcaggatcgatttcttcatttttcccatcaaatcttttgtcttctctttcttcctatcgtcctgtgattgctcggttcttgaggaagcttctacgctatacccttagagcccgtttgatttgtttccatcttcgtttcttgcttcttctcgctgtccctcctttatacatcttcttccttgttatcaatcttcgtatcttccttcgtctagtctttgtgattatcgctttatccttcatcctctcgatctctctcagattcgctcttcctcacttaacatcaattcgtctttttgtcgcacgcttgctgacatttatccctgccagattctcttcctctcagccgagcactgaccgagttgtttggtccattgggtcgaagccagttgcggagaataataagacaaattcaggatcttgggttcagaagtatggcactaatgatatgtatgaaggagagtttcatagaggaaagtgttcaggaagtggagtttattactattctatgaaaggcaaatacgaaggagagtggattgatgggaaatatgatggttatggagtagaaacatggtctaaagggagtaggtatcgaggtcaatataggttaggtctaagacatggaattggagtttatacgttttatacaggagatgtgtatgctggtgaatggtctaatgggcagtgccatggttgtggtgtatatacctctgaggatggaagtagatatgacggagagttcaagtggggtgtcaaacatggccttggtagttaccatttcagaaatggtgatgcgtatgctggggagtattttgcagacaagatgcatggttttggagtgtatcactttgcgaacgggcataagtatgaaggagcttggcacgagggaagaaggcaagggcttggtatgtatactttcaggaatggtgatacacaagccggtcattgggaagacggtgtactcagttgtcctaccgagcagactatccgtcctggatcatcttttaccataagccattccaaagttgttgatgctgttgagcaagcaaggaaagcagctgagaaagcacatgaagttgtgaaagtggaagagaggatcaagagagcggtgatggctgcaaatagagcagcgaatgcagctagagtagcagccgtgaaggctgtccaatcccagacctttcacaggaatgatggcgatcttgaaaccaattgttgagcataggttagaagagatcttccttaacaggttttcttgttcctttatgagcaaagctagtttgaaactgtagataataaactagagatgatctttgtatatcaacaagaaaaaaattgggtctgcttcatagaatgcaactgacatacatgtagccaaaaatccctatcttgattaaacaattagaagaatctggt

SEQ ID NO: 1932 - protein, 1802 aa, Arabidopsis thaliana
  misc_feature: PFam Name: NAD_binding_2; PFam Description: NAD binding
  misc_feature: GI Number: 34909392; NR Description: putative dehydrogenase [Oryza sativa (japonica cultivar-group)] >gi|20521418|dbj|BAB91928.1| putative dehydrogenase [Oryza sativa
  misc_feature: GI Number: 32472744; NR Description: 3-hydroxyisobutyrate dehydrogenase [Pirellula sp. 1] >gi|32443981|emb|CAD73423.1|
  misc_feature: GI Number: 21281068; NR Description: putative dehydrogenase [Arabidopsis thaliana] >gi|15293143|gb|AAK93682.1| putative dehydrogenase [Arabidopsis thaliana] >gi|18409781|ref|NP_565014.1| 6-phosphogluconate dehydrogenase
CTTCTTCTTCTTCTTCGCGAAAACTTGGAAACTGTTTTAGGAACAAAAACCAGAGGCTTTGATTTGGAAAAAACCCTAATTTTCAACAACCCTAAATCCCCTACCATTTCTCCCCAAATCCTCTTTCCAAGTTCCATACTCTTTATGTAAATGCATCTGAAGAAATCATCTGTAACAGAACGACGATTAATCGGGAAAGACGATTCCGATCCAAACCAAATCCCCAATCCGATTCATCATCATCATCAGACCCAGAATAAAAATCGAACCGCCATTGATAATAAAGGCTCTGGCTTCACTAAGTATAATCATCCCCAAGGTCAGAATCATCATCACACGGTTGATATCCCAACCGGTGTTGACCATTTCCGACGAAGAAGCGCACGGGCACGATCAGGATCGATTTCTTCATTTTTCCCATCAAATCTTTTGTCTTCTCTTTCTTCCTATCGTCCTGTGATTGCTCGGTTCTTGAGGAAGCTTCTACGCTATACCCTTAGAGCCCGTTTGATTTGTTTCCATCTTCGTTTCTTGCTTCTTCTCGCTGTCCCTCCTTTATACATCTTCTTCCTTGTTATCAATCTTCGTATCTTCCTTCGTCTAGTCTTTGTGATTATCGCTTTATCCTTCATCCTCTCGATCTCTCTCAGATTCGCTCTTCCTCACTTAACATCAATTCGTCTTTTTGTCGCACGCTTGCTGACATTTATCCCTGCCAGATTCTCTTCCTCTCAGCCGAGCACTGACCGAGTTGTTTGGTCCATTGGGTCGAAGCCAGTTGCGGAGAATAATAAGACAAATTCAGGATCTTGGGTTCAGAAGTATGGCACTAATGATATGTATGAAGGAGAGTTTCATAGAGGAAAGTGTTCAGGAAGTGGAGTTTATTACTATTCTATGAAAGGCAAATACGAAGGAGAGTGGATTGATGGGAAATATGATGGTTATGGAGTAGAAACATGGTCTAAAGGGAGTAGGTATCGAGGTCAATATAGGTTAGGTCTAAGACATGGAATTGGAGTTTATACGTTTTATACAGGAGATGTGTATGCTGGTGAATGGTCTAATGGGCAGTGCCATGGTTGTGGTGTATATACCTCTGAGGATGGAAGTAGATATGACGGAGAGTTCAAGTGGGGTGTCAAACATGGCCTTGGTAGTTACCATTTCAGAAATGGTGATGCGTATGCTGGGGAGTATTTTGCAGACAAGATGCATGGTTTTGGAGTGTATCACTTTGCGAACGGGCATAAGTATGAAGGAGCTTGGCACGAGGGAAGAAGGCAAGGGCTTGGTATGTATACTTTCAGGAATGGTGATACACAAGCCGGTCATTGGGAAGACGGTGTACTCAGTTGTCCTACCGAGCAGACTATCCGTCCTGGATCATCTTTTACCATAAGCCATTCCAAAGTTGTTGATGCTGTTGAGCAAGCAAGGAAAGCAGCTGAGAAAGCACATGAAGTTGTGAAAGTGGAAGAGAGGATCAAGAGAGCGGTGATGGCTGCAAATAGAGCAGCGAATGCAGCTAGAGTAGCAGCCGTGAAGGCTGTCCAATCCCAGACCTTTCACAGGAATGATGGCGATCTTGAAACCAATTGTTGAGCATAGGTTAGAAGAGATCTTCCTTAACAGGTTTTCTTGTTCCTTTATGAGCAAAGCTAGTTTGAAACTGTAGATAATAAACTAGAGATGATCTTTGTATATCAACAAGAAAAAAATTGGGTCTGCTTCATAGAATGCAACTGACATACATGTAGCCAAAAATCCCTATCTTGATTAAACAATTAGAAGAATCTGGT

SEQ ID NO: 1933 - DNA, 858 bp, Arabidopsis thaliana
  misc_feature (1)..(858): Ceres cDNA ID no. 12720130
  misc_feature (1)..(858): Also known as  Ceres CDNA ID no. 23539064
atggctggtctcgatctaggcacaacttctcgctacgtccacaacgtcgatggtggcggcggcggacagttcaccaccgacaaccaccacgaagatgacggtggcgctggaggaaaccaccatcatcaccatcataatcataatcaccatcaaggtttagatttaatagcttctaatgataactctggactaggcggcggtggaggaggagggagcggtgacctcgtcatgcgtcggccacgtggccgtccagctggatcgaagaacaaaccgaagccgccggtgattgtcacgcgcgagagcgcaaacactcttagggctcacattcttgaagttggaagtggctgcgacgttttcgaatgtatctccacttacgctcgtcggagacagcgcgggatttgcgttttatccgggacgggaaccgtcactaacgtcagcatccgtcagcctacggcggccggagctgttgtgactctgcggggtacttttgagattctttccctctccggatcttttcttccgccacctgctcctccaggggcgactagcttgacgatattcctcgctggagctcaaggacaggtcgtcggaggtaacgtagttggtgagttaatggcggcggggccggtaatggtcatggcagcgtcttttacaaacgtggcttacgaaaggttgcctttggacgagcatgaggagcacttgcaaagtggcggcggcggaggtggagggaatatgtactcggaagccactggcggtggcggagggttgcctttctttaatttgccgatgagtatgcctcagattggagttgaaagttggcaggggaatcacgccggcgccggtagggctccgttttag

SEQ ID NO: 1934 - protein, 858 aa, Arabidopsis thaliana
  misc_feature: PFam Name: NAD_binding_2; PFam Description: NAD binding
  misc_feature: GI Number: 34909392; NR Description: putative dehydrogenase [Oryza sativa (japonica cultivar-group)] >gi|20521418|dbj|BAB91928.1| putative dehydrogenase [Oryza sativa
  misc_feature: GI Number: 32472744; NR Description: 3-hydroxyisobutyrate dehydrogenase [Pirellula sp. 1] >gi|32443981|emb|CAD73423.1|
  misc_feature: GI Number: 21281068; NR Description: putative dehydrogenase [Arabidopsis thaliana] >gi|15293143|gb|AAK93682.1| putative dehydrogenase [Arabidopsis thaliana] >gi|18409781|ref|NP_565014.1| 6-phosphogluconate dehydrogenase
ATGGCTGGTCTCGATCTAGGCACAACTTCTCGCTACGTCCACAACGTCGATGGTGGCGGCGGCGGACAGTTCACCACCGACAACCACCACGAAGATGACGGTGGCGCTGGAGGAAACCACCATCATCACCATCATAATCATAATCACCATCAAGGTTTAGATTTAATAGCTTCTAATGATAACTCTGGACTAGGCGGCGGTGGAGGAGGAGGGAGCGGTGACCTCGTCATGCGTCGGCCACGTGGCCGTCCAGCTGGATCGAAGAACAAACCGAAGCCGCCGGTGATTGTCACGCGCGAGAGCGCAAACACTCTTAGGGCTCACATTCTTGAAGTTGGAAGTGGCTGCGACGTTTTCGAATGTATCTCCACTTACGCTCGTCGGAGACAGCGCGGGATTTGCGTTTTATCCGGGACGGGAACCGTCACTAACGTCAGCATCCGTCAGCCTACGGCGGCCGGAGCTGTTGTGACTCTGCGGGGTACTTTTGAGATTCTTTCCCTCTCCGGATCTTTTCTTCCGCCACCTGCTCCTCCAGGGGCGACTAGCTTGACGATATTCCTCGCTGGAGCTCAAGGACAGGTCGTCGGAGGTAACGTAGTTGGTGAGTTAATGGCGGCGGGGCCGGTAATGGTCATGGCAGCGTCTTTTACAAACGTGGCTTACGAAAGGTTGCCTTTGGACGAGCATGAGGAGCACTTGCAAAGTGGCGGCGGCGGAGGTGGAGGGAATATGTACTCGGAAGCCACTGGCGGTGGCGGAGGGTTGCCTTTCTTTAATTTGCCGATGAGTATGCCTCAGATTGGAGTTGAAAGTTGGCAGGGGAATCACGCCGGCGCCGGTAGGGCTCCGTTTTAG

SEQ ID NO: 1935 - DNA, 2328 bp, Arabidopsis thaliana
  misc_feature (1)..(2328): Ceres cDNA ID no. 12720156
  misc_feature (1)..(2328): Ceres CLONE  ID no. 1368266
  misc_feature (1)..(2328): Also known as  Ceres CDNA ID no. 23659432
accaaacgatcaaatcgatcggacaaagaggaagaagaagaagacaaaacccgaacaaaagagaaaaggcaccaaagaataaaacttttttgttaatggagatttgaggaagacgaagaagagattgaaacattgagaataatggtggagggttggcgaaatgggtttcgcgatgctacgaattcgaaacctctcttcgtgacgatctacgcgactgtgatcattggcgttctcgtctcttccttctatgtattctccgccatttactctcccaccaatggctcctcctcctttctctcttttcctcctctttccacttctggccgaattcatagtctcccacaagaaaatgcaaccttagagttaccagttgctccaccaccaccaccacaagcactgccaccgccagttctggaggaggctcaaggcaattccttgggtaaaatttgggtgtctcctcctagagataagaagatgccaccgcttgagacctttaaactgaccaaagaattgtttggggaaagagtgaaggacaatgttattatagtgacctttgggaactatgcttttatggatttcattttgacttgggttaaacacttgactgatttagatctctccaatattcttgttggtgcgatggatacaaagttattagaggctttgtactggaaaggcgttccagtttttgacatgggaagccatatgagcacagtggatgtcgggtggggttctccaacattccacaaaatgggaagagaaaaagttattctcatagattctgtcttgccttttggttacgagctacttatgtgtgacactgacatggtgtggcttaagaaccctatgccttatttggctcgattcccagatgctgatgttttgacttcaagcgatcaagttgtgcctaccgtcatagatgacagtttggacatatggcaacaagttggtgctgcctacaacataggaatttttcattggcggccgacagaatctgcgaaaaagttggcaaaagaatggaaagaaattctcttagctgacgataaggtttgggatcaaaatgggttcaatgagattgttaggagacagctaggtccatctgtggaaggggatagtggacttttctatgcttatgatggaaatctcaaggttggaattttgccagctagcatattttgcagtggtcatacttattttgttcaggctatgtatcaacaactcaggctagaaccatatgccgtgcatacaacattccagtatgcaggtaccgaaggaaaacgccacaggcttcgagaggggatggttttctatgacccaccagaatattatgattcaccaggaggtttcattgcgtttaaaccatcgattccaaaaagcttgttacttgacgggaagcataccattgaatcgcattttatcctcgttaatcaccaaatgaaacagatcagatcagctctagccattgcatctcttcttaatcgtacactggtgatgccaccaatatggtgcaggttagataggctttggtttgggcatcctggtactcttcagggatctatgacccgacaacctttcatctgcccacttgatcatgtctttgaggtcaatatcatgcttaaggagctaccagaggaagagtttggccctgggattggtatcagagagtattcttttctagataacccattgctgccaaaacaagtgaaagagtcatggcttgatgttcagctttgtcaagaaggaaaagaaggatgcgaggcatcaaataacactagcccctctcgggttcttaagttcccaaagcggagcaatgaagatacgtttaaggcgatattctcttccttcgacgatgtcaaagtgatcaagttttcttcaattgaagatgctttcatcggattctctgacaaggagcgagaagaaagatttagaagacgggtaaagagatatgtgggaatatggtgttgtgaggagaacaagactccaggacacatttactacgatatgtattgggacgagaaacctggttggaaaccggttccaccacagacaccagaagaagatcatcctcctctctgataacattactggcaagaagactccaagaagcttacactcgatttcttgggtcacaaggagacagacttagggagttttttttttccttctatacggcctttttatactactgtggaactgtatctttcttttctctgtctcactcaatgtatcatgttataaccataggtttggacacagaaacttgtttcttcttttcatataatttctctgtagatttttatattaataaatggcttatttagttgtttc

SEQ ID NO: 1936 - protein, 2328 aa, Arabidopsis thaliana
ACCAAACGATCAAATCGATCGGACAAAGAGGAAGAAGAAGAAGACAAAACCCGAACAAAAGAGAAAAGGCACCAAAGAATAAAACTTTTTTGTTAATGGAGATTTGAGGAAGACGAAGAAGAGATTGAAACATTGAGAATAATGGTGGAGGGTTGGCGAAATGGGTTTCGCGATGCTACGAATTCGAAACCTCTCTTCGTGACGATCTACGCGACTGTGATCATTGGCGTTCTCGTCTCTTCCTTCTATGTATTCTCCGCCATTTACTCTCCCACCAATGGCTCCTCCTCCTTTCTCTCTTTTCCTCCTCTTTCCACTTCTGGCCGAATTCATAGTCTCCCACAAGAAAATGCAACCTTAGAGTTACCAGTTGCTCCACCACCACCACCACAAGCACTGCCACCGCCAGTTCTGGAGGAGGCTCAAGGCAATTCCTTGGGTAAAATTTGGGTGTCTCCTCCTAGAGATAAGAAGATGCCACCGCTTGAGACCTTTAAACTGACCAAAGAATTGTTTGGGGAAAGAGTGAAGGACAATGTTATTATAGTGACCTTTGGGAACTATGCTTTTATGGATTTCATTTTGACTTGGGTTAAACACTTGACTGATTTAGATCTCTCCAATATTCTTGTTGGTGCGATGGATACAAAGTTATTAGAGGCTTTGTACTGGAAAGGCGTTCCAGTTTTTGACATGGGAAGCCATATGAGCACAGTGGATGTCGGGTGGGGTTCTCCAACATTCCACAAAATGGGAAGAGAAAAAGTTATTCTCATAGATTCTGTCTTGCCTTTTGGTTACGAGCTACTTATGTGTGACACTGACATGGTGTGGCTTAAGAACCCTATGCCTTATTTGGCTCGATTCCCAGATGCTGATGTTTTGACTTCAAGCGATCAAGTTGTGCCTACCGTCATAGATGACAGTTTGGACATATGGCAACAAGTTGGTGCTGCCTACAACATAGGAATTTTTCATTGGCGGCCGACAGAATCTGCGAAAAAGTTGGCAAAAGAATGGAAAGAAATTCTCTTAGCTGACGATAAGGTTTGGGATCAAAATGGGTTCAATGAGATTGTTAGGAGACAGCTAGGTCCATCTGTGGAAGGGGATAGTGGACTTTTCTATGCTTATGATGGAAATCTCAAGGTTGGAATTTTGCCAGCTAGCATATTTTGCAGTGGTCATACTTATTTTGTTCAGGCTATGTATCAACAACTCAGGCTAGAACCATATGCCGTGCATACAACATTCCAGTATGCAGGTACCGAAGGAAAACGCCACAGGCTTCGAGAGGGGATGGTTTTCTATGACCCACCAGAATATTATGATTCACCAGGAGGTTTCATTGCGTTTAAACCATCGATTCCAAAAAGCTTGTTACTTGACGGGAAGCATACCATTGAATCGCATTTTATCCTCGTTAATCACCAAATGAAACAGATCAGATCAGCTCTAGCCATTGCATCTCTTCTTAATCGTACACTGGTGATGCCACCAATATGGTGCAGGTTAGATAGGCTTTGGTTTGGGCATCCTGGTACTCTTCAGGGATCTATGACCCGACAACCTTTCATCTGCCCACTTGATCATGTCTTTGAGGTCAATATCATGCTTAAGGAGCTACCAGAGGAAGAGTTTGGCCCTGGGATTGGTATCAGAGAGTATTCTTTTCTAGATAACCCATTGCTGCCAAAACAAGTGAAAGAGTCATGGCTTGATGTTCAGCTTTGTCAAGAAGGAAAAGAAGGATGCGAGGCATCAAATAACACTAGCCCCTCTCGGGTTCTTAAGTTCCCAAAGCGGAGCAATGAAGATACGTTTAAGGCGATATTCTCTTCCTTCGACGATGTCAAAGTGATCAAGTTTTCTTCAATTGAAGATGCTTTCATCGGATTCTCTGACAAGGAGCGAGAAGAAAGATTTAGAAGACGGGTAAAGAGATATGTGGGAATATGGTGTTGTGAGGAGAACAAGACTCCAGGACACATTTACTACGATATGTATTGGGACGAGAAACCTGGTTGGAAACCGGTTCCACCACAGACACCAGAAGAAGATCATCCTCCTCTCTGATAACATTACTGGCAAGAAGACTCCAAGAAGCTTACACTCGATTTCTTGGGTCACAAGGAGACAGACTTAGGGAGTTTTTTTTTTCCTTCTATACGGCCTTTTTATACTACTGTGGAACTGTATCTTTCTTTTCTCTGTCTCACTCAATGTATCATGTTATAACCATAGGTTTGGACACAGAAACTTGTTTCTTCTTTTCATATAATTTCTCTGTAGATTTTTATATTAATAAATGGCTTATTTAGTTGTTTC

SEQ ID NO: 1937 - DNA, 879 bp, Arabidopsis thaliana
  misc_feature (1)..(879): Ceres cDNA ID no. 12720323
  misc_feature (1)..(879): Also known as  Ceres CDNA ID no. 23659432
atggtgatgatgatgatcaagaaccatgtaagatctataagcttacaatcaagatctcatcctagcacagcagcgatcgaggagtcgctcgacaaatttcttatcactatgaacacgtcgacaatggcgtcgtctgagtcggttcactccggtttatcggggttggaggatctgtacgactgttcggaagatcttctgaagatgggttcgacgcaaagggtgttgtcgtttagtgatgagaagaagaagaagaagaggaaagtgaagggagagtttatggaggaaatgcttgatggttcgttgaggctaatggatatatgcaacgtctcgagggatctcatggttgagactcatgagcatgttcttggtcttcagtcttgtgttaggagaaggaaagatgtcgacgtctcgggatatgtcgggtttaggaaaaacatgaggaaagaagtgaagaagcttcttggatctttaaagaacattaatgtagggttagtgatgagagatcatggttatgatcaagacggtgatattcatttcttggccgtgattcatgcaatgagacgtgtcgtttatatgacagtttcggtcttaaagtctttctttgagttcttgtcgggacgacaaaacgggaacgacgtaaggagcaagttggctttagttctcatgaacaagaagtttcatgatcacgataagatggtcaaaaacgagttggagaatgtagattccgcgatttgtggagattctatctctcatgatgatcttcatgagaagcttgaggaagttgaggtatggattggaaaattcgagaagagtcttgaaggattgtttcgagggttgattaaaacacgagcctcgcttctcaacataatctctcaatag

SEQ ID NO: 1938 - protein, 879 aa, Arabidopsis thaliana
ATGGTGATGATGATGATCAAGAACCATGTAAGATCTATAAGCTTACAATCAAGATCTCATCCTAGCACAGCAGCGATCGAGGAGTCGCTCGACAAATTTCTTATCACTATGAACACGTCGACAATGGCGTCGTCTGAGTCGGTTCACTCCGGTTTATCGGGGTTGGAGGATCTGTACGACTGTTCGGAAGATCTTCTGAAGATGGGTTCGACGCAAAGGGTGTTGTCGTTTAGTGATGAGAAGAAGAAGAAGAAGAGGAAAGTGAAGGGAGAGTTTATGGAGGAAATGCTTGATGGTTCGTTGAGGCTAATGGATATATGCAACGTCTCGAGGGATCTCATGGTTGAGACTCATGAGCATGTTCTTGGTCTTCAGTCTTGTGTTAGGAGAAGGAAAGATGTCGACGTCTCGGGATATGTCGGGTTTAGGAAAAACATGAGGAAAGAAGTGAAGAAGCTTCTTGGATCTTTAAAGAACATTAATGTAGGGTTAGTGATGAGAGATCATGGTTATGATCAAGACGGTGATATTCATTTCTTGGCCGTGATTCATGCAATGAGACGTGTCGTTTATATGACAGTTTCGGTCTTAAAGTCTTTCTTTGAGTTCTTGTCGGGACGACAAAACGGGAACGACGTAAGGAGCAAGTTGGCTTTAGTTCTCATGAACAAGAAGTTTCATGATCACGATAAGATGGTCAAAAACGAGTTGGAGAATGTAGATTCCGCGATTTGTGGAGATTCTATCTCTCATGATGATCTTCATGAGAAGCTTGAGGAAGTTGAGGTATGGATTGGAAAATTCGAGAAGAGTCTTGAAGGATTGTTTCGAGGGTTGATTAAAACACGAGCCTCGCTTCTCAACATAATCTCTCAATAG

SEQ ID NO: 1939 - DNA, 1344 bp, Arabidopsis thaliana
  misc_feature (1)..(1344): Ceres cDNA ID no. 12720522
  misc_feature (1)..(1344): Also known as  Ceres CDNA ID no. 23659432
atgggccaaacgtttcacgcctttatgttcccatggttcgcttttggtcatatgactccatacttgcatttagccaacaagttagctgagagaggtcacagaatcactttcttgatccccaagaaagctcagaagcagcttgaacatctcaatctgtttccagacagcatcgtctttcactctcttactattcctcatgttgatggtctccccgctggagccgagactttctcggatatccctatgccattgtggaagttcttgcccccagctatagatctcacacgcgatcaagttgaagcagcggttagtgccttgagtccggacctgatcttgttcgatattgcttcatgggttccagaagtggctaaagagtatagagtcaagagtatgttgtacaacatcatatcagctacttctatagctcatgactttgtcccaggtggtgaacttggagttcctccacctggttatccttcctcaaagttgttgtaccgcaaacacgatgctcacgccttgttgtccttctccgtctactacaagaggttttctcatcggctcatcacaggtcttatgaattgtgatttcatttcgataaggacatgcaaagaaatcgagggtaaattctgcgagtatcttgagcgtcaataccataaaaaggttttcttgacgggtccaatgcttcctgagccaaacaaaggtaaaccactggaagatcgatggagtcattggctgaacgggtttgaacaaggctctgtagtgttctgtgcattgggaagtcaagtcactctagagaaggaccagttccaagaactttgtttaggaatagagcttacaggtttaccgttttttgtagctgtaacaccaccaaaaggcgcaaagacgattcaagatgcgttaccagaagggttcgaggagagggtgaaagatcgtggagtggttttgggagaatgggtgcaacaaccgttattattggctcatccatcagtaggctgcttcttgagtcattgcggattcgggtcaatgtgggaatctataatgagtgattgccaaatagttttgcttccatttttggctgatcaagttctcaacacaagattgatgaccgaagaactcaaggtttcggttgaagtgcaaagagaagaaacaggatggttctcgaaggagagcttgagtgttgctatcacatctgtgatggaccaagctagtgagatcgggaatctggtgagaaggaaccattccaaattgaaggaggttttggttagtgatggattattaaccggttacaccgataaatttgttgacactttggagaatcttgtcagcgagacaaagcgtgaatga

SEQ ID NO: 1940 - protein, 1344 aa, Arabidopsis thaliana
ATGGGCCAAACGTTTCACGCCTTTATGTTCCCATGGTTCGCTTTTGGTCATATGACTCCATACTTGCATTTAGCCAACAAGTTAGCTGAGAGAGGTCACAGAATCACTTTCTTGATCCCCAAGAAAGCTCAGAAGCAGCTTGAACATCTCAATCTGTTTCCAGACAGCATCGTCTTTCACTCTCTTACTATTCCTCATGTTGATGGTCTCCCCGCTGGAGCCGAGACTTTCTCGGATATCCCTATGCCATTGTGGAAGTTCTTGCCCCCAGCTATAGATCTCACACGCGATCAAGTTGAAGCAGCGGTTAGTGCCTTGAGTCCGGACCTGATCTTGTTCGATATTGCTTCATGGGTTCCAGAAGTGGCTAAAGAGTATAGAGTCAAGAGTATGTTGTACAACATCATATCAGCTACTTCTATAGCTCATGACTTTGTCCCAGGTGGTGAACTTGGAGTTCCTCCACCTGGTTATCCTTCCTCAAAGTTGTTGTACCGCAAACACGATGCTCACGCCTTGTTGTCCTTCTCCGTCTACTACAAGAGGTTTTCTCATCGGCTCATCACAGGTCTTATGAATTGTGATTTCATTTCGATAAGGACATGCAAAGAAATCGAGGGTAAATTCTGCGAGTATCTTGAGCGTCAATACCATAAAAAGGTTTTCTTGACGGGTCCAATGCTTCCTGAGCCAAACAAAGGTAAACCACTGGAAGATCGATGGAGTCATTGGCTGAACGGGTTTGAACAAGGCTCTGTAGTGTTCTGTGCATTGGGAAGTCAAGTCACTCTAGAGAAGGACCAGTTCCAAGAACTTTGTTTAGGAATAGAGCTTACAGGTTTACCGTTTTTTGTAGCTGTAACACCACCAAAAGGCGCAAAGACGATTCAAGATGCGTTACCAGAAGGGTTCGAGGAGAGGGTGAAAGATCGTGGAGTGGTTTTGGGAGAATGGGTGCAACAACCGTTATTATTGGCTCATCCATCAGTAGGCTGCTTCTTGAGTCATTGCGGATTCGGGTCAATGTGGGAATCTATAATGAGTGATTGCCAAATAGTTTTGCTTCCATTTTTGGCTGATCAAGTTCTCAACACAAGATTGATGACCGAAGAACTCAAGGTTTCGGTTGAAGTGCAAAGAGAAGAAACAGGATGGTTCTCGAAGGAGAGCTTGAGTGTTGCTATCACATCTGTGATGGACCAAGCTAGTGAGATCGGGAATCTGGTGAGAAGGAACCATTCCAAATTGAAGGAGGTTTTGGTTAGTGATGGATTATTAACCGGTTACACCGATAAATTTGTTGACACTTTGGAGAATCTTGTCAGCGAGACAAAGCGTGAATGA

SEQ ID NO: 1941 - DNA, 893 bp, Arabidopsis thaliana
  misc_feature (1)..(893): Ceres cDNA ID no. 12721506
  misc_feature (1)..(893): Also known as  Ceres CDNA ID no. 23659432
cataaacacaaaatccggtttttaataatggcgaaaatctccagtattcacattctcttcttcgtcttcatcacaagtggcattgctgattccgccaccgtattcactttacaaaacagttgtgcgtacaccgtttggccgggaactctctccggcaacagcatcaccctcggcgacggcggatttcccttaactccaggcgcttccgtgcagctcacggctcctaccggttggtcaggccggttctgggctcgtaccggctgcaactttgacgcctccggtcacggtacctgcgtcaccggagactgcggcggcgttttaaaatgtaccggcggcggagttcctccagcgactctagcggaattcaccgtgggatcaagcaatgccggcatggatttctacgacgtgagcctcgtcgacggttacaatgtaaagatggggataaaaccacagggaggattcggaaattgcaaatacgcaggctgcgtctcggacatcaacgagatttgccctagcgagcttaggatcatggatccgaattcgggaagtgtcgcggcgtgtaagagcgcttgcgcggcgtttagttcgccggaattttgctgtactggtgctcacgcgacgccgcaaacttgttctccgacgtattactcgtccatgtttaagaacgcttgtcctagcgcttatagttacgcttacgacgacgcatcgagcactttcacttgtaccggatctaactacttgatcactttctgccctacccagtcttaaaaccggagctccggtttagatttgggttgggtttctctctctcacgtttcttttgcttgttatgtacggaaagagaaataaagaaagatatgataaggaaaagcgactatgatccatttttaaag

SEQ ID NO: 1942 - protein, 893 aa, Arabidopsis thaliana
CATAAACACAAAATCCGGTTTTTAATAATGGCGAAAATCTCCAGTATTCACATTCTCTTCTTCGTCTTCATCACAAGTGGCATTGCTGATTCCGCCACCGTATTCACTTTACAAAACAGTTGTGCGTACACCGTTTGGCCGGGAACTCTCTCCGGCAACAGCATCACCCTCGGCGACGGCGGATTTCCCTTAACTCCAGGCGCTTCCGTGCAGCTCACGGCTCCTACCGGTTGGTCAGGCCGGTTCTGGGCTCGTACCGGCTGCAACTTTGACGCCTCCGGTCACGGTACCTGCGTCACCGGAGACTGCGGCGGCGTTTTAAAATGTACCGGCGGCGGAGTTCCTCCAGCGACTCTAGCGGAATTCACCGTGGGATCAAGCAATGCCGGCATGGATTTCTACGACGTGAGCCTCGTCGACGGTTACAATGTAAAGATGGGGATAAAACCACAGGGAGGATTCGGAAATTGCAAATACGCAGGCTGCGTCTCGGACATCAACGAGATTTGCCCTAGCGAGCTTAGGATCATGGATCCGAATTCGGGAAGTGTCGCGGCGTGTAAGAGCGCTTGCGCGGCGTTTAGTTCGCCGGAATTTTGCTGTACTGGTGCTCACGCGACGCCGCAAACTTGTTCTCCGACGTATTACTCGTCCATGTTTAAGAACGCTTGTCCTAGCGCTTATAGTTACGCTTACGACGACGCATCGAGCACTTTCACTTGTACCGGATCTAACTACTTGATCACTTTCTGCCCTACCCAGTCTTAAAACCGGAGCTCCGGTTTAGATTTGGGTTGGGTTTCTCTCTCTCACGTTTCTTTTGCTTGTTATGTACGGAAAGAGAAATAAAGAAAGATATGATAAGGAAAAGCGACTATGATCCATTTTTAAAG

SEQ ID NO: 1943 - DNA, 1767 bp, Arabidopsis thaliana
  misc_feature (1)..(1767): Ceres cDNA ID no. 12722327
  misc_feature (1)..(1767): Also known as  Ceres CDNA ID no. 23659432
atggctctgaattcttcagctttcttcgttccatgtcacaattacaatcaaatctgtgatcttcttctttcttcagctcgaaccagatcaactattaaaggacttcagcttcatggctatgtcgttaaatcaggcctttctcttatccctctcgtcgctaacaacctcattaatttctactccaaatcacagcttccgtttgattctcgtcgagcttttgaagatagcccacaaaaaagttcgacgacttggagttcaatcatctcttgttttgcccagaacgagcttccatggatgtcactcgagtttcttaaaaaaatgatggcgggaaaccttagacctgatgatcatgttcttccatcagctacaaagtcgtgtgcgattttgagtcgttgtgatattggtagatcagttcattgtctatcgatgaagactgggtatgatgctgatgtgtttgtggggagttctttggttgatatgtatgcgaaatgtggagaaattgtttatgcgaggaagatgttcgacgaaatgcctcagagaaatgttgttacttggagtgggatgatgtatgggtatgcacaaatgggtgaaaatgaggaagctttgtggttgtttaaagaagctttgtttgagaatctcgctgttaatgattactcgttttcgagtgttattagtgtttgtgcaaattcgactctacttgagttaggtagacagattcatggattgagtattaagtctagctttgattcttctagctttgtgggaagttctttagtctcgttgtattcaaagtgtggtgttcctgaaggagcttatcaagtttttaacgaggtgcctgtgaagaatctcgggatttggaacgctatgctcaaggcgtatgcgcaacattcacatactcaaaaggttattgaattgttcaaaaggatgaagctttctggaatgaaaccaaatttcataacttttttgaatgtgctcaatgcttgtagtcacgcgggtctagttgatgaagggagatactactttgatcagatgaaagaatcgaggattgagccgacggataagcattacgcttccttggtggatatgttaggacgagctggtagattacaagaagcacttgaagttatcactaatatgccgattgatcccacggaatctgtatggggagctttattaacgagttgtacagtccacaagaacacagagcttgcagcatttgcagcagacaaggtcttcgaattaggaccagtgagttccggtatgcacatttcgttatccaatgcttatgcagccgatggtagattcgaagacgcagctaaagctagaaaattgcttcgagaccgaggggaaaagaaggaaacagggctaagttgggttgaagaaaggaacaaggttcatacatttgcagctggagaaagacgtcatgagaaaagcaaggagatatatgagaagctggctgagttaggggaagagatggagaaagcgggttacattgcagacacaagctatgttctgagagaagtggatggtgacgagaagaatcaaaccataaggtatcatagtgagagattagctattgcttttggactgatcacgtttccagctgatagaccgatccgagtaatgaagaatctgcgtgtttgcggtgattgccataacgcgatcaagttcatgtccgtatgtacgagacgagtgatcattgtgagagataataatcggtttcatcggtttgaagatggcaagtgttcttgtaatgactattggtga

SEQ ID NO: 1944 - protein, 1767 aa, Arabidopsis thaliana
ATGGCTCTGAATTCTTCAGCTTTCTTCGTTCCATGTCACAATTACAATCAAATCTGTGATCTTCTTCTTTCTTCAGCTCGAACCAGATCAACTATTAAAGGACTTCAGCTTCATGGCTATGTCGTTAAATCAGGCCTTTCTCTTATCCCTCTCGTCGCTAACAACCTCATTAATTTCTACTCCAAATCACAGCTTCCGTTTGATTCTCGTCGAGCTTTTGAAGATAGCCCACAAAAAAGTTCGACGACTTGGAGTTCAATCATCTCTTGTTTTGCCCAGAACGAGCTTCCATGGATGTCACTCGAGTTTCTTAAAAAAATGATGGCGGGAAACCTTAGACCTGATGATCATGTTCTTCCATCAGCTACAAAGTCGTGTGCGATTTTGAGTCGTTGTGATATTGGTAGATCAGTTCATTGTCTATCGATGAAGACTGGGTATGATGCTGATGTGTTTGTGGGGAGTTCTTTGGTTGATATGTATGCGAAATGTGGAGAAATTGTTTATGCGAGGAAGATGTTCGACGAAATGCCTCAGAGAAATGTTGTTACTTGGAGTGGGATGATGTATGGGTATGCACAAATGGGTGAAAATGAGGAAGCTTTGTGGTTGTTTAAAGAAGCTTTGTTTGAGAATCTCGCTGTTAATGATTACTCGTTTTCGAGTGTTATTAGTGTTTGTGCAAATTCGACTCTACTTGAGTTAGGTAGACAGATTCATGGATTGAGTATTAAGTCTAGCTTTGATTCTTCTAGCTTTGTGGGAAGTTCTTTAGTCTCGTTGTATTCAAAGTGTGGTGTTCCTGAAGGAGCTTATCAAGTTTTTAACGAGGTGCCTGTGAAGAATCTCGGGATTTGGAACGCTATGCTCAAGGCGTATGCGCAACATTCACATACTCAAAAGGTTATTGAATTGTTCAAAAGGATGAAGCTTTCTGGAATGAAACCAAATTTCATAACTTTTTTGAATGTGCTCAATGCTTGTAGTCACGCGGGTCTAGTTGATGAAGGGAGATACTACTTTGATCAGATGAAAGAATCGAGGATTGAGCCGACGGATAAGCATTACGCTTCCTTGGTGGATATGTTAGGACGAGCTGGTAGATTACAAGAAGCACTTGAAGTTATCACTAATATGCCGATTGATCCCACGGAATCTGTATGGGGAGCTTTATTAACGAGTTGTACAGTCCACAAGAACACAGAGCTTGCAGCATTTGCAGCAGACAAGGTCTTCGAATTAGGACCAGTGAGTTCCGGTATGCACATTTCGTTATCCAATGCTTATGCAGCCGATGGTAGATTCGAAGACGCAGCTAAAGCTAGAAAATTGCTTCGAGACCGAGGGGAAAAGAAGGAAACAGGGCTAAGTTGGGTTGAAGAAAGGAACAAGGTTCATACATTTGCAGCTGGAGAAAGACGTCATGAGAAAAGCAAGGAGATATATGAGAAGCTGGCTGAGTTAGGGGAAGAGATGGAGAAAGCGGGTTACATTGCAGACACAAGCTATGTTCTGAGAGAAGTGGATGGTGACGAGAAGAATCAAACCATAAGGTATCATAGTGAGAGATTAGCTATTGCTTTTGGACTGATCACGTTTCCAGCTGATAGACCGATCCGAGTAATGAAGAATCTGCGTGTTTGCGGTGATTGCCATAACGCGATCAAGTTCATGTCCGTATGTACGAGACGAGTGATCATTGTGAGAGATAATAATCGGTTTCATCGGTTTGAAGATGGCAAGTGTTCTTGTAATGACTATTGGTGA

SEQ ID NO: 1945 - DNA, 1357 bp, Arabidopsis thaliana
  misc_feature (1)..(1357): Ceres cDNA ID no. 12722652
  misc_feature (1)..(1357): Also known as  Ceres CDNA ID no. 23659432
cattattacaccaccgttggcctccgacgacggctcaagcctatcttcgtcgccggcttctccgatggttaccaatcgcgtagacgtcttctggcacgaaggaatgctccgacacgacgccgtagaaggcgtcttcgacactggatacgaccctggattcctcgacgtattggagaagcacccggagaacgccgatcgcgtcaggaacatgctttcgattctccgacgcggtcccatcgctcctcatgtcaattggtttaccggtcttccagcaatcgtttcggagcttctaatgtttcacacttcagagtacattgagaagctagtggaggcagataaatcaggagaaaggtgtgaaattgccgcaggtactttcatgagcccaggctcgtgggaagctgctcttcttgcagctggaacaactctttcagcaatgcaacatattcttgattgccatgggaaaattgcatatgctctggtacgcccaccaggtcaccactcacagcctactcaggctgatgggtattgcttcctcaacaacgctgctcttgctgtcaagctggcattgaattcgggttcttgttcccgagttgcggttattgacatcgatgtacattatggaaatggcacagctgaagggttttatacatctgataaggttcttacggtgtcactccatatgaaccatggatcatggggatcgtcccacccgcagaaagggtcgattgatgaacttggtgaagacgtgggattgggttacaatctgaatgtccctttaccgaatggcacgggtgaccggggatatgaatatgccatgaatgagctggtggttcctgcagttagaaggtttggacccgatatggttgttctcgttgttggtcaagactctagcgcttttgatccaaacgggagacaaagcctgacaatgaatggatacagaaggattgggcagataatgaggggagttgcagaggagcacagccatggaaggttgcttatggtgcaagaaggcgggtatcatgtaacatatgcagcttactgcctccacgccatgctcgaaggggtgctgaagattccagaaccgcatctatctgatccgatcgcttattatcccgaagaagaagctaatgctgttgctgctgtggagtcaatcaaaacatatcacaccgaatttgttccatttctcagaggaacttgaaaatgggacgtatgaatgagtttatgttattcctcgttgtcttgtgaccttttggaacacagatccaaatcaatcaggtcaaaccgtatatatcaaaatacttgttgatcaaactatcttttgtatgaaaacttattcacacgatccgactttgttttt

SEQ ID NO: 1946 - protein, 1357 aa, Arabidopsis thaliana
CATTATTACACCACCGTTGGCCTCCGACGACGGCTCAAGCCTATCTTCGTCGCCGGCTTCTCCGATGGTTACCAATCGCGTAGACGTCTTCTGGCACGAAGGAATGCTCCGACACGACGCCGTAGAAGGCGTCTTCGACACTGGATACGACCCTGGATTCCTCGACGTATTGGAGAAGCACCCGGAGAACGCCGATCGCGTCAGGAACATGCTTTCGATTCTCCGACGCGGTCCCATCGCTCCTCATGTCAATTGGTTTACCGGTCTTCCAGCAATCGTTTCGGAGCTTCTAATGTTTCACACTTCAGAGTACATTGAGAAGCTAGTGGAGGCAGATAAATCAGGAGAAAGGTGTGAAATTGCCGCAGGTACTTTCATGAGCCCAGGCTCGTGGGAAGCTGCTCTTCTTGCAGCTGGAACAACTCTTTCAGCAATGCAACATATTCTTGATTGCCATGGGAAAATTGCATATGCTCTGGTACGCCCACCAGGTCACCACTCACAGCCTACTCAGGCTGATGGGTATTGCTTCCTCAACAACGCTGCTCTTGCTGTCAAGCTGGCATTGAATTCGGGTTCTTGTTCCCGAGTTGCGGTTATTGACATCGATGTACATTATGGAAATGGCACAGCTGAAGGGTTTTATACATCTGATAAGGTTCTTACGGTGTCACTCCATATGAACCATGGATCATGGGGATCGTCCCACCCGCAGAAAGGGTCGATTGATGAACTTGGTGAAGACGTGGGATTGGGTTACAATCTGAATGTCCCTTTACCGAATGGCACGGGTGACCGGGGATATGAATATGCCATGAATGAGCTGGTGGTTCCTGCAGTTAGAAGGTTTGGACCCGATATGGTTGTTCTCGTTGTTGGTCAAGACTCTAGCGCTTTTGATCCAAACGGGAGACAAAGCCTGACAATGAATGGATACAGAAGGATTGGGCAGATAATGAGGGGAGTTGCAGAGGAGCACAGCCATGGAAGGTTGCTTATGGTGCAAGAAGGCGGGTATCATGTAACATATGCAGCTTACTGCCTCCACGCCATGCTCGAAGGGGTGCTGAAGATTCCAGAACCGCATCTATCTGATCCGATCGCTTATTATCCCGAAGAAGAAGCTAATGCTGTTGCTGCTGTGGAGTCAATCAAAACATATCACACCGAATTTGTTCCATTTCTCAGAGGAACTTGAAAATGGGACGTATGAATGAGTTTATGTTATTCCTCGTTGTCTTGTGACCTTTTGGAACACAGATCCAAATCAATCAGGTCAAACCGTATATATCAAAATACTTGTTGATCAAACTATCTTTTGTATGAAAACTTATTCACACGATCCGACTTTGTTTTT

SEQ ID NO: 1947 - DNA, 1050 bp, Arabidopsis thaliana
  misc_feature (1)..(1050): Ceres cDNA ID no. 12723494
  misc_feature (1)..(1050): Also known as  Ceres CDNA ID no. 23659432
atggagaaaccaaagttgaagacagtccaagaggtggtcgcagctggcgaaaaactaccggaaagatacctctacacacccaccggcgacggcgaaggtgatcaacctttcaatggtttgttgccagagatgaaaatttcgatcatcgatcttaatctccttttctcttcttctgacgacggtcgagaagagttgagtaaacttcactcggcgatctctacatggggcgttgttcaggtgatgaatcatggaatttcagaagccttgctcgacaagattcacgagctaacgaagcagttctttgtacttccgaccaaagagaaacagaagtacgcaagagagataagtagttttcaaggatttggaaacgacatgattctgtctgatgatcaagttctcgattgggtcgaccgcttgtacctcattacgtaccctgaagatcaacgacagcttaaattctggcctgaaaatccaagcggatttagggaaactttacatgaatacacaatgaagcaacagttagtggttgagaaattcttcaaggcattagctagatcgttggagttggaagataattgctttctagagatgcatggtgaaaatgctacgttggagacaagattcaacatctaccctccatgtccgaggccggacaaggttcttgggctaaaaccgcattctgatggctcagcctttactcttatcctacccgacaaaaatgtagaaggacttcagttcctcaaagatgggaagtggtataaagcttcaattctccctcatacaattctgatcaatgtaggagatactatggaggtaatgagcaatggaatatacaagagtccggttcatagagtggtgcttaacggaaaaaaggaaaggatatatgtggcaacattttgtaatgctgatgaagacaaagagattcaacctttaaatgggcttgtgtctgaggctagaccaaggttgtacaaagcagttaagaagtctgagaaaaacttcttcgattactatcaacaaggtcgaagaccgatcgaagctgcaatgatctga

SEQ ID NO: 1948 - protein, 1050 aa, Arabidopsis thaliana
ATGGAGAAACCAAAGTTGAAGACAGTCCAAGAGGTGGTCGCAGCTGGCGAAAAACTACCGGAAAGATACCTCTACACACCCACCGGCGACGGCGAAGGTGATCAACCTTTCAATGGTTTGTTGCCAGAGATGAAAATTTCGATCATCGATCTTAATCTCCTTTTCTCTTCTTCTGACGACGGTCGAGAAGAGTTGAGTAAACTTCACTCGGCGATCTCTACATGGGGCGTTGTTCAGGTGATGAATCATGGAATTTCAGAAGCCTTGCTCGACAAGATTCACGAGCTAACGAAGCAGTTCTTTGTACTTCCGACCAAAGAGAAACAGAAGTACGCAAGAGAGATAAGTAGTTTTCAAGGATTTGGAAACGACATGATTCTGTCTGATGATCAAGTTCTCGATTGGGTCGACCGCTTGTACCTCATTACGTACCCTGAAGATCAACGACAGCTTAAATTCTGGCCTGAAAATCCAAGCGGATTTAGGGAAACTTTACATGAATACACAATGAAGCAACAGTTAGTGGTTGAGAAATTCTTCAAGGCATTAGCTAGATCGTTGGAGTTGGAAGATAATTGCTTTCTAGAGATGCATGGTGAAAATGCTACGTTGGAGACAAGATTCAACATCTACCCTCCATGTCCGAGGCCGGACAAGGTTCTTGGGCTAAAACCGCATTCTGATGGCTCAGCCTTTACTCTTATCCTACCCGACAAAAATGTAGAAGGACTTCAGTTCCTCAAAGATGGGAAGTGGTATAAAGCTTCAATTCTCCCTCATACAATTCTGATCAATGTAGGAGATACTATGGAGGTAATGAGCAATGGAATATACAAGAGTCCGGTTCATAGAGTGGTGCTTAACGGAAAAAAGGAAAGGATATATGTGGCAACATTTTGTAATGCTGATGAAGACAAAGAGATTCAACCTTTAAATGGGCTTGTGTCTGAGGCTAGACCAAGGTTGTACAAAGCAGTTAAGAAGTCTGAGAAAAACTTCTTCGATTACTATCAACAAGGTCGAAGACCGATCGAAGCTGCAATGATCTGA

SEQ ID NO: 1949 - DNA, 1059 bp, Arabidopsis thaliana
  misc_feature (1)..(1059): Ceres cDNA ID no. 12723619
  misc_feature (1)..(1059): Also known as  Ceres CDNA ID no. 23659432
gaatgatttcaattctctatcttattgacacataaacatggaccggtccactttcatcttatctctactcttcacactcactgtctcgactacgaccctcttctctccggttttcgcaggaacgttcgacacagaattcgatatcacttggggtgatggtcgtggcaaggttcttaacaacggagagcttctcactctctccctcgacagagcctccggctctggttttcaaaccaagaaagagtatttgttcgggaaaatcgacatgcagctcaaactcgtccctggaaactccgccggaaccgtcactgcctactacttgaagtcaaaaggtgatacgtgggacgaaatcgatttcgagtttcttggtaatctaactggtgatccgtataccatgcatacgaatgtgtatactcaaggcaaaggtgatagagaacaacaatttcatctctggttcgatccaaccgctgatttccacacttactctgttttatggaaccctcatcacatcgttttcatggttgatgatattccggtaagagaattcaagaatctacaacatatgggtatccagtatccaaaattgcagccgatgaggttatactcgagtctatggaacgcggaccagtgggctacaaggggaggtctcgttaagactgactggtccaaggcaccattcaccgcttcttacagaaactttagagcggatgcatgtgtttcctcgggcggaagatcatcttgtcctgccggttcacctagatggttctctcaaaggcttgatctaacagcggaagataagatgagagtggtgcagaggaagtacatgatctataactattgtacggacaccaaaaggtttcctcaaggatttccaaaggagtgtagacactagctacgagaattaatgtgtgatccgaaactccaaagctagtattgtataggttcgtctaaattatatatgtaatgtttatgtttatttaggttctgtaataagcaatttcccctgtttctatgtagatattctcataataaaatgggcgtgagttatgttggttcaat

SEQ ID NO: 1950 - protein, 1059 aa, Arabidopsis thaliana
GAATGATTTCAATTCTCTATCTTATTGACACATAAACATGGACCGGTCCACTTTCATCTTATCTCTACTCTTCACACTCACTGTCTCGACTACGACCCTCTTCTCTCCGGTTTTCGCAGGAACGTTCGACACAGAATTCGATATCACTTGGGGTGATGGTCGTGGCAAGGTTCTTAACAACGGAGAGCTTCTCACTCTCTCCCTCGACAGAGCCTCCGGCTCTGGTTTTCAAACCAAGAAAGAGTATTTGTTCGGGAAAATCGACATGCAGCTCAAACTCGTCCCTGGAAACTCCGCCGGAACCGTCACTGCCTACTACTTGAAGTCAAAAGGTGATACGTGGGACGAAATCGATTTCGAGTTTCTTGGTAATCTAACTGGTGATCCGTATACCATGCATACGAATGTGTATACTCAAGGCAAAGGTGATAGAGAACAACAATTTCATCTCTGGTTCGATCCAACCGCTGATTTCCACACTTACTCTGTTTTATGGAACCCTCATCACATCGTTTTCATGGTTGATGATATTCCGGTAAGAGAATTCAAGAATCTACAACATATGGGTATCCAGTATCCAAAATTGCAGCCGATGAGGTTATACTCGAGTCTATGGAACGCGGACCAGTGGGCTACAAGGGGAGGTCTCGTTAAGACTGACTGGTCCAAGGCACCATTCACCGCTTCTTACAGAAACTTTAGAGCGGATGCATGTGTTTCCTCGGGCGGAAGATCATCTTGTCCTGCCGGTTCACCTAGATGGTTCTCTCAAAGGCTTGATCTAACAGCGGAAGATAAGATGAGAGTGGTGCAGAGGAAGTACATGATCTATAACTATTGTACGGACACCAAAAGGTTTCCTCAAGGATTTCCAAAGGAGTGTAGACACTAGCTACGAGAATTAATGTGTGATCCGAAACTCCAAAGCTAGTATTGTATAGGTTCGTCTAAATTATATATGTAATGTTTATGTTTATTTAGGTTCTGTAATAAGCAATTTCCCCTGTTTCTATGTAGATATTCTCATAATAAAATGGGCGTGAGTTATGTTGGTTCAAT

SEQ ID NO: 1951 - DNA, 963 bp, Arabidopsis thaliana
  misc_feature (1)..(963): Ceres cDNA ID no. 12723825
  misc_feature (1)..(963): Ceres CLONE  ID no. 4324
  misc_feature (1)..(963): Also known as  Ceres CDNA ID no. 23372771
atcaatttttctttattttattcactaataataattttgagtctctcttctctctctcttatatctcaaaatccgagaaaacgaagttcaaagatccgtggttgaattcgtgattctgaaatttcgtttcttcaggtctctgatcgtcctggttctcctctgatctgttatttgcttcgaaatagaagtttgtttctcgtttgacgatggagactgcgactggagaaatcaccatcgtctgcaaccactgtgacagagacattccatcactgaatatcgatctgcatcgtgtacattgtgctcggaatttagaaaaatgtaagatttgtggtgatatggtacccaaaaagcatgctgaggaacactacttgaacacacatgctccgatagcatgctcgatgtgcaaagagaccatagaacgtgagattttcgatagtcataaaggagaaatttgccccaagaggattgtaacatgcgagttctgtgagtttccattgcctgcggttgatcttgccgagcatcaggaagtatgtggcaacaggacagaactctgttatcaatgcaacagctatgttagattgagagaaagatataaccatgaaaccaaatgccctggcactgttgaatcatccagaaggatcccgagagcagcagaaggagatggaaacgggagaagacgaagagatgggaacggtgtttcgaacaaaaggcttttcttcacgatagcaataacgggaatagctgtgataataggatccttgttcttccagaggaagcctgagtagaggaggcgtagcttatctgtaattctgtaaatttgcctcaaatccttcagacagattctaaggaagggtttatacattttaaagcttacccagacaagagaaaccccaaaagattgtttgagctgatcaccatgagacttgcttttatatttgatttcaataaaagagatttcagatt

SEQ ID NO: 1952 - protein, 963 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATCAATTTTTCTTTATTTTATTCACTAATAATAATTTTGAGTCTCTCTTCTCTCTCTCTTATATCTCAAAATCCGAGAAAACGAAGTTCAAAGATCCGTGGTTGAATTCGTGATTCTGAAATTTCGTTTCTTCAGGTCTCTGATCGTCCTGGTTCTCCTCTGATCTGTTATTTGCTTCGAAATAGAAGTTTGTTTCTCGTTTGACGATGGAGACTGCGACTGGAGAAATCACCATCGTCTGCAACCACTGTGACAGAGACATTCCATCACTGAATATCGATCTGCATCGTGTACATTGTGCTCGGAATTTAGAAAAATGTAAGATTTGTGGTGATATGGTACCCAAAAAGCATGCTGAGGAACACTACTTGAACACACATGCTCCGATAGCATGCTCGATGTGCAAAGAGACCATAGAACGTGAGATTTTCGATAGTCATAAAGGAGAAATTTGCCCCAAGAGGATTGTAACATGCGAGTTCTGTGAGTTTCCATTGCCTGCGGTTGATCTTGCCGAGCATCAGGAAGTATGTGGCAACAGGACAGAACTCTGTTATCAATGCAACAGCTATGTTAGATTGAGAGAAAGATATAACCATGAAACCAAATGCCCTGGCACTGTTGAATCATCCAGAAGGATCCCGAGAGCAGCAGAAGGAGATGGAAACGGGAGAAGACGAAGAGATGGGAACGGTGTTTCGAACAAAAGGCTTTTCTTCACGATAGCAATAACGGGAATAGCTGTGATAATAGGATCCTTGTTCTTCCAGAGGAAGCCTGAGTAGAGGAGGCGTAGCTTATCTGTAATTCTGTAAATTTGCCTCAAATCCTTCAGACAGATTCTAAGGAAGGGTTTATACATTTTAAAGCTTACCCAGACAAGAGAAACCCCAAAAGATTGTTTGAGCTGATCACCATGAGACTTGCTTTTATATTTGATTTCAATAAAAGAGATTTCAGATT

SEQ ID NO: 1953 - DNA, 1413 bp, Arabidopsis thaliana
  misc_feature (1)..(1413): Ceres cDNA ID no. 12723970
  misc_feature (1)..(1413): Also known as  Ceres CDNA ID no. 23372771
atgttagatttgcagccgtcagatcggcgtcatggagctccgagtagtagcggcggtgttagtggtggtgatgagctgatcagaacttataaaggctggaaaggcaataacgtgttcttccttggaggaaggctcgtgtttggacctgatgctcgatctattctcatcaccgtcttcttaattacagctcctgtcattgtattctgtatttttgttggcagaaaatttatcgatgattttcctcaccatagaggagtatcagttttagctgttgctgatctagtatttcttcttctaacctccgcgagagacccagggataataccacgtaatctgtatcctcctgaaccagagagtaatgaaggcaatggagaaccacgtcttgctcatactcctcagagtcggttgcctcggacaaaggatatgattgtaaatggaattactgtcaagatcaaatactgtgacacatgcatgctttacagaccgccccgtgcttctcattgttcgatttgcaacaactgcgtcgagaagtttgatcaccactgtccttggcttggtcagtgcattggattgagaaactataggttctacttcatgtttgtgttgtgctcaactcttctctgcatttatgtccatgtgttctgctggatctacgtcaagcggataatggatagtgagaacataaacatctggaaatcgtttctcaagactcctgcttccattgcactaataatctacactttcatttgcgtctggtttgttggtgggcttacctgtttccacttgtacctaatgagtaccaatcagtcaacttacgaaaactttaggtatcggtatgatagacatgagaaccccttcaacaaaggaatagtggggaactttatggaagttttctgcacaaatgttgccgtatctcagaacagtttcagagaaaaggtttcaaaggagccagcaataccaccaaggacagtaaatggagggatgtcaagcccgagcttacagaaagtttccaacgacatagagatggggagaaaaccagtgtggcacgagacagtagaagaagagctcggtgacatcgaaaaggacatggaagcaggggttgcatcacgggatttgagcagaatgcttcctccagaagaatctgaaggacgagggattatgcattcaagagagtcaagcaggggacgcgggattatgcattcaagagagtcaagcaggggaagaagaggagggagctgggaattgtcaagccgtgtaaacgaagatttaagaaccagagatgagtctgtgtcaagagtcggtgaagacagctcagagtcttcagacaatgatgcttcaagagatttacatgttgagatatatgatgcagtaacaagtagaggaagaaccggaactggtatagggcggttatag

SEQ ID NO: 1954 - protein, 1413 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGTTAGATTTGCAGCCGTCAGATCGGCGTCATGGAGCTCCGAGTAGTAGCGGCGGTGTTAGTGGTGGTGATGAGCTGATCAGAACTTATAAAGGCTGGAAAGGCAATAACGTGTTCTTCCTTGGAGGAAGGCTCGTGTTTGGACCTGATGCTCGATCTATTCTCATCACCGTCTTCTTAATTACAGCTCCTGTCATTGTATTCTGTATTTTTGTTGGCAGAAAATTTATCGATGATTTTCCTCACCATAGAGGAGTATCAGTTTTAGCTGTTGCTGATCTAGTATTTCTTCTTCTAACCTCCGCGAGAGACCCAGGGATAATACCACGTAATCTGTATCCTCCTGAACCAGAGAGTAATGAAGGCAATGGAGAACCACGTCTTGCTCATACTCCTCAGAGTCGGTTGCCTCGGACAAAGGATATGATTGTAAATGGAATTACTGTCAAGATCAAATACTGTGACACATGCATGCTTTACAGACCGCCCCGTGCTTCTCATTGTTCGATTTGCAACAACTGCGTCGAGAAGTTTGATCACCACTGTCCTTGGCTTGGTCAGTGCATTGGATTGAGAAACTATAGGTTCTACTTCATGTTTGTGTTGTGCTCAACTCTTCTCTGCATTTATGTCCATGTGTTCTGCTGGATCTACGTCAAGCGGATAATGGATAGTGAGAACATAAACATCTGGAAATCGTTTCTCAAGACTCCTGCTTCCATTGCACTAATAATCTACACTTTCATTTGCGTCTGGTTTGTTGGTGGGCTTACCTGTTTCCACTTGTACCTAATGAGTACCAATCAGTCAACTTACGAAAACTTTAGGTATCGGTATGATAGACATGAGAACCCCTTCAACAAAGGAATAGTGGGGAACTTTATGGAAGTTTTCTGCACAAATGTTGCCGTATCTCAGAACAGTTTCAGAGAAAAGGTTTCAAAGGAGCCAGCAATACCACCAAGGACAGTAAATGGAGGGATGTCAAGCCCGAGCTTACAGAAAGTTTCCAACGACATAGAGATGGGGAGAAAACCAGTGTGGCACGAGACAGTAGAAGAAGAGCTCGGTGACATCGAAAAGGACATGGAAGCAGGGGTTGCATCACGGGATTTGAGCAGAATGCTTCCTCCAGAAGAATCTGAAGGACGAGGGATTATGCATTCAAGAGAGTCAAGCAGGGGACGCGGGATTATGCATTCAAGAGAGTCAAGCAGGGGAAGAAGAGGAGGGAGCTGGGAATTGTCAAGCCGTGTAAACGAAGATTTAAGAACCAGAGATGAGTCTGTGTCAAGAGTCGGTGAAGACAGCTCAGAGTCTTCAGACAATGATGCTTCAAGAGATTTACATGTTGAGATATATGATGCAGTAACAAGTAGAGGAAGAACCGGAACTGGTATAGGGCGGTTATAG

SEQ ID NO: 1955 - DNA, 1521 bp, Arabidopsis thaliana
  misc_feature (1)..(1521): Ceres cDNA ID no. 12724298
  misc_feature (1)..(1521): Also known as  Ceres CDNA ID no. 23372771
gaaagagaaactccgataccagagcttggtggagcagtggagacgcttccacgcgaatctcgcagtcccactcgtcttcctccttccctctcttcctttgaataccttacctctctcggtctcgctccctccctcgattcaagcctattcgtcttcttacgctgtgtcttgaaaccctaatctttttcatttcaatccctaaaggtgtgattttgagattatggccaaagctaggaaggcaggacgtagggttccttcacgacgcttcagggcaagagcaaaaccatacaaatttccatcttctaaaagacttgtggcgagaaacatgtttgcggaagattgttcaaagtgtctagagaagagggattgggagaatgttatatgttcggtttgcatggagtgtccacacaacgctgtccttcttctctgctcatctcatgacaagggatgtcgtccttacatgtgtggaaccagtttccggtattctaattgcttagatcagtacaagaaagcgtcagctaagctgaagacatcgggccatcaacagatcaataagtctgagcttggaaatctcacatgcccactttgtagaggacaggtgaaaggttggacaatcgtacagcctgctcgtgactttttgaatcttaagaagaggatctgtatgcaggagaactgtgtttatgctggaaccttcaaagagctgaggaaacacatgaaagtggaccaccctagtgcgaagccgcgtgaagtggatcctgatgtggagcagaattggagaaggcttgagatcgagcatgaccgggacgatgttatgagcacgattaggtcgacaatgcctggtacagtggtgtatggtgattacgtaattgaaaggaacaatgccaacggttcagattcagacgagggtggtgatgatgatgggatcgatgctgcatttggtaggaatcttgtgaatgttttccttctgttacatgcttttggggcatcaggtaatcagatcagacgctctgattcagattcgaatgactcgacaacaatcaaccgaggaacaagtgagctgaatttctctgaagaagaagaggaagaggaggaggaggagaggcatagtaacagtaactctttggcaagtcgaatgaggcgacaaggacgcgttctgctgggacgttcaggtaggagacgtagagatagagaagctaaccagaacacaggtcctcctcctagatgagagagaatcacacgaattcaaaagaaaaccctgtctgattttgggtttcaggtaagctttatggtatggttaggtacaaatgtagtttcgacaagtttaaaacaaaacaaaaaaaggcttttggcctttctgctatcaccattggagaatttgggaatttgactcgaaattctttcatatgctagagaagcaggcttgcaatctcatgttttatttactgtattctgatgtaactttctgggtggaaaattcacaaatatctatccttgtgaataagcatgatcagtgatgatgac

SEQ ID NO: 1956 - protein, 1521 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
GAAAGAGAAACTCCGATACCAGAGCTTGGTGGAGCAGTGGAGACGCTTCCACGCGAATCTCGCAGTCCCACTCGTCTTCCTCCTTCCCTCTCTTCCTTTGAATACCTTACCTCTCTCGGTCTCGCTCCCTCCCTCGATTCAAGCCTATTCGTCTTCTTACGCTGTGTCTTGAAACCCTAATCTTTTTCATTTCAATCCCTAAAGGTGTGATTTTGAGATTATGGCCAAAGCTAGGAAGGCAGGACGTAGGGTTCCTTCACGACGCTTCAGGGCAAGAGCAAAACCATACAAATTTCCATCTTCTAAAAGACTTGTGGCGAGAAACATGTTTGCGGAAGATTGTTCAAAGTGTCTAGAGAAGAGGGATTGGGAGAATGTTATATGTTCGGTTTGCATGGAGTGTCCACACAACGCTGTCCTTCTTCTCTGCTCATCTCATGACAAGGGATGTCGTCCTTACATGTGTGGAACCAGTTTCCGGTATTCTAATTGCTTAGATCAGTACAAGAAAGCGTCAGCTAAGCTGAAGACATCGGGCCATCAACAGATCAATAAGTCTGAGCTTGGAAATCTCACATGCCCACTTTGTAGAGGACAGGTGAAAGGTTGGACAATCGTACAGCCTGCTCGTGACTTTTTGAATCTTAAGAAGAGGATCTGTATGCAGGAGAACTGTGTTTATGCTGGAACCTTCAAAGAGCTGAGGAAACACATGAAAGTGGACCACCCTAGTGCGAAGCCGCGTGAAGTGGATCCTGATGTGGAGCAGAATTGGAGAAGGCTTGAGATCGAGCATGACCGGGACGATGTTATGAGCACGATTAGGTCGACAATGCCTGGTACAGTGGTGTATGGTGATTACGTAATTGAAAGGAACAATGCCAACGGTTCAGATTCAGACGAGGGTGGTGATGATGATGGGATCGATGCTGCATTTGGTAGGAATCTTGTGAATGTTTTCCTTCTGTTACATGCTTTTGGGGCATCAGGTAATCAGATCAGACGCTCTGATTCAGATTCGAATGACTCGACAACAATCAACCGAGGAACAAGTGAGCTGAATTTCTCTGAAGAAGAAGAGGAAGAGGAGGAGGAGGAGAGGCATAGTAACAGTAACTCTTTGGCAAGTCGAATGAGGCGACAAGGACGCGTTCTGCTGGGACGTTCAGGTAGGAGACGTAGAGATAGAGAAGCTAACCAGAACACAGGTCCTCCTCCTAGATGAGAGAGAATCACACGAATTCAAAAGAAAACCCTGTCTGATTTTGGGTTTCAGGTAAGCTTTATGGTATGGTTAGGTACAAATGTAGTTTCGACAAGTTTAAAACAAAACAAAAAAAGGCTTTTGGCCTTTCTGCTATCACCATTGGAGAATTTGGGAATTTGACTCGAAATTCTTTCATATGCTAGAGAAGCAGGCTTGCAATCTCATGTTTTATTTACTGTATTCTGATGTAACTTTCTGGGTGGAAAATTCACAAATATCTATCCTTGTGAATAAGCATGATCAGTGATGATGAC

SEQ ID NO: 1957 - DNA, 1224 bp, Arabidopsis thaliana
  misc_feature (1)..(1224): Ceres cDNA ID no. 12724752
  misc_feature (1)..(1224): Also known as  Ceres CDNA ID no. 23372771
atgccgtcaacgccgacgacgccgactacaacaacgccgatcacggcttcgtattggtgttacagctgtacgcgtttcgtcagcgtttgggctgatcaaggcacaacaaccgtcggtagcgtcgcttgccctcactgcgacggcggttttatcgaacagattaacgattcttcctccgccgctaccgaattaacgattccggcttctactgaagtaagatcgatcaataacaaccgtagatccgtgattagacgccggagatccggtcgtcgtccgtcctttaatccggtcatcgtacttcaaggaggcgccggcgagagagaagagggagaagaaggagatgcggctagagatcgacgcgcttttgagttttattacgatgacggatccggatcgggtcttagaccgcttccggattctgtatctgagatcttgatgggatctggattcgagcggttacttgaacagctaagccaaatcgaagcgtcggctactggaattggtagatctggaaaccctccggcgtctaaatcggcgattgagtctttacctagagtcgaaatctcggattgccacataggctcggaggctaattgcgctgtttgcacggagattttcgagacggagacggaggcgcgtgagatgccgtgtaaacaccttttccacgacgattgcatcgtaccgtggctatcgattcgaaactcttgtcccgtgtgcagattcgagctaccttcagagcctaatcgacggagcaacaacaacgaggaggataacgccgtggggatgacgatttggagacttcccggtggtggattcgccgtagggaggtttaacgcagcaatgagagacggagagagagttttgccagtggtgttaacagaaatggatggtggtgggattggtaatagccaggatggtcctagacggatctcatgggttaggtcacacggtacactcgaatcggatagtaacggtactggctcaggttccggctccggtggaagattgaggaggatggttcgtggaatggtgtcgttaatgaggagagtgagaccaaaccgtagctcttcttcttcatcagctgcgatatcaacttcttctgataatctggatttgaacattgaagtagaatctagggttttggataggtcaaattcagtgatgagaagatacttcagaagaaacagaagtaacagggattcttcgtcttcagttcttcattga

SEQ ID NO: 1958 - protein, 1224 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGCCGTCAACGCCGACGACGCCGACTACAACAACGCCGATCACGGCTTCGTATTGGTGTTACAGCTGTACGCGTTTCGTCAGCGTTTGGGCTGATCAAGGCACAACAACCGTCGGTAGCGTCGCTTGCCCTCACTGCGACGGCGGTTTTATCGAACAGATTAACGATTCTTCCTCCGCCGCTACCGAATTAACGATTCCGGCTTCTACTGAAGTAAGATCGATCAATAACAACCGTAGATCCGTGATTAGACGCCGGAGATCCGGTCGTCGTCCGTCCTTTAATCCGGTCATCGTACTTCAAGGAGGCGCCGGCGAGAGAGAAGAGGGAGAAGAAGGAGATGCGGCTAGAGATCGACGCGCTTTTGAGTTTTATTACGATGACGGATCCGGATCGGGTCTTAGACCGCTTCCGGATTCTGTATCTGAGATCTTGATGGGATCTGGATTCGAGCGGTTACTTGAACAGCTAAGCCAAATCGAAGCGTCGGCTACTGGAATTGGTAGATCTGGAAACCCTCCGGCGTCTAAATCGGCGATTGAGTCTTTACCTAGAGTCGAAATCTCGGATTGCCACATAGGCTCGGAGGCTAATTGCGCTGTTTGCACGGAGATTTTCGAGACGGAGACGGAGGCGCGTGAGATGCCGTGTAAACACCTTTTCCACGACGATTGCATCGTACCGTGGCTATCGATTCGAAACTCTTGTCCCGTGTGCAGATTCGAGCTACCTTCAGAGCCTAATCGACGGAGCAACAACAACGAGGAGGATAACGCCGTGGGGATGACGATTTGGAGACTTCCCGGTGGTGGATTCGCCGTAGGGAGGTTTAACGCAGCAATGAGAGACGGAGAGAGAGTTTTGCCAGTGGTGTTAACAGAAATGGATGGTGGTGGGATTGGTAATAGCCAGGATGGTCCTAGACGGATCTCATGGGTTAGGTCACACGGTACACTCGAATCGGATAGTAACGGTACTGGCTCAGGTTCCGGCTCCGGTGGAAGATTGAGGAGGATGGTTCGTGGAATGGTGTCGTTAATGAGGAGAGTGAGACCAAACCGTAGCTCTTCTTCTTCATCAGCTGCGATATCAACTTCTTCTGATAATCTGGATTTGAACATTGAAGTAGAATCTAGGGTTTTGGATAGGTCAAATTCAGTGATGAGAAGATACTTCAGAAGAAACAGAAGTAACAGGGATTCTTCGTCTTCAGTTCTTCATTGA

SEQ ID NO: 1959 - DNA, 1572 bp, Arabidopsis thaliana
  misc_feature (1)..(1572): Ceres cDNA ID no. 12724855
  misc_feature (1)..(1572): Also known as  Ceres CDNA ID no. 23372771
atggaatctttaatgagactcgtcttagttctgtttccgttcttcgtcgtcttcttcgtacctcttgatcacgtttcttcagaatctatcagcagagcaaattttccagatggatttgtattcggaacagcttcttcagcttaccagttcgaaggagctgtgaaagaaggaaacaaaggagaaagcatatgggacactttcacgaaggagaaaccaggaaagatactggatttcagcaatgcggatactacggttgatcaatatcataggtttcacaatgacatagacctgatgaaagatctgagaatggatgcttacagattctctatatcttggtcaagaatattccctaatggaacaggggaagtaaacccagatggagttaagtactataacagcctaatagatgctcttttagccaaaggaatcaaaccttatgtgacattgtatcactgggatctcccacaagccttagaagacagatatgaaggatggctaagcagagaagtggtggatgattttgagcattatgcattcacctgtttcaaagcatttggagatagagtgaagtactggatcactttcaatgagcctcatggggtatcgatccaaggctatgacacagggatacaagctccaggaaggtgctcacttctgggacattggttctgtaagaaggggaagtcatcggtcgaaccgtatattgtagctcataacattctgttgtctcatgctgctgcttaccatacctaccaaagaaactttaaggagaaacaacgtggtcaaatcgggatatcattagatgcaaaatggtatgagccaatgtctgattgtgatgaggacaaagatgcagctcgtagagcaatggattttgggcttggatggtttatggatcctctaatcaatggagactatccagcttcaatgaagagtctagtggaagagagactacctaagataacaccagagatgtataaaaccataaaaggggcatttgattacgtgggaatcaaccactacaccacattatacgcgaggaatgacagaactaggataaggaaactgattctacaagatgcttcttctgattcagccgtgattacaagctggtcaagctggctacacattgtcccatggggaatcaggaaactggcagtgtatgttaaagacatatatggaaacccacctgtattcatcacagaaaacggcatggatgagaaaaacagtccattcatagacatggaaaaagcattaaaagatgacaagaggattggcttccacagagattacctctcaaacttatcagctgccataaggaatgatgaatgcgacgtaagaggatattttgtgtggtcattgctagacaattgggaatggaactcaggatacacggtccggtttgggatctactatgttgactacaagaacaatctcacaaggatacctaaagcttctgctcgatggtttcaaacaatacttagcggctcttcttcaacatcagattccagcaagcttattctactggaagaggcaacagaacaacaacaagagtacaaattccaagagaaatga

SEQ ID NO: 1960 - protein, 1572 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGGAATCTTTAATGAGACTCGTCTTAGTTCTGTTTCCGTTCTTCGTCGTCTTCTTCGTACCTCTTGATCACGTTTCTTCAGAATCTATCAGCAGAGCAAATTTTCCAGATGGATTTGTATTCGGAACAGCTTCTTCAGCTTACCAGTTCGAAGGAGCTGTGAAAGAAGGAAACAAAGGAGAAAGCATATGGGACACTTTCACGAAGGAGAAACCAGGAAAGATACTGGATTTCAGCAATGCGGATACTACGGTTGATCAATATCATAGGTTTCACAATGACATAGACCTGATGAAAGATCTGAGAATGGATGCTTACAGATTCTCTATATCTTGGTCAAGAATATTCCCTAATGGAACAGGGGAAGTAAACCCAGATGGAGTTAAGTACTATAACAGCCTAATAGATGCTCTTTTAGCCAAAGGAATCAAACCTTATGTGACATTGTATCACTGGGATCTCCCACAAGCCTTAGAAGACAGATATGAAGGATGGCTAAGCAGAGAAGTGGTGGATGATTTTGAGCATTATGCATTCACCTGTTTCAAAGCATTTGGAGATAGAGTGAAGTACTGGATCACTTTCAATGAGCCTCATGGGGTATCGATCCAAGGCTATGACACAGGGATACAAGCTCCAGGAAGGTGCTCACTTCTGGGACATTGGTTCTGTAAGAAGGGGAAGTCATCGGTCGAACCGTATATTGTAGCTCATAACATTCTGTTGTCTCATGCTGCTGCTTACCATACCTACCAAAGAAACTTTAAGGAGAAACAACGTGGTCAAATCGGGATATCATTAGATGCAAAATGGTATGAGCCAATGTCTGATTGTGATGAGGACAAAGATGCAGCTCGTAGAGCAATGGATTTTGGGCTTGGATGGTTTATGGATCCTCTAATCAATGGAGACTATCCAGCTTCAATGAAGAGTCTAGTGGAAGAGAGACTACCTAAGATAACACCAGAGATGTATAAAACCATAAAAGGGGCATTTGATTACGTGGGAATCAACCACTACACCACATTATACGCGAGGAATGACAGAACTAGGATAAGGAAACTGATTCTACAAGATGCTTCTTCTGATTCAGCCGTGATTACAAGCTGGTCAAGCTGGCTACACATTGTCCCATGGGGAATCAGGAAACTGGCAGTGTATGTTAAAGACATATATGGAAACCCACCTGTATTCATCACAGAAAACGGCATGGATGAGAAAAACAGTCCATTCATAGACATGGAAAAAGCATTAAAAGATGACAAGAGGATTGGCTTCCACAGAGATTACCTCTCAAACTTATCAGCTGCCATAAGGAATGATGAATGCGACGTAAGAGGATATTTTGTGTGGTCATTGCTAGACAATTGGGAATGGAACTCAGGATACACGGTCCGGTTTGGGATCTACTATGTTGACTACAAGAACAATCTCACAAGGATACCTAAAGCTTCTGCTCGATGGTTTCAAACAATACTTAGCGGCTCTTCTTCAACATCAGATTCCAGCAAGCTTATTCTACTGGAAGAGGCAACAGAACAACAACAAGAGTACAAATTCCAAGAGAAATGA

SEQ ID NO: 1961 - DNA, 1231 bp, Arabidopsis thaliana
  misc_feature (1)..(1231): Ceres cDNA ID no. 12724977
  misc_feature (1)..(1231): Also known as  Ceres CDNA ID no. 23372771
agaattagcaaacgacagatctgagaaatggaagaaaagtttagaaacttaatcgaggtatggatctctgctttaatctctctatcttactgttattacatatcgtctaaactctccaaaggtgttcttcgtctcctctctattcttccagtctgcattctgtttcttgttcttcctctgttcctctcttgtgtgcacttttgcgccatttcagttctttttctttcatggcttgcaaactttaagcttcttctatttgcctttgatgagggacctttgttcccacttcctccaaaactctcccgtttcatctgcttcgcttgtttacccatcaaaatcagacaagacccttctccaaatgcgataccaaatcttcatcctaaacctatgcctaaatgggttttggctgttaaaattttggtcttgggcgtcttgttacatgtttatgaatacagggatggtttgcctcggtttgttgtcttggctctctattgtctccatatttaccttgaggtagaacttgtcttggtctttgttggagccgtggtatctactcttcttgggtgtaacatcgagccggtgttcaatgagccctacctagctacctccctacaagacttctggagccgcagatggaacctcatggtttcagccgtcctacgctcaaccgttcacattccggttcagcgttttttcaaacgcatactcagtccagacggggctatgtttgctggggtcatggcatcgttctttgtctcaggcttgatgcatgagctgctctacttttacatgatccgtaagcctccaacttgggaagtcacttgtttctttgtgttgcatggtgctgccactgccactgagatagcggtgaagagaacacaatggttgaggccaccgcaccgggctgtctctggtcttgtagttctgacgtttgtgagtgtgacgggcgtttggctattcctcgctcaagtgctgagaaacaatgtccatgagaaagcgattggagaatgtttattggttcttgacctagccaagttattcacttcttcatgattctttattaaaggcaaagagcggtagcagagcaaccaaactttgtttctcttcattgtttgaaaacgtatatagaagtgtgagacacgtcgtctagtgtgaaacattcttgacatgctattaaattgaatcaagctcaacaaattcaataaatatggcgtaaatgttttctaagttc

SEQ ID NO: 1962 - protein, 1231 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
AGAATTAGCAAACGACAGATCTGAGAAATGGAAGAAAAGTTTAGAAACTTAATCGAGGTATGGATCTCTGCTTTAATCTCTCTATCTTACTGTTATTACATATCGTCTAAACTCTCCAAAGGTGTTCTTCGTCTCCTCTCTATTCTTCCAGTCTGCATTCTGTTTCTTGTTCTTCCTCTGTTCCTCTCTTGTGTGCACTTTTGCGCCATTTCAGTTCTTTTTCTTTCATGGCTTGCAAACTTTAAGCTTCTTCTATTTGCCTTTGATGAGGGACCTTTGTTCCCACTTCCTCCAAAACTCTCCCGTTTCATCTGCTTCGCTTGTTTACCCATCAAAATCAGACAAGACCCTTCTCCAAATGCGATACCAAATCTTCATCCTAAACCTATGCCTAAATGGGTTTTGGCTGTTAAAATTTTGGTCTTGGGCGTCTTGTTACATGTTTATGAATACAGGGATGGTTTGCCTCGGTTTGTTGTCTTGGCTCTCTATTGTCTCCATATTTACCTTGAGGTAGAACTTGTCTTGGTCTTTGTTGGAGCCGTGGTATCTACTCTTCTTGGGTGTAACATCGAGCCGGTGTTCAATGAGCCCTACCTAGCTACCTCCCTACAAGACTTCTGGAGCCGCAGATGGAACCTCATGGTTTCAGCCGTCCTACGCTCAACCGTTCACATTCCGGTTCAGCGTTTTTTCAAACGCATACTCAGTCCAGACGGGGCTATGTTTGCTGGGGTCATGGCATCGTTCTTTGTCTCAGGCTTGATGCATGAGCTGCTCTACTTTTACATGATCCGTAAGCCTCCAACTTGGGAAGTCACTTGTTTCTTTGTGTTGCATGGTGCTGCCACTGCCACTGAGATAGCGGTGAAGAGAACACAATGGTTGAGGCCACCGCACCGGGCTGTCTCTGGTCTTGTAGTTCTGACGTTTGTGAGTGTGACGGGCGTTTGGCTATTCCTCGCTCAAGTGCTGAGAAACAATGTCCATGAGAAAGCGATTGGAGAATGTTTATTGGTTCTTGACCTAGCCAAGTTATTCACTTCTTCATGATTCTTTATTAAAGGCAAAGAGCGGTAGCAGAGCAACCAAACTTTGTTTCTCTTCATTGTTTGAAAACGTATATAGAAGTGTGAGACACGTCGTCTAGTGTGAAACATTCTTGACATGCTATTAAATTGAATCAAGCTCAACAAATTCAATAAATATGGCGTAAATGTTTTCTAAGTTC

SEQ ID NO: 1963 - DNA, 1189 bp, Arabidopsis thaliana
  misc_feature (1)..(1189): Ceres cDNA ID no. 12725056
  misc_feature (1)..(1189): Also known as  Ceres CDNA ID no. 23372771
gtttttcattcataacaaaaaatgggttttataactcgatttttagttttcatgtcactcttcaccagtttggtttctggatttgctctacaaaagcttcctcttatacagttcgacgaaggttacacacagctctttggtgaccagaatcttattgttcacagagatggaaaatctgtccggttaacgcttgatgaaagaaccggttctggatttgtctcaaatgatatttacttgcatggcttcttcagttcctctatcaaattgccagcagattactctgcaggagttgttatcgccttttatttatcaaatggggacttatatgagaagaatcatgacgagattgattttgagtttttggggaatattagaggcagagaatggaggattcagaccaatatatacggtaatggaagcacacacttgggcagagaagaaagatacaatctttggtttgatccaacagaggatttccatcaatacagtatcctttggtctctatctcacatcatattttatgtagacaatgttccgatcagagaagtcaaacgtacggcgtcgatgggcggtgacttcccggcgaagccaatgtctttatattcaaccatatgggatggttccaaatgggcgactgatggaggcaagtacggtgtaaattacaaatatgccccttacgtctctcaattcactgatctgatcctccacggctgcgccgttgaccccaccgagaagtttccgagctgcaaagatgaagcggttcagaatctccggctagcatcggagataacggagtctcagaggaacaagatggagattttccgacagaaacacatgacttattcgtattgttacgatcatatgaggtacaaggtggttttgtcggagtgtgttgtgaatccggctgaggctaagcgtctcagggtctatgatccggtcacgttcggtgggattcctcacggccaccgtcgtgggaagcatcggagcaggagccgattagctcgaactgagtcgatatgaatcggtgtatattgttcggctagagggcatttttggcattttctgtcttgtataggaatactatgaattatggactgaataatggaatgacaccgctatattttgatttcctccattttatgaacattatcgttttaacataataataaaatttcatttttctataagt

SEQ ID NO: 1964 - protein, 1189 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
GTTTTTCATTCATAACAAAAAATGGGTTTTATAACTCGATTTTTAGTTTTCATGTCACTCTTCACCAGTTTGGTTTCTGGATTTGCTCTACAAAAGCTTCCTCTTATACAGTTCGACGAAGGTTACACACAGCTCTTTGGTGACCAGAATCTTATTGTTCACAGAGATGGAAAATCTGTCCGGTTAACGCTTGATGAAAGAACCGGTTCTGGATTTGTCTCAAATGATATTTACTTGCATGGCTTCTTCAGTTCCTCTATCAAATTGCCAGCAGATTACTCTGCAGGAGTTGTTATCGCCTTTTATTTATCAAATGGGGACTTATATGAGAAGAATCATGACGAGATTGATTTTGAGTTTTTGGGGAATATTAGAGGCAGAGAATGGAGGATTCAGACCAATATATACGGTAATGGAAGCACACACTTGGGCAGAGAAGAAAGATACAATCTTTGGTTTGATCCAACAGAGGATTTCCATCAATACAGTATCCTTTGGTCTCTATCTCACATCATATTTTATGTAGACAATGTTCCGATCAGAGAAGTCAAACGTACGGCGTCGATGGGCGGTGACTTCCCGGCGAAGCCAATGTCTTTATATTCAACCATATGGGATGGTTCCAAATGGGCGACTGATGGAGGCAAGTACGGTGTAAATTACAAATATGCCCCTTACGTCTCTCAATTCACTGATCTGATCCTCCACGGCTGCGCCGTTGACCCCACCGAGAAGTTTCCGAGCTGCAAAGATGAAGCGGTTCAGAATCTCCGGCTAGCATCGGAGATAACGGAGTCTCAGAGGAACAAGATGGAGATTTTCCGACAGAAACACATGACTTATTCGTATTGTTACGATCATATGAGGTACAAGGTGGTTTTGTCGGAGTGTGTTGTGAATCCGGCTGAGGCTAAGCGTCTCAGGGTCTATGATCCGGTCACGTTCGGTGGGATTCCTCACGGCCACCGTCGTGGGAAGCATCGGAGCAGGAGCCGATTAGCTCGAACTGAGTCGATATGAATCGGTGTATATTGTTCGGCTAGAGGGCATTTTTGGCATTTTCTGTCTTGTATAGGAATACTATGAATTATGGACTGAATAATGGAATGACACCGCTATATTTTGATTTCCTCCATTTTATGAACATTATCGTTTTAACATAATAATAAAATTTCATTTTTCTATAAGT

SEQ ID NO: 1965 - DNA, 1662 bp, Arabidopsis thaliana
  misc_feature (1)..(1662): Ceres cDNA ID no. 12725353
  misc_feature (1)..(1662): Also known as  Ceres CDNA ID no. 23372771
aacaccatccaccacatgattcacatgttgtgacgaagagagccaacaaaacgttcgagagtcagatactttatatatcggttaccgaagtgatcgaaaccgcgaaccacgaagctgagcaggatacttttaattagtagttcatgcaggttttgggaatggaggaaaagcctgcaaggagaagcgtagtgttggttccatttccagcacaaggacatatatctccaatgatgcaacttgccaaaacccttcacttaaagggtttctcgatcacagttgttcagactaagttcaattactttagcccttcagatgacttcactcatgattttcagttcgtcaccattccagaaagcttaccagagtctgatttcaagaatctcggaccaatacagtttctgtttaagctcaacaaagagtgtaaggtgagcttcaaggactgtttgggtcagttggtgctgcaacaaagtaatgagatctcatgtgtcatctacgatgagttcatgtactttgctgaagctgcagccaaagagtgtaagcttccaaacatcattttcagcacaacaagtgccacggctttcgcttgccgctctgtatttgacaaactatatgcaaacaatgtccaagctcccttgaaagaaactaaaggacaacaagaagagctagttccggagttttatcccttgagatataaagactttccagtttcacggtttgcatcattagagagcataatggaggtgtataggaatacagttgacaaacggacagcttcctcggtgataatcaacactgcgagctgtctagagagctcatctctgtcttttctgcaacaacaacagctacaaattccagtgtatcctataggccctcttcacatggtggcctcagctcctacaagtctgcttgaagagaacaagagctgcatcgaatggttgaacaaacaaaaggtaaactcggtgatatacataagcatgggaagcatagctttaatggaaatcaacgagataatggaagtcgcgtcaggattggctgctagcaaccaacacttcttatgggtgatccgaccagggtcaatacctggttccgagtggatagagtccatgcctgaagagtttagtaagatggttttggaccgaggttacattgtgaaatgggctccacagaaggaagtactttctcatcctgcagtaggagggttttggagccattgtggatggaactcgacactagaaagcatcggccaaggagttccaatgatctgcaggccattttcgggtgatcaaaaggtgaacgctagatacttggagtgtgtatggaaaattgggattcaagtggagggtgagctagacagaggagtggtcgagagagctgtgaagaggttaatggttgacgaagaaggagaggagatgaggaagagagctttcagtttaaaagagcaacttagagcctctgttaaaagtggaggctcttcacacaactcgctagaagagtttgtacacttcataaggactctatgaagacagttgtgtctactaaaacacacaaagcatcaagattcctttttcaaccattccaagtttgtttgcatagagtttatctgaacatcacttaaaaactcacctgcagaataacaaactataaaaattaatactttaccgc

SEQ ID NO: 1966 - protein, 1662 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
AACACCATCCACCACATGATTCACATGTTGTGACGAAGAGAGCCAACAAAACGTTCGAGAGTCAGATACTTTATATATCGGTTACCGAAGTGATCGAAACCGCGAACCACGAAGCTGAGCAGGATACTTTTAATTAGTAGTTCATGCAGGTTTTGGGAATGGAGGAAAAGCCTGCAAGGAGAAGCGTAGTGTTGGTTCCATTTCCAGCACAAGGACATATATCTCCAATGATGCAACTTGCCAAAACCCTTCACTTAAAGGGTTTCTCGATCACAGTTGTTCAGACTAAGTTCAATTACTTTAGCCCTTCAGATGACTTCACTCATGATTTTCAGTTCGTCACCATTCCAGAAAGCTTACCAGAGTCTGATTTCAAGAATCTCGGACCAATACAGTTTCTGTTTAAGCTCAACAAAGAGTGTAAGGTGAGCTTCAAGGACTGTTTGGGTCAGTTGGTGCTGCAACAAAGTAATGAGATCTCATGTGTCATCTACGATGAGTTCATGTACTTTGCTGAAGCTGCAGCCAAAGAGTGTAAGCTTCCAAACATCATTTTCAGCACAACAAGTGCCACGGCTTTCGCTTGCCGCTCTGTATTTGACAAACTATATGCAAACAATGTCCAAGCTCCCTTGAAAGAAACTAAAGGACAACAAGAAGAGCTAGTTCCGGAGTTTTATCCCTTGAGATATAAAGACTTTCCAGTTTCACGGTTTGCATCATTAGAGAGCATAATGGAGGTGTATAGGAATACAGTTGACAAACGGACAGCTTCCTCGGTGATAATCAACACTGCGAGCTGTCTAGAGAGCTCATCTCTGTCTTTTCTGCAACAACAACAGCTACAAATTCCAGTGTATCCTATAGGCCCTCTTCACATGGTGGCCTCAGCTCCTACAAGTCTGCTTGAAGAGAACAAGAGCTGCATCGAATGGTTGAACAAACAAAAGGTAAACTCGGTGATATACATAAGCATGGGAAGCATAGCTTTAATGGAAATCAACGAGATAATGGAAGTCGCGTCAGGATTGGCTGCTAGCAACCAACACTTCTTATGGGTGATCCGACCAGGGTCAATACCTGGTTCCGAGTGGATAGAGTCCATGCCTGAAGAGTTTAGTAAGATGGTTTTGGACCGAGGTTACATTGTGAAATGGGCTCCACAGAAGGAAGTACTTTCTCATCCTGCAGTAGGAGGGTTTTGGAGCCATTGTGGATGGAACTCGACACTAGAAAGCATCGGCCAAGGAGTTCCAATGATCTGCAGGCCATTTTCGGGTGATCAAAAGGTGAACGCTAGATACTTGGAGTGTGTATGGAAAATTGGGATTCAAGTGGAGGGTGAGCTAGACAGAGGAGTGGTCGAGAGAGCTGTGAAGAGGTTAATGGTTGACGAAGAAGGAGAGGAGATGAGGAAGAGAGCTTTCAGTTTAAAAGAGCAACTTAGAGCCTCTGTTAAAAGTGGAGGCTCTTCACACAACTCGCTAGAAGAGTTTGTACACTTCATAAGGACTCTATGAAGACAGTTGTGTCTACTAAAACACACAAAGCATCAAGATTCCTTTTTCAACCATTCCAAGTTTGTTTGCATAGAGTTTATCTGAACATCACTTAAAAACTCACCTGCAGAATAACAAACTATAAAAATTAATACTTTACCGC

SEQ ID NO: 1967 - DNA, 1242 bp, Arabidopsis thaliana
  misc_feature (1)..(1242): Ceres cDNA ID no. 12725832
  misc_feature (1)..(1242): Also known as  Ceres CDNA ID no. 23372771
atgtctaaaccgttattatacagaaggtcttcgatcttttccgttattttgagaattcataagcttagagaaactgaaagtttcgtgttgtttcctggagaatcatctagtagattgcaatggacgtttgttcaggtgagacacaagtctggtggaggaggatggagacctaagcagaaagtatatcatagagttcatgaccttgataaagcaattgacttgaacaagaaaccatctctgatacttcagttgaaatctattatccaggcgcagaaacatggaagccttcttcttagagatcttgagaagcatgttgggtttgttcacaagtggaacttaatggctgccattgagaagtaccctacgatattttatgttggaggtggacacaaagaacctcctttcgttatgctgactgagaaagctaaaaagattgcagctgaggaaagtgaagctacagagtcaatggaacctattctggttaataatcttaggaagttattgatgatgtctgttgattgtcgagttcctttggagaaggttgagtttattcaatctgcaatgggtttgcctcaagattttaagagtacattgatccctaagtacactgaatttttctctttgaaggttatcaatggaaaagttaatcttgttttagagaattgggattcttcactggcaatcactgcacgagaggataggttatcccgtgaaggattctccgagtcagttggggacagaaagagggtcaggatcacaaaggatggcaatttcttgggacgaaatgcgtttaagatttcttttcctcctggttttaggcctaacgctagttatttagaggaatttgagaagtggcagaaaatggaattcccatctccttatcttaatgcgagaagatttgatgctgcagatcctaaagctaggaaacgagttgtagctgtgcttcatgaactgctcagtttaacaatggagaaaagagtgacatgcgctcaattggatgcattccactctgagtatctgcttccatcaagactaatactttgcttgataaagcatcaagggatcttctacattactaacaaaggagcaaggggtacggtatttctcaaagatgcttatgctggttctaatttgattgagaaatgcccattgctattgttccatgatagatttgttgcactctgtggtcggaaagaagtcaatttatctaatgaaatgcagtcttcaagtgttttctcctaa

SEQ ID NO: 1968 - protein, 1242 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGTCTAAACCGTTATTATACAGAAGGTCTTCGATCTTTTCCGTTATTTTGAGAATTCATAAGCTTAGAGAAACTGAAAGTTTCGTGTTGTTTCCTGGAGAATCATCTAGTAGATTGCAATGGACGTTTGTTCAGGTGAGACACAAGTCTGGTGGAGGAGGATGGAGACCTAAGCAGAAAGTATATCATAGAGTTCATGACCTTGATAAAGCAATTGACTTGAACAAGAAACCATCTCTGATACTTCAGTTGAAATCTATTATCCAGGCGCAGAAACATGGAAGCCTTCTTCTTAGAGATCTTGAGAAGCATGTTGGGTTTGTTCACAAGTGGAACTTAATGGCTGCCATTGAGAAGTACCCTACGATATTTTATGTTGGAGGTGGACACAAAGAACCTCCTTTCGTTATGCTGACTGAGAAAGCTAAAAAGATTGCAGCTGAGGAAAGTGAAGCTACAGAGTCAATGGAACCTATTCTGGTTAATAATCTTAGGAAGTTATTGATGATGTCTGTTGATTGTCGAGTTCCTTTGGAGAAGGTTGAGTTTATTCAATCTGCAATGGGTTTGCCTCAAGATTTTAAGAGTACATTGATCCCTAAGTACACTGAATTTTTCTCTTTGAAGGTTATCAATGGAAAAGTTAATCTTGTTTTAGAGAATTGGGATTCTTCACTGGCAATCACTGCACGAGAGGATAGGTTATCCCGTGAAGGATTCTCCGAGTCAGTTGGGGACAGAAAGAGGGTCAGGATCACAAAGGATGGCAATTTCTTGGGACGAAATGCGTTTAAGATTTCTTTTCCTCCTGGTTTTAGGCCTAACGCTAGTTATTTAGAGGAATTTGAGAAGTGGCAGAAAATGGAATTCCCATCTCCTTATCTTAATGCGAGAAGATTTGATGCTGCAGATCCTAAAGCTAGGAAACGAGTTGTAGCTGTGCTTCATGAACTGCTCAGTTTAACAATGGAGAAAAGAGTGACATGCGCTCAATTGGATGCATTCCACTCTGAGTATCTGCTTCCATCAAGACTAATACTTTGCTTGATAAAGCATCAAGGGATCTTCTACATTACTAACAAAGGAGCAAGGGGTACGGTATTTCTCAAAGATGCTTATGCTGGTTCTAATTTGATTGAGAAATGCCCATTGCTATTGTTCCATGATAGATTTGTTGCACTCTGTGGTCGGAAAGAAGTCAATTTATCTAATGAAATGCAGTCTTCAAGTGTTTTCTCCTAA

SEQ ID NO: 1969 - DNA, 1780 bp, Arabidopsis thaliana
  misc_feature (1)..(1780): Ceres cDNA ID no. 12726290
  misc_feature (1)..(1780): Also known as  Ceres CDNA ID no. 23372771
agtttcggcttctctttttctcgtccaccaacataactatttctcctcttttctagcaaaagtaaaaaataaaaatttacaatatttttcttgcatagaatctctctctccatttttaggattcttcttcttcttccattagtctctattgaatcagaatctcaactctcaggttggattttgagagctaattaaatagttaagatgatggaaatagcttatcagcctcggattgattccgagattgaatcactcgtcgagagaatcaatcctccaagggtttgtgtagacaacgactctgacccagagtgcacacttattaaggtagatagcgcgaacaagtacgggatattactggacatggttcaagtgttagccgatcttgatctcgttatctccaaatgttacatctcatctgatggcgaatggttcatggatgtgtttcacgtgacagaccaactcgggaataagctcaccgaccgaagccttattctctacattcaacaggcaatatgttctagtagaacgggaggtataacaaaggagatgcagagtaatctaaaacgggaggtgcaacagcgccacgtgtcaacagaacacacggcctttgagataaccggaatcaatagaccgggtctactatccgaaatatctgccgtactttccgacattggatgtcacgtgacggctgctgttgcatggacccaccacgagcgagcggctatggtgatttatctagaagacgggtttaacggtgggcccattatcgacccaataagaaaggcccaagtaaaggatcatctggatacagtcatggaggcccatcacatagttggcgatgtgtctcatgtcgtcgtgagggtcgtcgaggctaaaggagttccggtcgggtgggctcacactgagcgacgacttcacgagctaatgtacggagaaggagattacgagaattgcttcgactgcgattgtttcggagacaggtgcgatgctttgtggagaggaagatgcgagaggatacacgtgacaatcgaagcatgtaatggctattcaatggtgaatgttaagtgtagagacagaccaaaactacttttcgacacggtgtgtgctttgaaagagttacaattcgttgtgtttcacgccgtcgccggagctaaaggctccactgcagagcaagaatatttcataagaaagaagaacgggggcacgttagaaacggaagggcaaagagagagactaaggcattgtttggttgctgcgatttcgagacgtgcttcacaaggattgaaactcgagattcggacagagaacaagatgggtttgttgtcggatgtgactagagttgtgagagaaaacggtttatcgataacgagagctgagatgtgcacgcaaggtgagattgcggttggctcgttttatgttacggatgtgaatggtggtgagacgggtcctagtgaggttgaagcggttgtacgagaattgggaggagcggttgtgtcagcggttaaaggggttggaatgatgccgaggaggattggttcgacgagtgatagtgtggagcaggacaaagctaagtcgtctattgggagaatgttttggtctaaattagagaggttgtcaacgtctataagatcgttgtgaagtgtttgattagtggtttttgcctctctggttctcgtgattatcgatcgttgtatatatagatgaactaggactatttgcagattcaattgaaattcgtataattattggttttagatgtgatctaatgagataagattct

SEQ ID NO: 1970 - protein, 1780 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
AGTTTCGGCTTCTCTTTTTCTCGTCCACCAACATAACTATTTCTCCTCTTTTCTAGCAAAAGTAAAAAATAAAAATTTACAATATTTTTCTTGCATAGAATCTCTCTCTCCATTTTTAGGATTCTTCTTCTTCTTCCATTAGTCTCTATTGAATCAGAATCTCAACTCTCAGGTTGGATTTTGAGAGCTAATTAAATAGTTAAGATGATGGAAATAGCTTATCAGCCTCGGATTGATTCCGAGATTGAATCACTCGTCGAGAGAATCAATCCTCCAAGGGTTTGTGTAGACAACGACTCTGACCCAGAGTGCACACTTATTAAGGTAGATAGCGCGAACAAGTACGGGATATTACTGGACATGGTTCAAGTGTTAGCCGATCTTGATCTCGTTATCTCCAAATGTTACATCTCATCTGATGGCGAATGGTTCATGGATGTGTTTCACGTGACAGACCAACTCGGGAATAAGCTCACCGACCGAAGCCTTATTCTCTACATTCAACAGGCAATATGTTCTAGTAGAACGGGAGGTATAACAAAGGAGATGCAGAGTAATCTAAAACGGGAGGTGCAACAGCGCCACGTGTCAACAGAACACACGGCCTTTGAGATAACCGGAATCAATAGACCGGGTCTACTATCCGAAATATCTGCCGTACTTTCCGACATTGGATGTCACGTGACGGCTGCTGTTGCATGGACCCACCACGAGCGAGCGGCTATGGTGATTTATCTAGAAGACGGGTTTAACGGTGGGCCCATTATCGACCCAATAAGAAAGGCCCAAGTAAAGGATCATCTGGATACAGTCATGGAGGCCCATCACATAGTTGGCGATGTGTCTCATGTCGTCGTGAGGGTCGTCGAGGCTAAAGGAGTTCCGGTCGGGTGGGCTCACACTGAGCGACGACTTCACGAGCTAATGTACGGAGAAGGAGATTACGAGAATTGCTTCGACTGCGATTGTTTCGGAGACAGGTGCGATGCTTTGTGGAGAGGAAGATGCGAGAGGATACACGTGACAATCGAAGCATGTAATGGCTATTCAATGGTGAATGTTAAGTGTAGAGACAGACCAAAACTACTTTTCGACACGGTGTGTGCTTTGAAAGAGTTACAATTCGTTGTGTTTCACGCCGTCGCCGGAGCTAAAGGCTCCACTGCAGAGCAAGAATATTTCATAAGAAAGAAGAACGGGGGCACGTTAGAAACGGAAGGGCAAAGAGAGAGACTAAGGCATTGTTTGGTTGCTGCGATTTCGAGACGTGCTTCACAAGGATTGAAACTCGAGATTCGGACAGAGAACAAGATGGGTTTGTTGTCGGATGTGACTAGAGTTGTGAGAGAAAACGGTTTATCGATAACGAGAGCTGAGATGTGCACGCAAGGTGAGATTGCGGTTGGCTCGTTTTATGTTACGGATGTGAATGGTGGTGAGACGGGTCCTAGTGAGGTTGAAGCGGTTGTACGAGAATTGGGAGGAGCGGTTGTGTCAGCGGTTAAAGGGGTTGGAATGATGCCGAGGAGGATTGGTTCGACGAGTGATAGTGTGGAGCAGGACAAAGCTAAGTCGTCTATTGGGAGAATGTTTTGGTCTAAATTAGAGAGGTTGTCAACGTCTATAAGATCGTTGTGAAGTGTTTGATTAGTGGTTTTTGCCTCTCTGGTTCTCGTGATTATCGATCGTTGTATATATAGATGAACTAGGACTATTTGCAGATTCAATTGAAATTCGTATAATTATTGGTTTTAGATGTGATCTAATGAGATAAGATTCT

SEQ ID NO: 1971 - DNA, 1945 bp, Arabidopsis thaliana
  misc_feature (1)..(1945): Ceres cDNA ID no. 12726607
  misc_feature (1)..(1945): Also known as  Ceres CDNA ID no. 23372771
caatcggaagatagaagtttcccaaaacttatcaaatctctgtgtatcgctcgccgacgaggcaggaaggacgaccaattgagacgttgacccttaatccgatttgaacaatctctctctctctctctctctctctctcttggtcgagattcataaaagtctcttctttcgtcttcttcgatctcggataatcacaaagtttatcttcttctttcttttttaaaaataaaatcagagagcagatcttgcgaatggatagcagttactctgtcatttccaaaacttcttacgttgagttacagaaaccgacggttaatgggaaacccagaaacaagttgcttccttctgatgaagaaagcttcgtcaatgattttgacgatgcccgtaatggtgttgggggtgaagatgctgatgatctcgatttcgatgtcgctgattacccactcgttcatggcaaatcatccaatcaaggatctgggatttacggtgctgttttcaatctcaccacttctattatcggcgccgggatcatggcattgcccgccaccatgaaagttctcggcttggttctagggtttgttttgattatcctcatggctcttttgtctgagattagtgttgagcttctggttagattttctgttctttacaagtccaaatcctacggcgaggttgttcaattcgctttggggaaaaccgctagggttttgtctgagatttgtatcattgtcaacaatggtggcgttctcgttgtttacttgattattatgggcgatgttatgtctggttctctccatcacattggggttttggatcaatggttagggaatgggttctgggatcaccgtaaagtgttgattttgattgttatggtcatcttcttggctcctctctgtgctttgaacaagattgattccttgagcgttacatcagctgcttctgttgctcttgctgttgtctttgtggttgtctgttttgttgtcgccaccatcaagcttatcgaaggaactatcgaccctccaaggttgtctcctgactttggttccaaacaagcaattttggaccttcttgtggtcattccgattatgtcaaacgcatacgtttgtcacttcaatgttcagccgatatacaacgagcttgaaggtcgatcacctcataagatgaaccgagttgggagaatcacaacagccatttgtgttgttgtctacgcttcaactgctgtatcgggttatctcctcttcggcaaggacaccgaatcagatatcttgaccaactttgatcaagatctcggtatccggttcagctctgcggtgaattacattgtcagaatcggctacattcttcatctagttctcgtcttccctgtgatccatttctccttgagagaaaccgtcaataccttactgtttgaaggctcgcctcctctatccgaaagcaaaaagagatctttgggactcactgtggtcttgctggctcttatttacattggctcaacgatgataccaaacatatggactgctttcaaattcacaggcgcaacatcagctgtttcacttggttttacattccctgctctgatcgcattgcggttagggaaacagagcaattcgttaagcttcgtggaaagatcagtgtcatggctgatgctaatcttggccgtagtggttagcattgttggaaccattggcaacatttacagcctcgagagcaaatcagattgatacttatagcagttttccaggatcttgtagatttatatagtcagagattctcagtccaataccgaaccggaaatcttcagcgactgctacatgcacctttaggatgtcgatcaatggcgtttgttcaggctaagcctaaagatttccggtttgtgaattatatgtatacagacacctgattcttatgattttattatatatacgcattttttttctgtttttct

SEQ ID NO: 1972 - protein, 1945 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
CAATCGGAAGATAGAAGTTTCCCAAAACTTATCAAATCTCTGTGTATCGCTCGCCGACGAGGCAGGAAGGACGACCAATTGAGACGTTGACCCTTAATCCGATTTGAACAATCTCTCTCTCTCTCTCTCTCTCTCTCTCTTGGTCGAGATTCATAAAAGTCTCTTCTTTCGTCTTCTTCGATCTCGGATAATCACAAAGTTTATCTTCTTCTTTCTTTTTTAAAAATAAAATCAGAGAGCAGATCTTGCGAATGGATAGCAGTTACTCTGTCATTTCCAAAACTTCTTACGTTGAGTTACAGAAACCGACGGTTAATGGGAAACCCAGAAACAAGTTGCTTCCTTCTGATGAAGAAAGCTTCGTCAATGATTTTGACGATGCCCGTAATGGTGTTGGGGGTGAAGATGCTGATGATCTCGATTTCGATGTCGCTGATTACCCACTCGTTCATGGCAAATCATCCAATCAAGGATCTGGGATTTACGGTGCTGTTTTCAATCTCACCACTTCTATTATCGGCGCCGGGATCATGGCATTGCCCGCCACCATGAAAGTTCTCGGCTTGGTTCTAGGGTTTGTTTTGATTATCCTCATGGCTCTTTTGTCTGAGATTAGTGTTGAGCTTCTGGTTAGATTTTCTGTTCTTTACAAGTCCAAATCCTACGGCGAGGTTGTTCAATTCGCTTTGGGGAAAACCGCTAGGGTTTTGTCTGAGATTTGTATCATTGTCAACAATGGTGGCGTTCTCGTTGTTTACTTGATTATTATGGGCGATGTTATGTCTGGTTCTCTCCATCACATTGGGGTTTTGGATCAATGGTTAGGGAATGGGTTCTGGGATCACCGTAAAGTGTTGATTTTGATTGTTATGGTCATCTTCTTGGCTCCTCTCTGTGCTTTGAACAAGATTGATTCCTTGAGCGTTACATCAGCTGCTTCTGTTGCTCTTGCTGTTGTCTTTGTGGTTGTCTGTTTTGTTGTCGCCACCATCAAGCTTATCGAAGGAACTATCGACCCTCCAAGGTTGTCTCCTGACTTTGGTTCCAAACAAGCAATTTTGGACCTTCTTGTGGTCATTCCGATTATGTCAAACGCATACGTTTGTCACTTCAATGTTCAGCCGATATACAACGAGCTTGAAGGTCGATCACCTCATAAGATGAACCGAGTTGGGAGAATCACAACAGCCATTTGTGTTGTTGTCTACGCTTCAACTGCTGTATCGGGTTATCTCCTCTTCGGCAAGGACACCGAATCAGATATCTTGACCAACTTTGATCAAGATCTCGGTATCCGGTTCAGCTCTGCGGTGAATTACATTGTCAGAATCGGCTACATTCTTCATCTAGTTCTCGTCTTCCCTGTGATCCATTTCTCCTTGAGAGAAACCGTCAATACCTTACTGTTTGAAGGCTCGCCTCCTCTATCCGAAAGCAAAAAGAGATCTTTGGGACTCACTGTGGTCTTGCTGGCTCTTATTTACATTGGCTCAACGATGATACCAAACATATGGACTGCTTTCAAATTCACAGGCGCAACATCAGCTGTTTCACTTGGTTTTACATTCCCTGCTCTGATCGCATTGCGGTTAGGGAAACAGAGCAATTCGTTAAGCTTCGTGGAAAGATCAGTGTCATGGCTGATGCTAATCTTGGCCGTAGTGGTTAGCATTGTTGGAACCATTGGCAACATTTACAGCCTCGAGAGCAAATCAGATTGATACTTATAGCAGTTTTCCAGGATCTTGTAGATTTATATAGTCAGAGATTCTCAGTCCAATACCGAACCGGAAATCTTCAGCGACTGCTACATGCACCTTTAGGATGTCGATCAATGGCGTTTGTTCAGGCTAAGCCTAAAGATTTCCGGTTTGTGAATTATATGTATACAGACACCTGATTCTTATGATTTTATTATATATACGCATTTTTTTTCTGTTTTTCT

SEQ ID NO: 1973 - DNA, 831 bp, Arabidopsis thaliana
  misc_feature (1)..(831): Ceres cDNA ID no. 12726808
  misc_feature (1)..(831): Also known as  Ceres CDNA ID no. 23372771
atgggatcagcgatggtttctcatatcctcgccgcaggctattcagtcaccgtttatgctcgcgatcttcgtaaaacaaaggatctgcaaaccaaaggaggtcgtaccgccaatagccccaaagagttaggggagatgagcgacgttgtgttcacgatcgttggaaactctaacgatgttagatcgttgcttcttggggatgatggtgtactctctggtcttaaacccggtggagtaacagtggacatgactagtagcaagccaggattggcgcgtgagatatacgcggaggcgaggcggagggattgctgggcggtggatgcgcctgtatcgggtggagacgctggagcacgtgaggggaagctaacgatattcgccggcggagattccgagattgtggagtggttggctccggtgatgaaaacgatgggaattgtgaggtttatgggaggagctgggagtggacagagctgtaaaattgggaatcagatttgtgttggaagcaacatgattggattagctgaagggattgtgtttgctgagaaggcgggtttagatccggtgaaatggcttgaggcggttaaggacggtgcagctggatcggcggttatgcggcttttcggggagatgatggcggtgagggactataaggcgacggggtttgcggagtatatggtgaaagatttgggaatggcggcggaggcggcaatggcgatgcctggaactgctttgaacaagcagttgttcactgtaatggtggcaaatggagatgggaagttaggatttcaaggcgtcgtcgatgttattaggagacttaacggcttatcctga

SEQ ID NO: 1974 - protein, 831 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGGGATCAGCGATGGTTTCTCATATCCTCGCCGCAGGCTATTCAGTCACCGTTTATGCTCGCGATCTTCGTAAAACAAAGGATCTGCAAACCAAAGGAGGTCGTACCGCCAATAGCCCCAAAGAGTTAGGGGAGATGAGCGACGTTGTGTTCACGATCGTTGGAAACTCTAACGATGTTAGATCGTTGCTTCTTGGGGATGATGGTGTACTCTCTGGTCTTAAACCCGGTGGAGTAACAGTGGACATGACTAGTAGCAAGCCAGGATTGGCGCGTGAGATATACGCGGAGGCGAGGCGGAGGGATTGCTGGGCGGTGGATGCGCCTGTATCGGGTGGAGACGCTGGAGCACGTGAGGGGAAGCTAACGATATTCGCCGGCGGAGATTCCGAGATTGTGGAGTGGTTGGCTCCGGTGATGAAAACGATGGGAATTGTGAGGTTTATGGGAGGAGCTGGGAGTGGACAGAGCTGTAAAATTGGGAATCAGATTTGTGTTGGAAGCAACATGATTGGATTAGCTGAAGGGATTGTGTTTGCTGAGAAGGCGGGTTTAGATCCGGTGAAATGGCTTGAGGCGGTTAAGGACGGTGCAGCTGGATCGGCGGTTATGCGGCTTTTCGGGGAGATGATGGCGGTGAGGGACTATAAGGCGACGGGGTTTGCGGAGTATATGGTGAAAGATTTGGGAATGGCGGCGGAGGCGGCAATGGCGATGCCTGGAACTGCTTTGAACAAGCAGTTGTTCACTGTAATGGTGGCAAATGGAGATGGGAAGTTAGGATTTCAAGGCGTCGTCGATGTTATTAGGAGACTTAACGGCTTATCCTGA

SEQ ID NO: 1975 - DNA, 957 bp, Arabidopsis thaliana
  misc_feature (1)..(957): Ceres cDNA ID no. 12726819
  misc_feature (1)..(957): Also known as  Ceres CDNA ID no. 23372771
atgttctaccaatcgtcgtcgtctctcacgcaaattcttcattcgttctgtggaaacacagaaatggagactccatatccgaaactcatcgatccttcaaagactcgaataggatggattggcatcgggataatgggatcggccatggtttctcatattatcgccgcaggctattctgtcacagtttacgctcgcgacctccggaaaacaaaagatctgcaaaccaaaggagctcgcatagccaatagccccaaagagttagcggagatgagcgacgttgtgttcacgattgttggaaacttcaacgatgtccgatcattgcttctcggtgacgatggtgtactctctggtcttacgcccggtggagtaacagtggacatgactagtagcaaaccaggattggcgcgtgaaatacacgcagaagcgaggcgtaggaattgttgggcggtggatgcgccggtatcaggtggagacgctggagcacgagaggggacgttagggattttcgccggcggagattcagagattgtggagtggttgtccccggtgatgaagaatatagggactgttacttatatgggagaagcagggagtgggcaaagctgcaagatagggaatcagattgctggtgcgagcaacctggttggacttgctgaagggatagtgttcgctgagaaagcgggtttagatacagtgaaatggctcgaggcggtgaaggatggtgcagctggatcggcggttatgcggctgtttggggagatgattgtgaagagggattatagggcgactggctttgcggagtatatggtgaaagatttgggaatggctgcagaggcggcgatgcctggtgctgctctgagcaagcagttgttcactggaatggtggctaatggagatggcaagttaggtattcaaggcgtcgtctctgttattagaagacttaacggcatatcctga

SEQ ID NO: 1976 - protein, 957 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGTTCTACCAATCGTCGTCGTCTCTCACGCAAATTCTTCATTCGTTCTGTGGAAACACAGAAATGGAGACTCCATATCCGAAACTCATCGATCCTTCAAAGACTCGAATAGGATGGATTGGCATCGGGATAATGGGATCGGCCATGGTTTCTCATATTATCGCCGCAGGCTATTCTGTCACAGTTTACGCTCGCGACCTCCGGAAAACAAAAGATCTGCAAACCAAAGGAGCTCGCATAGCCAATAGCCCCAAAGAGTTAGCGGAGATGAGCGACGTTGTGTTCACGATTGTTGGAAACTTCAACGATGTCCGATCATTGCTTCTCGGTGACGATGGTGTACTCTCTGGTCTTACGCCCGGTGGAGTAACAGTGGACATGACTAGTAGCAAACCAGGATTGGCGCGTGAAATACACGCAGAAGCGAGGCGTAGGAATTGTTGGGCGGTGGATGCGCCGGTATCAGGTGGAGACGCTGGAGCACGAGAGGGGACGTTAGGGATTTTCGCCGGCGGAGATTCAGAGATTGTGGAGTGGTTGTCCCCGGTGATGAAGAATATAGGGACTGTTACTTATATGGGAGAAGCAGGGAGTGGGCAAAGCTGCAAGATAGGGAATCAGATTGCTGGTGCGAGCAACCTGGTTGGACTTGCTGAAGGGATAGTGTTCGCTGAGAAAGCGGGTTTAGATACAGTGAAATGGCTCGAGGCGGTGAAGGATGGTGCAGCTGGATCGGCGGTTATGCGGCTGTTTGGGGAGATGATTGTGAAGAGGGATTATAGGGCGACTGGCTTTGCGGAGTATATGGTGAAAGATTTGGGAATGGCTGCAGAGGCGGCGATGCCTGGTGCTGCTCTGAGCAAGCAGTTGTTCACTGGAATGGTGGCTAATGGAGATGGCAAGTTAGGTATTCAAGGCGTCGTCTCTGTTATTAGAAGACTTAACGGCATATCCTGA

SEQ ID NO: 1977 - DNA, 585 bp, Arabidopsis thaliana
  misc_feature (1)..(585): Ceres cDNA ID no. 12727180
  misc_feature (1)..(585): Also known as  Ceres CDNA ID no. 23372771
atgaatatctctcaaaaccctagccctaattttacgtacttctccgatgaaaactttattaatccgtttatggataacaacgatttctcaaatttgatgttctttgacatagatgaaggaggtaacaatggattaatcgaggaagagatctcatctccgacaagcatcgtttcgtcggagacatttaccggggaaagcggcggatccggcagcgcaacaacgttgagtaaaaaggaatcaactaatagaggaagtaaagagagtgatcagacgaaggagacgggtcatcgagttgcatttagaacgagatcgaagattgatgtgatggatgatggttttaaatggaggaagtatggcaagaaatctgtcaaaaacaacattaacaagaggaattactacaaatgctcaagtgaaggttgctcggtgaagaagagggtagagagagatggtgacgatgcagcttatgtaattacaacatatgaaggagtccataaccatgagagtctctctaatgtctattacaatgaaatggttttatcttatgatcatgataactggaaccaacactctcttcttcgatcttaa

SEQ ID NO: 1978 - protein, 585 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGAATATCTCTCAAAACCCTAGCCCTAATTTTACGTACTTCTCCGATGAAAACTTTATTAATCCGTTTATGGATAACAACGATTTCTCAAATTTGATGTTCTTTGACATAGATGAAGGAGGTAACAATGGATTAATCGAGGAAGAGATCTCATCTCCGACAAGCATCGTTTCGTCGGAGACATTTACCGGGGAAAGCGGCGGATCCGGCAGCGCAACAACGTTGAGTAAAAAGGAATCAACTAATAGAGGAAGTAAAGAGAGTGATCAGACGAAGGAGACGGGTCATCGAGTTGCATTTAGAACGAGATCGAAGATTGATGTGATGGATGATGGTTTTAAATGGAGGAAGTATGGCAAGAAATCTGTCAAAAACAACATTAACAAGAGGAATTACTACAAATGCTCAAGTGAAGGTTGCTCGGTGAAGAAGAGGGTAGAGAGAGATGGTGACGATGCAGCTTATGTAATTACAACATATGAAGGAGTCCATAACCATGAGAGTCTCTCTAATGTCTATTACAATGAAATGGTTTTATCTTATGATCATGATAACTGGAACCAACACTCTCTTCTTCGATCTTAA

SEQ ID NO: 1979 - DNA, 1845 bp, Arabidopsis thaliana
  misc_feature (1)..(1845): Ceres cDNA ID no. 12727449
  misc_feature (1)..(1845): Also known as  Ceres CDNA ID no. 23372771
atgggatttggagtaggtggtggaggtggtagaatgttggatttgaggattgtccaaaatcacaagcgttcaaagagtgccagctttccagaaaagaaaagagttgaaggagataaaacctcaaatagttctcatgaagcctctcaacgaatgaagctggacatgggacgttcaaatgaatcaaagcataatcaatatcattcaaacacggagacttcattgaagcaagagattactcacctcgagacaagattacaagatcagtttaaggttcgttgtgcattagagaaagccttaggttatcgaacagcatcttcttacgtactgactgaaacaaacgacattgccatgcctaagccagctactgatttaatcaaagacgttgcggtgctcgaaatggaagttatacatttggaacagtatcttctttcattatacagaaaagcctttgagcagcaaatctcttctgtatctccaaatttagagaacaagaagccaaaatctcctcctgttacaacccctagaaggcgtctagacttttctgaagatgatgataccccctcgaaaacagatcaacacacagttcctctgcttgatgataatcaaaatcaatcaaagaaaacagagattgctgcggttgaccgagaccagatggaccccagttttcgccgtagtcactctcaacgttcggcatttgggagtagaaaagcttctcccgaagattcttggggtaaagccagccgctcttgtcactcacagccactgtatgtgcagaatggagataacctaatcagtctagctgaacatcttggcacccgaatctcggatcatgttccagaaacacccaacaagttatctgaaggaatggtcaagtgcatgtcagaaatatactgcaagcttgcagagccaccttctgtgctacatcgtgggctttcatctccaaactcgtctttatcatcaagtgcattttcgccctctgaccaatacgatacatcgagccctggattcggaaacagctcctcttttgatgttcggctagataactctttccatgtagaaggagaaaaggacttcagtggaccttacagcagcattgttgaagtgctttgcatttacagagacgccaaaaaggccagtgaggtggaagatcttctgcaaaacttcaagtcacttattagtagattggaggaagtcgatccaaggaagttgaaacatgaagagaagctagcgttttggataaatgtgcacaatgcacttgtgatgcatgcgtttttagcttatgggattccacagaacaatgtgaagagagtcttacttctactcaaggctgcatataacattggtggacacacaattagcgccgaagcgatacaaagttcgattcttgggtgcaaaatgtctcatcctggacagtggcttagactactatttgcttcgaggaaattcaaagcaggggatgaaagattagcttatgcaatcgatcatcctgagcctctcctgcattttgcacttacttcaggcagccactccgatcccgcggttcgtgtatatacaccgaaaagaatccagcaagagcttgaaacgtcgaaagaagagtacataagaatgaacttaagcatacgcaagcagagaatcctattgccaaagcttgtggagacgtttgcaaaagactccggtttatgtccggcgggtttgacagagatggttaaccggagtataccggagtcttcaaggaaatgtgtaaagagatgtcaatctagtactagtaaaccacgaaagacaattgattggatccctcacagctttacatttagatatcttattcttagagaagctgccaaatga

SEQ ID NO: 1980 - protein, 1845 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGGGATTTGGAGTAGGTGGTGGAGGTGGTAGAATGTTGGATTTGAGGATTGTCCAAAATCACAAGCGTTCAAAGAGTGCCAGCTTTCCAGAAAAGAAAAGAGTTGAAGGAGATAAAACCTCAAATAGTTCTCATGAAGCCTCTCAACGAATGAAGCTGGACATGGGACGTTCAAATGAATCAAAGCATAATCAATATCATTCAAACACGGAGACTTCATTGAAGCAAGAGATTACTCACCTCGAGACAAGATTACAAGATCAGTTTAAGGTTCGTTGTGCATTAGAGAAAGCCTTAGGTTATCGAACAGCATCTTCTTACGTACTGACTGAAACAAACGACATTGCCATGCCTAAGCCAGCTACTGATTTAATCAAAGACGTTGCGGTGCTCGAAATGGAAGTTATACATTTGGAACAGTATCTTCTTTCATTATACAGAAAAGCCTTTGAGCAGCAAATCTCTTCTGTATCTCCAAATTTAGAGAACAAGAAGCCAAAATCTCCTCCTGTTACAACCCCTAGAAGGCGTCTAGACTTTTCTGAAGATGATGATACCCCCTCGAAAACAGATCAACACACAGTTCCTCTGCTTGATGATAATCAAAATCAATCAAAGAAAACAGAGATTGCTGCGGTTGACCGAGACCAGATGGACCCCAGTTTTCGCCGTAGTCACTCTCAACGTTCGGCATTTGGGAGTAGAAAAGCTTCTCCCGAAGATTCTTGGGGTAAAGCCAGCCGCTCTTGTCACTCACAGCCACTGTATGTGCAGAATGGAGATAACCTAATCAGTCTAGCTGAACATCTTGGCACCCGAATCTCGGATCATGTTCCAGAAACACCCAACAAGTTATCTGAAGGAATGGTCAAGTGCATGTCAGAAATATACTGCAAGCTTGCAGAGCCACCTTCTGTGCTACATCGTGGGCTTTCATCTCCAAACTCGTCTTTATCATCAAGTGCATTTTCGCCCTCTGACCAATACGATACATCGAGCCCTGGATTCGGAAACAGCTCCTCTTTTGATGTTCGGCTAGATAACTCTTTCCATGTAGAAGGAGAAAAGGACTTCAGTGGACCTTACAGCAGCATTGTTGAAGTGCTTTGCATTTACAGAGACGCCAAAAAGGCCAGTGAGGTGGAAGATCTTCTGCAAAACTTCAAGTCACTTATTAGTAGATTGGAGGAAGTCGATCCAAGGAAGTTGAAACATGAAGAGAAGCTAGCGTTTTGGATAAATGTGCACAATGCACTTGTGATGCATGCGTTTTTAGCTTATGGGATTCCACAGAACAATGTGAAGAGAGTCTTACTTCTACTCAAGGCTGCATATAACATTGGTGGACACACAATTAGCGCCGAAGCGATACAAAGTTCGATTCTTGGGTGCAAAATGTCTCATCCTGGACAGTGGCTTAGACTACTATTTGCTTCGAGGAAATTCAAAGCAGGGGATGAAAGATTAGCTTATGCAATCGATCATCCTGAGCCTCTCCTGCATTTTGCACTTACTTCAGGCAGCCACTCCGATCCCGCGGTTCGTGTATATACACCGAAAAGAATCCAGCAAGAGCTTGAAACGTCGAAAGAAGAGTACATAAGAATGAACTTAAGCATACGCAAGCAGAGAATCCTATTGCCAAAGCTTGTGGAGACGTTTGCAAAAGACTCCGGTTTATGTCCGGCGGGTTTGACAGAGATGGTTAACCGGAGTATACCGGAGTCTTCAAGGAAATGTGTAAAGAGATGTCAATCTAGTACTAGTAAACCACGAAAGACAATTGATTGGATCCCTCACAGCTTTACATTTAGATATCTTATTCTTAGAGAAGCTGCCAAATGA

SEQ ID NO: 1981 - DNA, 1518 bp, Arabidopsis thaliana
  misc_feature (1)..(1518): Ceres cDNA ID no. 12728436
  misc_feature (1)..(1518): Also known as  Ceres CDNA ID no. 23372771
atggctccttcgtcttcatcttctccttccaaatctcctgttccatctcttcaccaatcccttcacttcactcctattctagaatgtgaagaagacgacctccaagaagaaagatacaaaaacagagcaacaccaagcagcgacggtggttcttccgccacaccaaaccaccagcaccaccgccgtaccaacagcaacaacaaccaccagcacactctaacacctctccaccacaacggcaaaccccaaaccagaaaacgacatgacgacaacgacgaagacgatggtggtgccgtatcctgcaacaagtgtcgacctcaccactctcaccgtgacaaattctccgtcgtacctctcgaaagccacaacaacccttctttcatctctagccccaatctcataatcaaatccatcttccaatctctcacacggagaagccccaaaccttcctctgcaacggcggcgcttccaccgcgctcttcctcatcctccgccgcagatgcttctagagaagaacagtggcggttagctgtggcggagctttctcataaactgattcaagccacgaagaagaaagaagacgcggttatagaagcttctaggttgaaatcatccatggcagagctagagaagaaactcaataaactcgagatttactgtcacaatctcaaatcaggtctcgacgaatgcagcaacaaaaaacagagtgttccgattcgaaaagacggattcaacgacaggatcattcagcagtttctcgtctctgtgtcggaatctcgttcttcgatcagagctttaagtagatctctcgcctcgcagctacgaaccgtcggtggcaaagtttacgagagactctctcttcttcttcaacctttcgatgtaaagatcaactcttttgccaaaaaccctaaaagtctgatcttttacctcgaagcgattctgagcagagccttcttcgaggatttcgaagctcctgggtttcagaaaaacgggtcgacccggattttgaatccaattgatcgttgtgaatccaattacgcttcgtttaacgtcttgatggagctgacgtgggatgaggtgttgagcagaggaacgaagcatttctcggaggagtttagccgtttctgtgaccggaagatgagtgacgtcgtttcgatgcttagctggaaccgtgcctggcctgaaccgcttttacaggctttctttggtgcgtcaaagagtgtttggttggttcatcttttggctaattcagtgaacccggggttgcaaatctttcgtgtggagaaagatgaccggtttgatccgatttacatggaggaaaccggtggggaacggtttaagagtctggttagagctatggttcagcccgggttttatgtctatgggagtgtggttaagtgcaaggtggtttgcaagcaatgcggcagcgatgaggaagaactagaagaccatacggtcaaagaatgtaataaaaacgacaagagtttaataagcatttgtagcccattaggaggttaa

SEQ ID NO: 1982 - protein, 1518 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGGCTCCTTCGTCTTCATCTTCTCCTTCCAAATCTCCTGTTCCATCTCTTCACCAATCCCTTCACTTCACTCCTATTCTAGAATGTGAAGAAGACGACCTCCAAGAAGAAAGATACAAAAACAGAGCAACACCAAGCAGCGACGGTGGTTCTTCCGCCACACCAAACCACCAGCACCACCGCCGTACCAACAGCAACAACAACCACCAGCACACTCTAACACCTCTCCACCACAACGGCAAACCCCAAACCAGAAAACGACATGACGACAACGACGAAGACGATGGTGGTGCCGTATCCTGCAACAAGTGTCGACCTCACCACTCTCACCGTGACAAATTCTCCGTCGTACCTCTCGAAAGCCACAACAACCCTTCTTTCATCTCTAGCCCCAATCTCATAATCAAATCCATCTTCCAATCTCTCACACGGAGAAGCCCCAAACCTTCCTCTGCAACGGCGGCGCTTCCACCGCGCTCTTCCTCATCCTCCGCCGCAGATGCTTCTAGAGAAGAACAGTGGCGGTTAGCTGTGGCGGAGCTTTCTCATAAACTGATTCAAGCCACGAAGAAGAAAGAAGACGCGGTTATAGAAGCTTCTAGGTTGAAATCATCCATGGCAGAGCTAGAGAAGAAACTCAATAAACTCGAGATTTACTGTCACAATCTCAAATCAGGTCTCGACGAATGCAGCAACAAAAAACAGAGTGTTCCGATTCGAAAAGACGGATTCAACGACAGGATCATTCAGCAGTTTCTCGTCTCTGTGTCGGAATCTCGTTCTTCGATCAGAGCTTTAAGTAGATCTCTCGCCTCGCAGCTACGAACCGTCGGTGGCAAAGTTTACGAGAGACTCTCTCTTCTTCTTCAACCTTTCGATGTAAAGATCAACTCTTTTGCCAAAAACCCTAAAAGTCTGATCTTTTACCTCGAAGCGATTCTGAGCAGAGCCTTCTTCGAGGATTTCGAAGCTCCTGGGTTTCAGAAAAACGGGTCGACCCGGATTTTGAATCCAATTGATCGTTGTGAATCCAATTACGCTTCGTTTAACGTCTTGATGGAGCTGACGTGGGATGAGGTGTTGAGCAGAGGAACGAAGCATTTCTCGGAGGAGTTTAGCCGTTTCTGTGACCGGAAGATGAGTGACGTCGTTTCGATGCTTAGCTGGAACCGTGCCTGGCCTGAACCGCTTTTACAGGCTTTCTTTGGTGCGTCAAAGAGTGTTTGGTTGGTTCATCTTTTGGCTAATTCAGTGAACCCGGGGTTGCAAATCTTTCGTGTGGAGAAAGATGACCGGTTTGATCCGATTTACATGGAGGAAACCGGTGGGGAACGGTTTAAGAGTCTGGTTAGAGCTATGGTTCAGCCCGGGTTTTATGTCTATGGGAGTGTGGTTAAGTGCAAGGTGGTTTGCAAGCAATGCGGCAGCGATGAGGAAGAACTAGAAGACCATACGGTCAAAGAATGTAATAAAAACGACAAGAGTTTAATAAGCATTTGTAGCCCATTAGGAGGTTAA

SEQ ID NO: 1983 - DNA, 1970 bp, Arabidopsis thaliana
  misc_feature (1)..(1970): Ceres cDNA ID no. 12728465
  misc_feature (1)..(1970): Also known as  Ceres CDNA ID no. 23372771
gagagaggactgggtctggtctcttcgctgcaacctatagctgttgtttgctcttcgacgggattctcactactcttttgccaaaaaaaagagatcggaggttccgaaggtgaatgcagcttgcgatttcatagaaaagaagattcgtttgctggattaggcttatttgtgtatcatagctttgaggttttaactgagatttattgatagtggaacttaggttttcgagaggtgtgaacagttgggtatatgggtatggacatagctgataaggagaatacgagcccgcttttatttgaattctgcaattgctataaagttgcaagccttactgaaaccattctaaaccctgtaaatgtttccaacttaaaagatagatatgtacttggagaacagttaggctggggtcagtttggtgtgataagagtatgttctgataagttaactggagagaggcttgcttgtaagtctatatctaaagacagactggtaacacaagatgacatgaagagtatcaaactcgagattgcgataatggccaagttagctgggcacccaaatgtggtgaatctcaaagcagtttacgaggagaaagattctgtgcatcttgtgatggaactatgcgcaggcggtgagctttttcacaagctcgagaaatatggaaggtattctgaggttcgtgctagggtgctcttcaagcacttgatgcaagtggtcaagttttgtcatgatagcggtattgttcacagagatttgaaaccggaaaacattcttatggccacaatgtcttcttcgtctcctatcaaattggctgattttggactggcaacctatataaagcctggcgaaaagctgagcggaacagttggtagtccgttttatatagccccggaagtgttagcagggggatataaccaagctgctgatgtatggagtgcaggggttattttgtatattcttctcagtggagcgccgcccttttggggaaagactaagtcaaagatttttgatgctgtcagggctgccgatttgagattttctgcagagccatgggacaatataacttcatacgccaaggatttgattcgcgggatgctttgtgtggatccttcccaaaggttatcagctgacgaagttctagctcactcttggatggagcagttatctgaatcaggtcaagaacaatatgatcaggatgggtttggttgtgaaggattggagaatgggggatgttctttctccacacaatgcgtttctcgggaacaagactatagctttagcgttggccagttagagcaatcaacagataacgattttaaatcatcgttctcgacattcctacctgcggataacacactgccaaattccggttttgatgggttttcttttgatgggaaacaaccggaatcaaccacagctggcttctcatcaactggaattccctctatgccaagctttacctttttttgtacaagcccagcaaggacacagaacaacgacataactgaaatagatggaaaagttcgagactcaagcccaaagaggttactgccttcaccagattcttcttcacaacttgagaggcgtgatgaagcaggggagaatcagacagaagcaggaggaaagtcagagacaagaagggaaagaggaaactggtcaagaatgtcaggtctacacagcaaaaggaacagaacaataggactaggcgagctagaccagttggtggtggatgttgcagtcacagagtcgataatcagatgggcatcttgcacgcatattcccaccgctccatctctcagattgtcgctcgtctgctagaagaagaaaacgaagaagacaactgttatcagtaaaatattgtatgtacacatctgattttgtccctgcaatgtctttgtttttgtagtaaaacttttccatggaaactgacctcaactgtataaaccaacggaaatagagtgtgattttga

SEQ ID NO: 1984 - protein, 1970 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
GAGAGAGGACTGGGTCTGGTCTCTTCGCTGCAACCTATAGCTGTTGTTTGCTCTTCGACGGGATTCTCACTACTCTTTTGCCAAAAAAAAGAGATCGGAGGTTCCGAAGGTGAATGCAGCTTGCGATTTCATAGAAAAGAAGATTCGTTTGCTGGATTAGGCTTATTTGTGTATCATAGCTTTGAGGTTTTAACTGAGATTTATTGATAGTGGAACTTAGGTTTTCGAGAGGTGTGAACAGTTGGGTATATGGGTATGGACATAGCTGATAAGGAGAATACGAGCCCGCTTTTATTTGAATTCTGCAATTGCTATAAAGTTGCAAGCCTTACTGAAACCATTCTAAACCCTGTAAATGTTTCCAACTTAAAAGATAGATATGTACTTGGAGAACAGTTAGGCTGGGGTCAGTTTGGTGTGATAAGAGTATGTTCTGATAAGTTAACTGGAGAGAGGCTTGCTTGTAAGTCTATATCTAAAGACAGACTGGTAACACAAGATGACATGAAGAGTATCAAACTCGAGATTGCGATAATGGCCAAGTTAGCTGGGCACCCAAATGTGGTGAATCTCAAAGCAGTTTACGAGGAGAAAGATTCTGTGCATCTTGTGATGGAACTATGCGCAGGCGGTGAGCTTTTTCACAAGCTCGAGAAATATGGAAGGTATTCTGAGGTTCGTGCTAGGGTGCTCTTCAAGCACTTGATGCAAGTGGTCAAGTTTTGTCATGATAGCGGTATTGTTCACAGAGATTTGAAACCGGAAAACATTCTTATGGCCACAATGTCTTCTTCGTCTCCTATCAAATTGGCTGATTTTGGACTGGCAACCTATATAAAGCCTGGCGAAAAGCTGAGCGGAACAGTTGGTAGTCCGTTTTATATAGCCCCGGAAGTGTTAGCAGGGGGATATAACCAAGCTGCTGATGTATGGAGTGCAGGGGTTATTTTGTATATTCTTCTCAGTGGAGCGCCGCCCTTTTGGGGAAAGACTAAGTCAAAGATTTTTGATGCTGTCAGGGCTGCCGATTTGAGATTTTCTGCAGAGCCATGGGACAATATAACTTCATACGCCAAGGATTTGATTCGCGGGATGCTTTGTGTGGATCCTTCCCAAAGGTTATCAGCTGACGAAGTTCTAGCTCACTCTTGGATGGAGCAGTTATCTGAATCAGGTCAAGAACAATATGATCAGGATGGGTTTGGTTGTGAAGGATTGGAGAATGGGGGATGTTCTTTCTCCACACAATGCGTTTCTCGGGAACAAGACTATAGCTTTAGCGTTGGCCAGTTAGAGCAATCAACAGATAACGATTTTAAATCATCGTTCTCGACATTCCTACCTGCGGATAACACACTGCCAAATTCCGGTTTTGATGGGTTTTCTTTTGATGGGAAACAACCGGAATCAACCACAGCTGGCTTCTCATCAACTGGAATTCCCTCTATGCCAAGCTTTACCTTTTTTTGTACAAGCCCAGCAAGGACACAGAACAACGACATAACTGAAATAGATGGAAAAGTTCGAGACTCAAGCCCAAAGAGGTTACTGCCTTCACCAGATTCTTCTTCACAACTTGAGAGGCGTGATGAAGCAGGGGAGAATCAGACAGAAGCAGGAGGAAAGTCAGAGACAAGAAGGGAAAGAGGAAACTGGTCAAGAATGTCAGGTCTACACAGCAAAAGGAACAGAACAATAGGACTAGGCGAGCTAGACCAGTTGGTGGTGGATGTTGCAGTCACAGAGTCGATAATCAGATGGGCATCTTGCACGCATATTCCCACCGCTCCATCTCTCAGATTGTCGCTCGTCTGCTAGAAGAAGAAAACGAAGAAGACAACTGTTATCAGTAAAATATTGTATGTACACATCTGATTTTGTCCCTGCAATGTCTTTGTTTTTGTAGTAAAACTTTTCCATGGAAACTGACCTCAACTGTATAAACCAACGGAAATAGAGTGTGATTTTGA

SEQ ID NO: 1985 - DNA, 1620 bp, Arabidopsis thaliana
  misc_feature (1)..(1620): Ceres cDNA ID no. 12728556
  misc_feature (1)..(1620): Also known as  Ceres CDNA ID no. 23372771
gaaaaacaaaaatgacgatcttgctctgtttcttcttagtttcacttcttactatcgtatcatcaatctttcttaaacagaataaaacctcaaaattcaatcttcccccaagcccttcaagccttccgatcattggaaacttacaccatctcgcaggattgcctcacagatgttttcataagctctctatcaaatacggacccttggtctttcttcgtctcgggtctgttccggttgttgtgatctcatcgagtgaagcagctgaagcagttctcaaaaccaatgacttggaatgttgcagccgaccaaagacggtggggagcggaaaactctcttacggtttcaaagacatcactttcgcaccatacggtgagtattggcgagaagtgcgaaaactcgcggttatcgagctttttagctctaaaaaggttcaatctttcaggtatataagagaggaagaggtcgacttcgtggtcaagaaagtgtcagaatcagctttgaagcaatctcctgtggatttaagcaaaacctttttctccctcaccgctagtatcatttgtagagtcgccttaggacagaatttcaatgaaagcggctttgttatcgatcaagacaggatcgaagaacttgttaccgaatcagcagaagctctagggactttcactttctctgacttcttccctggtggacttggaagatttgtagattggttgtttcaacgacacaagaagatcaacaaagtctttaaggaacttgatgctttttatcagcatgtgattgatgatcacttgaagccagagggaagaaagaatcaagatattgtcaccttgattttggatatgatcgataaacaagaagattcagattctttcaaactcaacatggataatctcaaggcaattgtcatggatgtatttctcgcggggatagatacaagcgcggtaacaatgatttgggcgatgacagaacttattagaaaccctagagtgatgaagaaggctcaagaaagtattcgaaccactctgggtctcaagaaggaaagaatcactgaagaagatttaggcaaagttgagtatttgaaccacatactcaaggaaacttttaggttacacccggcacttccatttgtggtgccaagggaaacaatgtctcacatcaagatccaaggctatgatattccaccgaaaacacaaatccagcttaacgtgtggacgatcggacgtgaccctaagcgttggaatgaccctgaagaattcaaccctgaaaggtttgcaaatagctctgtagattttagaggacaacattttgacctattaccgtttggttctggtcgaaggatttgtcccggaatgccaatggcgattgctagtgtggaactagcattgatgaatttgctttattattttgattggagtatgcctgatgggactaaaggtgaagacattgatatggaagaagctggtaatatctctattgtcaagaaaatacctcttcaacttgtgcctgttcaacgttattgatgagcaataatataagctcgataacatggaaagtgtatgaagcaaaaaacataagattctttagattttgttgtgttatataagaaagaaatgttccaat

SEQ ID NO: 1986 - protein, 1620 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
GAAAAACAAAAATGACGATCTTGCTCTGTTTCTTCTTAGTTTCACTTCTTACTATCGTATCATCAATCTTTCTTAAACAGAATAAAACCTCAAAATTCAATCTTCCCCCAAGCCCTTCAAGCCTTCCGATCATTGGAAACTTACACCATCTCGCAGGATTGCCTCACAGATGTTTTCATAAGCTCTCTATCAAATACGGACCCTTGGTCTTTCTTCGTCTCGGGTCTGTTCCGGTTGTTGTGATCTCATCGAGTGAAGCAGCTGAAGCAGTTCTCAAAACCAATGACTTGGAATGTTGCAGCCGACCAAAGACGGTGGGGAGCGGAAAACTCTCTTACGGTTTCAAAGACATCACTTTCGCACCATACGGTGAGTATTGGCGAGAAGTGCGAAAACTCGCGGTTATCGAGCTTTTTAGCTCTAAAAAGGTTCAATCTTTCAGGTATATAAGAGAGGAAGAGGTCGACTTCGTGGTCAAGAAAGTGTCAGAATCAGCTTTGAAGCAATCTCCTGTGGATTTAAGCAAAACCTTTTTCTCCCTCACCGCTAGTATCATTTGTAGAGTCGCCTTAGGACAGAATTTCAATGAAAGCGGCTTTGTTATCGATCAAGACAGGATCGAAGAACTTGTTACCGAATCAGCAGAAGCTCTAGGGACTTTCACTTTCTCTGACTTCTTCCCTGGTGGACTTGGAAGATTTGTAGATTGGTTGTTTCAACGACACAAGAAGATCAACAAAGTCTTTAAGGAACTTGATGCTTTTTATCAGCATGTGATTGATGATCACTTGAAGCCAGAGGGAAGAAAGAATCAAGATATTGTCACCTTGATTTTGGATATGATCGATAAACAAGAAGATTCAGATTCTTTCAAACTCAACATGGATAATCTCAAGGCAATTGTCATGGATGTATTTCTCGCGGGGATAGATACAAGCGCGGTAACAATGATTTGGGCGATGACAGAACTTATTAGAAACCCTAGAGTGATGAAGAAGGCTCAAGAAAGTATTCGAACCACTCTGGGTCTCAAGAAGGAAAGAATCACTGAAGAAGATTTAGGCAAAGTTGAGTATTTGAACCACATACTCAAGGAAACTTTTAGGTTACACCCGGCACTTCCATTTGTGGTGCCAAGGGAAACAATGTCTCACATCAAGATCCAAGGCTATGATATTCCACCGAAAACACAAATCCAGCTTAACGTGTGGACGATCGGACGTGACCCTAAGCGTTGGAATGACCCTGAAGAATTCAACCCTGAAAGGTTTGCAAATAGCTCTGTAGATTTTAGAGGACAACATTTTGACCTATTACCGTTTGGTTCTGGTCGAAGGATTTGTCCCGGAATGCCAATGGCGATTGCTAGTGTGGAACTAGCATTGATGAATTTGCTTTATTATTTTGATTGGAGTATGCCTGATGGGACTAAAGGTGAAGACATTGATATGGAAGAAGCTGGTAATATCTCTATTGTCAAGAAAATACCTCTTCAACTTGTGCCTGTTCAACGTTATTGATGAGCAATAATATAAGCTCGATAACATGGAAAGTGTATGAAGCAAAAAACATAAGATTCTTTAGATTTTGTTGTGTTATATAAGAAAGAAATGTTCCAAT

SEQ ID NO: 1987 - DNA, 1170 bp, Arabidopsis thaliana
  misc_feature (1)..(1170): Ceres cDNA ID no. 12728599
  misc_feature (1)..(1170): Also known as  Ceres CDNA ID no. 23372771
atggacaaaagagaacgtgaagccttgtactctgcgattcaaggatttgttggtgattcttggaacggatctgctctctatcctgatccttgtggttggactccaattcagggtgtttcttgtgacatctacaatgacctgtggtatgtcacggatttgagtttagggcttatttatgaaaactcgcttccttgctcctcaagtcttcagataagaccagagttatttgagctcaagcatttaagatctctctccttcttcaactgctttatctctcccatggtgatagctaaagaggagttgtggacaaactttgcatctaacttagaatctctcgagtttagatccaatcccggtctcattggggaacttcctgaaacaattggaaatctcacaaagctgaagtctttagtggttctcgaaaatggatttagtggagagctacccgcgagtatctgcaacttaaagagactaaagaggctggttttcgcagggaactcgtttgcgggaatgatcccaaactgtttcaaagggttaaaagagctcttgatcttggatttgagccgcaactctttctcagggacattgcctacatcttttggagatttggtttcattgctcaagcttgacctaagcaataacctcttagaagggaacttacctcaagaactaggatttttgaagaatttgacacttttggacctgaggaacaacagattctctggtgggctgtccaagaatattgaaaatatccaatctctaacggaattagttttatctaacaatccaatgggtgaagaggatatggtgggaacaaattgggggaagatgagcaatttggtagttttggacttatccaaaatgggtttgagaggtgagattcctacaagtctaaccaacctgaagaggttaaggtttcttggtctgaacaacaacaatctaaccggttttgttccatcgaagaagcttgaagctttgccttgccttggtgctttatacatcaatggaaacaacctaacaggtgagcttagattctctacaaagttctatgagaagatgggaagaagatttaaagcttcaaagaatccaaatctgtgtcaacctttagagatggtaatgtcagaatctcataaacatttaagtcctcttggagtgaagccatgcacttaa

SEQ ID NO: 1988 - protein, 1170 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGGACAAAAGAGAACGTGAAGCCTTGTACTCTGCGATTCAAGGATTTGTTGGTGATTCTTGGAACGGATCTGCTCTCTATCCTGATCCTTGTGGTTGGACTCCAATTCAGGGTGTTTCTTGTGACATCTACAATGACCTGTGGTATGTCACGGATTTGAGTTTAGGGCTTATTTATGAAAACTCGCTTCCTTGCTCCTCAAGTCTTCAGATAAGACCAGAGTTATTTGAGCTCAAGCATTTAAGATCTCTCTCCTTCTTCAACTGCTTTATCTCTCCCATGGTGATAGCTAAAGAGGAGTTGTGGACAAACTTTGCATCTAACTTAGAATCTCTCGAGTTTAGATCCAATCCCGGTCTCATTGGGGAACTTCCTGAAACAATTGGAAATCTCACAAAGCTGAAGTCTTTAGTGGTTCTCGAAAATGGATTTAGTGGAGAGCTACCCGCGAGTATCTGCAACTTAAAGAGACTAAAGAGGCTGGTTTTCGCAGGGAACTCGTTTGCGGGAATGATCCCAAACTGTTTCAAAGGGTTAAAAGAGCTCTTGATCTTGGATTTGAGCCGCAACTCTTTCTCAGGGACATTGCCTACATCTTTTGGAGATTTGGTTTCATTGCTCAAGCTTGACCTAAGCAATAACCTCTTAGAAGGGAACTTACCTCAAGAACTAGGATTTTTGAAGAATTTGACACTTTTGGACCTGAGGAACAACAGATTCTCTGGTGGGCTGTCCAAGAATATTGAAAATATCCAATCTCTAACGGAATTAGTTTTATCTAACAATCCAATGGGTGAAGAGGATATGGTGGGAACAAATTGGGGGAAGATGAGCAATTTGGTAGTTTTGGACTTATCCAAAATGGGTTTGAGAGGTGAGATTCCTACAAGTCTAACCAACCTGAAGAGGTTAAGGTTTCTTGGTCTGAACAACAACAATCTAACCGGTTTTGTTCCATCGAAGAAGCTTGAAGCTTTGCCTTGCCTTGGTGCTTTATACATCAATGGAAACAACCTAACAGGTGAGCTTAGATTCTCTACAAAGTTCTATGAGAAGATGGGAAGAAGATTTAAAGCTTCAAAGAATCCAAATCTGTGTCAACCTTTAGAGATGGTAATGTCAGAATCTCATAAACATTTAAGTCCTCTTGGAGTGAAGCCATGCACTTAA

SEQ ID NO: 1989 - DNA, 2574 bp, Arabidopsis thaliana
  misc_feature (1)..(2574): Ceres cDNA ID no. 12729063
  misc_feature (1)..(2574): Also known as  Ceres CDNA ID no. 23372771
atggaaatggctaagaaagttggagaagttatagaaaaatcctgcgtagagaatgggatcacaaaggtctcatacttcgtttggcaatgcaatgagggagcagccaaggcagtattgaagggtgaagcagtatctcgtttcttgaccaatcatcaacctatctccactaggatggcaagcaccaacgttacagggcaatgcccgggtccaatgaaggctacctccaatggagccttccaaaacgaaagccctcttgatttcgcgcttcctcttatcatcctacaaatcgtcttggtggttgtgtttacaaggctcttagcttactttcttaagcctctcaaacagccccgagtcattgctgagatcattggagggatactgcttggaccttctgcactagggagaagcaaggcctatcttgacaccatcttcccaaagaagagcttgaccgttttagacacactcgccaacattggtcttctgtttttcttgttcctagttgggcttgagcttgactttgcagcaataaaaaaaactggaaagaaatcactattgatagccatagctgggatctcacttccttttatagtgggtgtaggcacatcttttgttctcagtgccaccataagcaaaggagtcgatcagcttccttttattgtcttcatgggtgttgccttatcaatcactgccttccctgtgcttgctcgtatactagctgagctaaagcttctaacaactgacattggacgtatggcaatgtctgcagcgggagtaaacgatgttgcagcttggatactccttgcgcttgctattgctctctcaggagatgggacttctcctcttgtatctgtttgggttcttctctgtggaactggattcgtgatctttgcagttgtggcaatcaaacctctgcttgcttatatggctagacgctgtcctgagggagagcctgtaaaggaactctatgtttgtgtcactctaaccgtggttttagcagcaagctttgtgacagacactattgggatacacgcgctgttcggggcgtttgtggtaggtatagtagctcctaaagaaggaccattttgcaggattttgactgagaagatagaggatcttgtttcggggcttcttctacctctgtattttgcggctagcggtctcaaaactgatgtaacaacgatcaggggagcacagtcatggggacttctagttcttgtcattctcaccacttgtttcgggaagattgtaggaacagttggttcctcgatgctctgcaaggttcctttcagagaagccgtgacacttggattccttatgaataccaaaggtttagtagagctcattgttcttaacattggcaaggaccggaaggtgctgaatgatcaagcatttgcgatcttagtcctaatggcattgttcacaaccttcatcacaactccaattgtgatgcttatttacaagcctgcaagaaaaggagcaccgtacaagcacagaaccatccaaagaaaagatcatgattctgagctaaggatacttgcttgcttccacagtacccgtaacatccccacattgatcaatctgatcgaatcatcaagaggaacaggcaaaaagggacgcctctgcgtttacgcgatgcatctgatggagctttctgaacggtcatcagcgatcgcgatggttcacaaagctcgaaacaatggtctcccaatctggaataagatcgagagatcaacggaccagatggtgattgccttcgaggcttaccagcatctacgagcagtagcggttagacccatgactgcaatctctggcctcagcagcatccacgaggacatatgcacaagcgcgcatcagaaacgagtagcgatgatactgcttccgtttcacaagcatcagagaatggacggagcgatggagtcaataggacataggttccatgaagtgaaccaacgggtcttgcaacgagctccttgctcagtcgggattcttgtggacagaggactcggaggaacctcacaggttgtagccagcgaagtggcttacaaagtcgtgattccattctttggaggcctcgacgaccgagaagctctcgcatacgggatgaaaatggtggaacatccaggaatcacactaactgtttacaaatttgtagctgcgagaggaacattgaagagattcgagaagagtgaacacgacgaaaaggagaaaaaagagaaagagactgacgaagagtttgtgagggagttgatgaatgatccaagaggaaatgagtcattggcttacgaggaaagagtcgttgagagcaaagacgatatcatcgcgacacttaaatcgatgagtaaatgcaatctcttcgtcgttggaagaaatgcagctgttgcatcgttggttaagagtacagactgtccagagttaggaccagttggacgcttgttgtcgtcatcagagttttccaccaccgcgtcggtgctcgtcgttcagggatatgatccagcagcagatacacgaccgctcgttgaggaagatgcagagtacgatcagtcttccagagatatttcagacttaactgcctga

SEQ ID NO: 1990 - protein, 2574 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGGAAATGGCTAAGAAAGTTGGAGAAGTTATAGAAAAATCCTGCGTAGAGAATGGGATCACAAAGGTCTCATACTTCGTTTGGCAATGCAATGAGGGAGCAGCCAAGGCAGTATTGAAGGGTGAAGCAGTATCTCGTTTCTTGACCAATCATCAACCTATCTCCACTAGGATGGCAAGCACCAACGTTACAGGGCAATGCCCGGGTCCAATGAAGGCTACCTCCAATGGAGCCTTCCAAAACGAAAGCCCTCTTGATTTCGCGCTTCCTCTTATCATCCTACAAATCGTCTTGGTGGTTGTGTTTACAAGGCTCTTAGCTTACTTTCTTAAGCCTCTCAAACAGCCCCGAGTCATTGCTGAGATCATTGGAGGGATACTGCTTGGACCTTCTGCACTAGGGAGAAGCAAGGCCTATCTTGACACCATCTTCCCAAAGAAGAGCTTGACCGTTTTAGACACACTCGCCAACATTGGTCTTCTGTTTTTCTTGTTCCTAGTTGGGCTTGAGCTTGACTTTGCAGCAATAAAAAAAACTGGAAAGAAATCACTATTGATAGCCATAGCTGGGATCTCACTTCCTTTTATAGTGGGTGTAGGCACATCTTTTGTTCTCAGTGCCACCATAAGCAAAGGAGTCGATCAGCTTCCTTTTATTGTCTTCATGGGTGTTGCCTTATCAATCACTGCCTTCCCTGTGCTTGCTCGTATACTAGCTGAGCTAAAGCTTCTAACAACTGACATTGGACGTATGGCAATGTCTGCAGCGGGAGTAAACGATGTTGCAGCTTGGATACTCCTTGCGCTTGCTATTGCTCTCTCAGGAGATGGGACTTCTCCTCTTGTATCTGTTTGGGTTCTTCTCTGTGGAACTGGATTCGTGATCTTTGCAGTTGTGGCAATCAAACCTCTGCTTGCTTATATGGCTAGACGCTGTCCTGAGGGAGAGCCTGTAAAGGAACTCTATGTTTGTGTCACTCTAACCGTGGTTTTAGCAGCAAGCTTTGTGACAGACACTATTGGGATACACGCGCTGTTCGGGGCGTTTGTGGTAGGTATAGTAGCTCCTAAAGAAGGACCATTTTGCAGGATTTTGACTGAGAAGATAGAGGATCTTGTTTCGGGGCTTCTTCTACCTCTGTATTTTGCGGCTAGCGGTCTCAAAACTGATGTAACAACGATCAGGGGAGCACAGTCATGGGGACTTCTAGTTCTTGTCATTCTCACCACTTGTTTCGGGAAGATTGTAGGAACAGTTGGTTCCTCGATGCTCTGCAAGGTTCCTTTCAGAGAAGCCGTGACACTTGGATTCCTTATGAATACCAAAGGTTTAGTAGAGCTCATTGTTCTTAACATTGGCAAGGACCGGAAGGTGCTGAATGATCAAGCATTTGCGATCTTAGTCCTAATGGCATTGTTCACAACCTTCATCACAACTCCAATTGTGATGCTTATTTACAAGCCTGCAAGAAAAGGAGCACCGTACAAGCACAGAACCATCCAAAGAAAAGATCATGATTCTGAGCTAAGGATACTTGCTTGCTTCCACAGTACCCGTAACATCCCCACATTGATCAATCTGATCGAATCATCAAGAGGAACAGGCAAAAAGGGACGCCTCTGCGTTTACGCGATGCATCTGATGGAGCTTTCTGAACGGTCATCAGCGATCGCGATGGTTCACAAAGCTCGAAACAATGGTCTCCCAATCTGGAATAAGATCGAGAGATCAACGGACCAGATGGTGATTGCCTTCGAGGCTTACCAGCATCTACGAGCAGTAGCGGTTAGACCCATGACTGCAATCTCTGGCCTCAGCAGCATCCACGAGGACATATGCACAAGCGCGCATCAGAAACGAGTAGCGATGATACTGCTTCCGTTTCACAAGCATCAGAGAATGGACGGAGCGATGGAGTCAATAGGACATAGGTTCCATGAAGTGAACCAACGGGTCTTGCAACGAGCTCCTTGCTCAGTCGGGATTCTTGTGGACAGAGGACTCGGAGGAACCTCACAGGTTGTAGCCAGCGAAGTGGCTTACAAAGTCGTGATTCCATTCTTTGGAGGCCTCGACGACCGAGAAGCTCTCGCATACGGGATGAAAATGGTGGAACATCCAGGAATCACACTAACTGTTTACAAATTTGTAGCTGCGAGAGGAACATTGAAGAGATTCGAGAAGAGTGAACACGACGAAAAGGAGAAAAAAGAGAAAGAGACTGACGAAGAGTTTGTGAGGGAGTTGATGAATGATCCAAGAGGAAATGAGTCATTGGCTTACGAGGAAAGAGTCGTTGAGAGCAAAGACGATATCATCGCGACACTTAAATCGATGAGTAAATGCAATCTCTTCGTCGTTGGAAGAAATGCAGCTGTTGCATCGTTGGTTAAGAGTACAGACTGTCCAGAGTTAGGACCAGTTGGACGCTTGTTGTCGTCATCAGAGTTTTCCACCACCGCGTCGGTGCTCGTCGTTCAGGGATATGATCCAGCAGCAGATACACGACCGCTCGTTGAGGAAGATGCAGAGTACGATCAGTCTTCCAGAGATATTTCAGACTTAACTGCCTGA

SEQ ID NO: 1991 - DNA, 1506 bp, Arabidopsis thaliana
  misc_feature (1)..(1506): Ceres cDNA ID no. 12729102
  misc_feature (1)..(1506): Also known as  Ceres CDNA ID no. 23372771
atgtttctttttctcctcctcctctctgcttcccgctccggcgaagagtcgccgtccggagacgccgtcccattggccaccggcggtcttaacagaaagagttttccggaaggattcttgttcggaaccgccacgtcagcttaccaggtcgaaggcgagacccaccaagatggtcgtggtccaagcatttgggatgcattcgtcaagattcctggtaagattgccaacaatgccactgctgagataacagtggaccaatatcatcgttacaaggaagatgtagatttgatgcagaacctgaacattgatgcctacagattttccatttcatggtctagaatattccctgagggatccggtaaaatcaactcgaatggagttgcttattacaatagattgatcgattacttgatcgaaaaagggattacaccgtatgctaatctgtaccactatgaccttcctttagccttggaacaaaagtatcaaggcctgcttagtaaacaaggaagattttgcggattacgcagagttttgtttcaaacatttggagatagagtgaagaactggatgacgtttaacgagcctcgtgtagtagctgctctaggttatgataacggcatttttgcgccgggtagatgctctgaagcatttggaaactgcactgatggaaactctgcaactgaaccatacattgttgcacatcaccttatcttggcacatgcagcagccgtccagagataccgccaaaattatcaggagaaacaaaagggaagggttgggattctactggattttgtttggtttgagccacttacgagtagtcaagcagacaatgacgctgctcaaagagcaagagacttccatgttggatggtttattcacccaatagtgtatggagagtacccaaatacgttgcaaaacatcgtgaaggagagacttccgaagttcaccgaggaagaagtgaaaatggtgaaaggttccatagacttcgtggggataaaccaatacacaacttatttcatgtctgatcctaaaatatctaccacacctaaagatttgggttatcaacaagattggaacgtcacttttaactttgcaaagaatgggacaccaattggtccaagggcacattcagaatggttatacaatgtcccatggggaatgtacaaagctttaatgtacattgaggaacgttatggcaacccaactatgattctctccgaaaacggtatggatgatccgggcaacataactctaactcaaggactaaatgatacaacaagagtcaagtattatagagactatttagtgcagcttaaaaaagcagtagacgatggagccaatctaactggatattttgcgtggtcgttgctagataatttcgaatggttatcaggatatacttcaaggtttggaatagtgtacgttgattacaaggacttgaagagataccccaagatgtctgctttatggtttaaacaacttttgaaacgggaccagaaatga

SEQ ID NO: 1992 - protein, 1506 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGTTTCTTTTTCTCCTCCTCCTCTCTGCTTCCCGCTCCGGCGAAGAGTCGCCGTCCGGAGACGCCGTCCCATTGGCCACCGGCGGTCTTAACAGAAAGAGTTTTCCGGAAGGATTCTTGTTCGGAACCGCCACGTCAGCTTACCAGGTCGAAGGCGAGACCCACCAAGATGGTCGTGGTCCAAGCATTTGGGATGCATTCGTCAAGATTCCTGGTAAGATTGCCAACAATGCCACTGCTGAGATAACAGTGGACCAATATCATCGTTACAAGGAAGATGTAGATTTGATGCAGAACCTGAACATTGATGCCTACAGATTTTCCATTTCATGGTCTAGAATATTCCCTGAGGGATCCGGTAAAATCAACTCGAATGGAGTTGCTTATTACAATAGATTGATCGATTACTTGATCGAAAAAGGGATTACACCGTATGCTAATCTGTACCACTATGACCTTCCTTTAGCCTTGGAACAAAAGTATCAAGGCCTGCTTAGTAAACAAGGAAGATTTTGCGGATTACGCAGAGTTTTGTTTCAAACATTTGGAGATAGAGTGAAGAACTGGATGACGTTTAACGAGCCTCGTGTAGTAGCTGCTCTAGGTTATGATAACGGCATTTTTGCGCCGGGTAGATGCTCTGAAGCATTTGGAAACTGCACTGATGGAAACTCTGCAACTGAACCATACATTGTTGCACATCACCTTATCTTGGCACATGCAGCAGCCGTCCAGAGATACCGCCAAAATTATCAGGAGAAACAAAAGGGAAGGGTTGGGATTCTACTGGATTTTGTTTGGTTTGAGCCACTTACGAGTAGTCAAGCAGACAATGACGCTGCTCAAAGAGCAAGAGACTTCCATGTTGGATGGTTTATTCACCCAATAGTGTATGGAGAGTACCCAAATACGTTGCAAAACATCGTGAAGGAGAGACTTCCGAAGTTCACCGAGGAAGAAGTGAAAATGGTGAAAGGTTCCATAGACTTCGTGGGGATAAACCAATACACAACTTATTTCATGTCTGATCCTAAAATATCTACCACACCTAAAGATTTGGGTTATCAACAAGATTGGAACGTCACTTTTAACTTTGCAAAGAATGGGACACCAATTGGTCCAAGGGCACATTCAGAATGGTTATACAATGTCCCATGGGGAATGTACAAAGCTTTAATGTACATTGAGGAACGTTATGGCAACCCAACTATGATTCTCTCCGAAAACGGTATGGATGATCCGGGCAACATAACTCTAACTCAAGGACTAAATGATACAACAAGAGTCAAGTATTATAGAGACTATTTAGTGCAGCTTAAAAAAGCAGTAGACGATGGAGCCAATCTAACTGGATATTTTGCGTGGTCGTTGCTAGATAATTTCGAATGGTTATCAGGATATACTTCAAGGTTTGGAATAGTGTACGTTGATTACAAGGACTTGAAGAGATACCCCAAGATGTCTGCTTTATGGTTTAAACAACTTTTGAAACGGGACCAGAAATGA

SEQ ID NO: 1993 - DNA, 1359 bp, Arabidopsis thaliana
  misc_feature (1)..(1359): Ceres cDNA ID no. 12729181
  misc_feature (1)..(1359): Also known as  Ceres CDNA ID no. 23372771
atggcgagtcatcagttaccgccgaagacggtggtggagatgcttaaagacaacaatatacagaaagtgaagttgttcgatgccgacacaaacaccatgggagctctcgccggctccggcgtcgaagtgatggtggctatccctaatgatctgctcctagcgatgggaaactatcaaagagctaaagattgggtccaaagaaacgtctctagattcaactttaacaacggcgttaagatcaaatacgttgcagtggggaacgaaccgttcttgacagcgtacaacggatcattcataaacctaacgtacccagcactcttcaacatccaaaccgctttaaacgaggctggagttggtgattttaccaaagccaccgttcctttaaacgccgacgtttacaattctcctccggacaatcaagtcccatccgccggaagattccgttccgacattatccaagaaatgacacaaatcgttaacttcctcgcacagaacaaagctcctttcacagtcaacatttatcctttcctcagtctctacttaagcagcgactttcctttcgaatacgctttctttgacggccaaaacaccgttaacgataacggcgttatctacacgaacgtcttcgacgctagtttcgacacgcttttagcttctttaaacgcgttgaatcacggtaacatggaagtgattgttggagaagttggttggcctacggatggtgacaagaacgcaaacgttccaaacgcggaacggttttattccggtttgcttccgcggttggcgaacaacgttggaactcctatgcgtaaaggttacattgaggtttatcttttcggatttatcgatgaagatgcgaaaagtgtagcgccagggaacttcgaacgtcattgggggatatttaaatttgatggccaaccgaaattcccggtagattttcgtggacaaggtcagaaaaagttcttaacgggagctcaaaacgttcagtactttctgaaccagtggtgtatgtttaatcctaatggtcgtggtaatatgagtaggctcggagataatataaactacgcgtgttcgcattcggactgtaccgctttaggttatggatcatcttgtggcaatcttgatgcgaatggaaacgcatcttacgcgtttaatatgtatttccaagtgcaaaatcaggaagctcaggcgtgcgattttgaagggcttgcaacgattactactcaaaatatatctcaaggacaatgtaattttccaattcagattggagagccatcttctggtcattatgattatagctatggttcgatggttaggttgtgtttggtgatgagtggcttggtctttcttctcatatag

SEQ ID NO: 1994 - protein, 1359 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGGCGAGTCATCAGTTACCGCCGAAGACGGTGGTGGAGATGCTTAAAGACAACAATATACAGAAAGTGAAGTTGTTCGATGCCGACACAAACACCATGGGAGCTCTCGCCGGCTCCGGCGTCGAAGTGATGGTGGCTATCCCTAATGATCTGCTCCTAGCGATGGGAAACTATCAAAGAGCTAAAGATTGGGTCCAAAGAAACGTCTCTAGATTCAACTTTAACAACGGCGTTAAGATCAAATACGTTGCAGTGGGGAACGAACCGTTCTTGACAGCGTACAACGGATCATTCATAAACCTAACGTACCCAGCACTCTTCAACATCCAAACCGCTTTAAACGAGGCTGGAGTTGGTGATTTTACCAAAGCCACCGTTCCTTTAAACGCCGACGTTTACAATTCTCCTCCGGACAATCAAGTCCCATCCGCCGGAAGATTCCGTTCCGACATTATCCAAGAAATGACACAAATCGTTAACTTCCTCGCACAGAACAAAGCTCCTTTCACAGTCAACATTTATCCTTTCCTCAGTCTCTACTTAAGCAGCGACTTTCCTTTCGAATACGCTTTCTTTGACGGCCAAAACACCGTTAACGATAACGGCGTTATCTACACGAACGTCTTCGACGCTAGTTTCGACACGCTTTTAGCTTCTTTAAACGCGTTGAATCACGGTAACATGGAAGTGATTGTTGGAGAAGTTGGTTGGCCTACGGATGGTGACAAGAACGCAAACGTTCCAAACGCGGAACGGTTTTATTCCGGTTTGCTTCCGCGGTTGGCGAACAACGTTGGAACTCCTATGCGTAAAGGTTACATTGAGGTTTATCTTTTCGGATTTATCGATGAAGATGCGAAAAGTGTAGCGCCAGGGAACTTCGAACGTCATTGGGGGATATTTAAATTTGATGGCCAACCGAAATTCCCGGTAGATTTTCGTGGACAAGGTCAGAAAAAGTTCTTAACGGGAGCTCAAAACGTTCAGTACTTTCTGAACCAGTGGTGTATGTTTAATCCTAATGGTCGTGGTAATATGAGTAGGCTCGGAGATAATATAAACTACGCGTGTTCGCATTCGGACTGTACCGCTTTAGGTTATGGATCATCTTGTGGCAATCTTGATGCGAATGGAAACGCATCTTACGCGTTTAATATGTATTTCCAAGTGCAAAATCAGGAAGCTCAGGCGTGCGATTTTGAAGGGCTTGCAACGATTACTACTCAAAATATATCTCAAGGACAATGTAATTTTCCAATTCAGATTGGAGAGCCATCTTCTGGTCATTATGATTATAGCTATGGTTCGATGGTTAGGTTGTGTTTGGTGATGAGTGGCTTGGTCTTTCTTCTCATATAG

SEQ ID NO: 1995 - DNA, 3018 bp, Arabidopsis thaliana
  misc_feature (1)..(3018): Ceres cDNA ID no. 12729846
  misc_feature (1)..(3018): Also known as  Ceres CDNA ID no. 23372771
atgggaacaaaggtgcactgtgaaagcttatttggtggatatcatcattctatgggagatctcaacaaagaatctaataacggttgtagatggccattgttctacggtgacaataaaacctctgcatcaaacaacgatcaatgctacaataatgggttcacgtctcagactacatttgggtttgacaaagatgtggtgagaaggacaatgctcgaacacgaagctgtttttaagacacaggttttggaacttcaccgggtatataggacacagaaggatatgatggatgaattgaaaaggaaacagtttaataaagaatgggttcagattgaggcatcactttcttctcaagctacgaatgatgatgttcgtaaatggaaaatccctagcttccctttggcgaactcggtttacgatagaccatccatgtcggttgttgaggataatggccattctcccatgaaaggaagcaattctcaaggtccagtttcatggcaaaatggagctagttccaaaagtgttgaagtgtccgaggttagaccgacgaaaatcagaagaaagatgatagatctttgccttccagctgatgagtacattgatgacaatgaagaagttgttgagttaaaggatcacagggtctgcagtacatcgagtcagcttcctaatggagatgtgaagactgaatctcgcatagatggtgtgagaattggctatgggtctagtagaagcaatggtttggctgacttaaatgaaccagttgatgctcaagaagcaaacgaatttgcttatggccactcccgtgacttgcgtaatggggagtttcaaggccatattcgtgactacggaaaatctctaaactcaggtagtgtaagggagcatattcctgttatccctctgcagccagatttgaacggcaaaccaaaagtttggtcacaccaacccctaagaactgatcattataatggcacacacaagtctgctgctccattttttcaaccggctaaaccactggattctttgtctcagcctatgcaagttttgatgaacagttcacaaagagttatgagtttacctaattcaggtccaccaagtaaggcagtcgtctggagagaaagaacgtttattgacctagaggctgatactgataccaatagtagtcatgaagccgtcattcatcaaaatcacttggattcaagtttaacttctcaccaacagcgccccttgtatccatatattcgtccagattctgctgtctcctggaaccatttgcactcttcttggcaaaatcctagctttggattccctcagaaagttgcttcagctcagagatatccggttctaaacatgtctgatacactgattggtaatgctcagaagcaagggtatcttggagatagattgcagtttgaaagcaattctagatttgactcagggtgcgggaattccagtcggttaaaccacaatatgttttacaatgagtgttccacttcatcaaaatcgaaagtcgctgggactggctataattatcctaacggaggaagaagtgattacagctcggagaggaagtttgtgagggatttgaacttaaatgtgacactttcaaacacttctgttgttgaagtcagaaaggatgaagaacacctggctactttaccatggcttaataaacccaagtctgtttgtaactctgagttagctgatgggaaatggagtctgaagagtaatgatgctgttccaagttcttctttgaaaccattggatatcagagatgaggcaggagacaaagttcagaatattatgtggctagagaggttaaagtctggttcttgttccaataatccggtgactgagaagatcgatgctaacaaggaaattcctggattggcttataaagatcaatccaatgtagagaaaggtaaagtccattacgttaggatgctagacatgaacgaaccgtgtgatcctctttgggatgaagatcagcaaacagaggaacagactgagacaagggtttcagctagtaataggtgtcagattgatttgaacattttgggcagtgatgatgaaggcgaaaattgctctgttcctgccagttcaagactgaattcaaaggctcctatgatagatttggaaactgttcctgagtctgatgatgaagaagaagatggtaatatctctggagaaaagcgatcagaagtaaaatcaattgaggaaaaaactctagagaaaccgcctgagtttgaaaaattagcagcagaaacaatagttgccatctattcagcttgcctagatagagaggttgaagttgttgcttcgtcagaagtttctgaaaccatcatccttcactggtttgcagaaacagtaaatactcacaaagagaatctggacaaaaagctcgatactttttcaaggaatcaatcgcgttctatcgaagatattgattactttgagtcaatgaccctgcaactacctgatatctcagaacaagagtatatgcctaagccattggttcctgaaaacctcaaattggaggaaactacaggaaccgctctggtcacaagccaaagaccgagaagaggaaacgcgagaaaagggaaacagagacgagacttccaaagagacattctccctggacttctgtctctttcgaaacacgaagtaacagaagacattcaaatgtttgatgggttcatgagagcaacaggaagatcttggactccaaccggtttaacaaggaagaaaaccggttcaagaggaagaccacgacgagccataacaatccctgctgaaccggtctattgtccggttccagctccagctcctcctcctccctcagttcaacaacatgtgagcaatcaaagcaacaatggtgaaactgaaatgtgtttagaagatagaagctttgcaggttggggtaagatgacaagaaggcctagaagacaacgatgtccttcagcttcaactacaactgcaactacaagtaaccaacgttcatcatcacacgcgcctttcacgtga

SEQ ID NO: 1996 - protein, 3018 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGGGAACAAAGGTGCACTGTGAAAGCTTATTTGGTGGATATCATCATTCTATGGGAGATCTCAACAAAGAATCTAATAACGGTTGTAGATGGCCATTGTTCTACGGTGACAATAAAACCTCTGCATCAAACAACGATCAATGCTACAATAATGGGTTCACGTCTCAGACTACATTTGGGTTTGACAAAGATGTGGTGAGAAGGACAATGCTCGAACACGAAGCTGTTTTTAAGACACAGGTTTTGGAACTTCACCGGGTATATAGGACACAGAAGGATATGATGGATGAATTGAAAAGGAAACAGTTTAATAAAGAATGGGTTCAGATTGAGGCATCACTTTCTTCTCAAGCTACGAATGATGATGTTCGTAAATGGAAAATCCCTAGCTTCCCTTTGGCGAACTCGGTTTACGATAGACCATCCATGTCGGTTGTTGAGGATAATGGCCATTCTCCCATGAAAGGAAGCAATTCTCAAGGTCCAGTTTCATGGCAAAATGGAGCTAGTTCCAAAAGTGTTGAAGTGTCCGAGGTTAGACCGACGAAAATCAGAAGAAAGATGATAGATCTTTGCCTTCCAGCTGATGAGTACATTGATGACAATGAAGAAGTTGTTGAGTTAAAGGATCACAGGGTCTGCAGTACATCGAGTCAGCTTCCTAATGGAGATGTGAAGACTGAATCTCGCATAGATGGTGTGAGAATTGGCTATGGGTCTAGTAGAAGCAATGGTTTGGCTGACTTAAATGAACCAGTTGATGCTCAAGAAGCAAACGAATTTGCTTATGGCCACTCCCGTGACTTGCGTAATGGGGAGTTTCAAGGCCATATTCGTGACTACGGAAAATCTCTAAACTCAGGTAGTGTAAGGGAGCATATTCCTGTTATCCCTCTGCAGCCAGATTTGAACGGCAAACCAAAAGTTTGGTCACACCAACCCCTAAGAACTGATCATTATAATGGCACACACAAGTCTGCTGCTCCATTTTTTCAACCGGCTAAACCACTGGATTCTTTGTCTCAGCCTATGCAAGTTTTGATGAACAGTTCACAAAGAGTTATGAGTTTACCTAATTCAGGTCCACCAAGTAAGGCAGTCGTCTGGAGAGAAAGAACGTTTATTGACCTAGAGGCTGATACTGATACCAATAGTAGTCATGAAGCCGTCATTCATCAAAATCACTTGGATTCAAGTTTAACTTCTCACCAACAGCGCCCCTTGTATCCATATATTCGTCCAGATTCTGCTGTCTCCTGGAACCATTTGCACTCTTCTTGGCAAAATCCTAGCTTTGGATTCCCTCAGAAAGTTGCTTCAGCTCAGAGATATCCGGTTCTAAACATGTCTGATACACTGATTGGTAATGCTCAGAAGCAAGGGTATCTTGGAGATAGATTGCAGTTTGAAAGCAATTCTAGATTTGACTCAGGGTGCGGGAATTCCAGTCGGTTAAACCACAATATGTTTTACAATGAGTGTTCCACTTCATCAAAATCGAAAGTCGCTGGGACTGGCTATAATTATCCTAACGGAGGAAGAAGTGATTACAGCTCGGAGAGGAAGTTTGTGAGGGATTTGAACTTAAATGTGACACTTTCAAACACTTCTGTTGTTGAAGTCAGAAAGGATGAAGAACACCTGGCTACTTTACCATGGCTTAATAAACCCAAGTCTGTTTGTAACTCTGAGTTAGCTGATGGGAAATGGAGTCTGAAGAGTAATGATGCTGTTCCAAGTTCTTCTTTGAAACCATTGGATATCAGAGATGAGGCAGGAGACAAAGTTCAGAATATTATGTGGCTAGAGAGGTTAAAGTCTGGTTCTTGTTCCAATAATCCGGTGACTGAGAAGATCGATGCTAACAAGGAAATTCCTGGATTGGCTTATAAAGATCAATCCAATGTAGAGAAAGGTAAAGTCCATTACGTTAGGATGCTAGACATGAACGAACCGTGTGATCCTCTTTGGGATGAAGATCAGCAAACAGAGGAACAGACTGAGACAAGGGTTTCAGCTAGTAATAGGTGTCAGATTGATTTGAACATTTTGGGCAGTGATGATGAAGGCGAAAATTGCTCTGTTCCTGCCAGTTCAAGACTGAATTCAAAGGCTCCTATGATAGATTTGGAAACTGTTCCTGAGTCTGATGATGAAGAAGAAGATGGTAATATCTCTGGAGAAAAGCGATCAGAAGTAAAATCAATTGAGGAAAAAACTCTAGAGAAACCGCCTGAGTTTGAAAAATTAGCAGCAGAAACAATAGTTGCCATCTATTCAGCTTGCCTAGATAGAGAGGTTGAAGTTGTTGCTTCGTCAGAAGTTTCTGAAACCATCATCCTTCACTGGTTTGCAGAAACAGTAAATACTCACAAAGAGAATCTGGACAAAAAGCTCGATACTTTTTCAAGGAATCAATCGCGTTCTATCGAAGATATTGATTACTTTGAGTCAATGACCCTGCAACTACCTGATATCTCAGAACAAGAGTATATGCCTAAGCCATTGGTTCCTGAAAACCTCAAATTGGAGGAAACTACAGGAACCGCTCTGGTCACAAGCCAAAGACCGAGAAGAGGAAACGCGAGAAAAGGGAAACAGAGACGAGACTTCCAAAGAGACATTCTCCCTGGACTTCTGTCTCTTTCGAAACACGAAGTAACAGAAGACATTCAAATGTTTGATGGGTTCATGAGAGCAACAGGAAGATCTTGGACTCCAACCGGTTTAACAAGGAAGAAAACCGGTTCAAGAGGAAGACCACGACGAGCCATAACAATCCCTGCTGAACCGGTCTATTGTCCGGTTCCAGCTCCAGCTCCTCCTCCTCCCTCAGTTCAACAACATGTGAGCAATCAAAGCAACAATGGTGAAACTGAAATGTGTTTAGAAGATAGAAGCTTTGCAGGTTGGGGTAAGATGACAAGAAGGCCTAGAAGACAACGATGTCCTTCAGCTTCAACTACAACTGCAACTACAAGTAACCAACGTTCATCATCACACGCGCCTTTCACGTGA

SEQ ID NO: 1997 - DNA, 2508 bp, Arabidopsis thaliana
  misc_feature (1)..(2508): Ceres cDNA ID no. 12730145
  misc_feature (1)..(2508): Also known as  Ceres CDNA ID no. 23372771
atggttcgaaaccaatctcgttgctttcttggtattattattaccatctctttctttttctttcttctttccttaccaaacactttcgcttctcccacacggtctttgtgccgcagcgaccaaagagatgctcttttggagctaaaaaaagagttcccgatccattccaacgggagccatcatgtaacaacactttcttggaacaagaccgttgattgttgttcttgggagggtgtcacatgtgatgctacattaggagaggtgatatcacttaatctcgtttcctatattgccaacacctctttgaaatctagcagtagtctttttaaactccgacatcttcgtcacctagagctttcacattgcaatctccaaggagagattccttcttcaattggaaatctttctcatctcacatatcttgatctttctttcaatcaattagtaggtgaatttccggtttcgataggtaacctaaaccaactagaatacatagatctttgggttaatgctctcggaggtaatattcctacttcatttgccaacttaacaaagctttctgaattgcacctccgtcaaaatcaattcacgggtggggatatagtattatccaacttaactagcttgtccattgtagacctctcctccaattacttcaactccacgatttctgctgaccttagtcaactccacaacttagagcgattttgggtgtctgagaactcattttttggaccttttccctcattcttgctcatgattccttcgttagtcgatatttgtttaagtgaaaaccaattcgaaggacctattaattttgggaataccacttcgtcatctaagttgacagagttagatgttagctacaacaatcttgatgggctaatcccaaaatctatatctacattagttagtctcgaacatttagagcttagccacaacaattttagaggacaagtccctagttctatatcgaaattagtcaatctcgatggtttatatcttagccataataacttcggaggacaagtccctagctctatatttaaattagtcaatctcgaacatttagatcttagccacaacgatttcggaggacgagtccctagctctatatcaaaattagtcaacctcagttcccttgatctttcctacaacaagtttgaaggtcatgtacctcaatgtatatggagatcttctaagttagattcagtggatctttcttataattctttcaacagtttcggcagaattctagaacttggggatgaatcattagaaagagattgggatcttagctcaaattccctccaaggaccaattccccaatggatctgcaacttcagatttttttccttcttagatttttccaacaaccatcttaatggctcaattccacaatgtttgaagaattccactgatttctacatgttaaatctgcgaaacaacagtctaagtggatttatgccagacttctgcatggatggctcaatgttgggatcacttgatgtcagcctcaacaatttggtggggaaacttccagaatctttcatcaactgtgagtggatggaatatcttaatgtgagaggaaacaagatcaaagacacgtttccagtctggttgggatctctacaatacctaacggttcttgtgctccgatcaaatacattctatggtccagtctataaggcctctgcctacttaggctttccaagcatgcggatcatggacatatcgaataacaacttcgttggatcattgccacaagactattttgccaactggactgaaatgtcatcggtatggcaacgacctatgctcacacttgattacaaaagaaatatagctataccagggtcaaactacatgggagatgataatcatcaagattcaattgatttggtgtataaaggagtagacacagatttcgaacaaatctttggaggctttaaagtcatagatttttctggaaaccgattctctggacatatccctagatccattggtctattgagcgaattgcttcatctcaacttgtcaggcaatgcattcacaggaaacatcccaccatctttggctagtattacaaagctcgagacgctagacctatcgcgaaacaacttgtcaggtgaaattcctcgaggtctcgggaaactctcgtttctctccaacatcaacttctcccacaaccatctagagggattggtgccacaaagcacacagtttggaagtcaaaattgttcttcattcatgggtaatcccagactctatggactcgatcaaatttgtggagaaacccatgtccccatacctacatcgctgcaccccgaggaacctttgttggaaccggaagagacagttctgaactggatagcagctgcaatagcatttggacctggtgtgttttgtggattagtgattggacatattttcacttcatacaagcacaagtggcttatggcgaaattttgtcgaaacaagcgcaaaaccaccataggtacttcttaa

SEQ ID NO: 1998 - protein, 2508 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGGTTCGAAACCAATCTCGTTGCTTTCTTGGTATTATTATTACCATCTCTTTCTTTTTCTTTCTTCTTTCCTTACCAAACACTTTCGCTTCTCCCACACGGTCTTTGTGCCGCAGCGACCAAAGAGATGCTCTTTTGGAGCTAAAAAAAGAGTTCCCGATCCATTCCAACGGGAGCCATCATGTAACAACACTTTCTTGGAACAAGACCGTTGATTGTTGTTCTTGGGAGGGTGTCACATGTGATGCTACATTAGGAGAGGTGATATCACTTAATCTCGTTTCCTATATTGCCAACACCTCTTTGAAATCTAGCAGTAGTCTTTTTAAACTCCGACATCTTCGTCACCTAGAGCTTTCACATTGCAATCTCCAAGGAGAGATTCCTTCTTCAATTGGAAATCTTTCTCATCTCACATATCTTGATCTTTCTTTCAATCAATTAGTAGGTGAATTTCCGGTTTCGATAGGTAACCTAAACCAACTAGAATACATAGATCTTTGGGTTAATGCTCTCGGAGGTAATATTCCTACTTCATTTGCCAACTTAACAAAGCTTTCTGAATTGCACCTCCGTCAAAATCAATTCACGGGTGGGGATATAGTATTATCCAACTTAACTAGCTTGTCCATTGTAGACCTCTCCTCCAATTACTTCAACTCCACGATTTCTGCTGACCTTAGTCAACTCCACAACTTAGAGCGATTTTGGGTGTCTGAGAACTCATTTTTTGGACCTTTTCCCTCATTCTTGCTCATGATTCCTTCGTTAGTCGATATTTGTTTAAGTGAAAACCAATTCGAAGGACCTATTAATTTTGGGAATACCACTTCGTCATCTAAGTTGACAGAGTTAGATGTTAGCTACAACAATCTTGATGGGCTAATCCCAAAATCTATATCTACATTAGTTAGTCTCGAACATTTAGAGCTTAGCCACAACAATTTTAGAGGACAAGTCCCTAGTTCTATATCGAAATTAGTCAATCTCGATGGTTTATATCTTAGCCATAATAACTTCGGAGGACAAGTCCCTAGCTCTATATTTAAATTAGTCAATCTCGAACATTTAGATCTTAGCCACAACGATTTCGGAGGACGAGTCCCTAGCTCTATATCAAAATTAGTCAACCTCAGTTCCCTTGATCTTTCCTACAACAAGTTTGAAGGTCATGTACCTCAATGTATATGGAGATCTTCTAAGTTAGATTCAGTGGATCTTTCTTATAATTCTTTCAACAGTTTCGGCAGAATTCTAGAACTTGGGGATGAATCATTAGAAAGAGATTGGGATCTTAGCTCAAATTCCCTCCAAGGACCAATTCCCCAATGGATCTGCAACTTCAGATTTTTTTCCTTCTTAGATTTTTCCAACAACCATCTTAATGGCTCAATTCCACAATGTTTGAAGAATTCCACTGATTTCTACATGTTAAATCTGCGAAACAACAGTCTAAGTGGATTTATGCCAGACTTCTGCATGGATGGCTCAATGTTGGGATCACTTGATGTCAGCCTCAACAATTTGGTGGGGAAACTTCCAGAATCTTTCATCAACTGTGAGTGGATGGAATATCTTAATGTGAGAGGAAACAAGATCAAAGACACGTTTCCAGTCTGGTTGGGATCTCTACAATACCTAACGGTTCTTGTGCTCCGATCAAATACATTCTATGGTCCAGTCTATAAGGCCTCTGCCTACTTAGGCTTTCCAAGCATGCGGATCATGGACATATCGAATAACAACTTCGTTGGATCATTGCCACAAGACTATTTTGCCAACTGGACTGAAATGTCATCGGTATGGCAACGACCTATGCTCACACTTGATTACAAAAGAAATATAGCTATACCAGGGTCAAACTACATGGGAGATGATAATCATCAAGATTCAATTGATTTGGTGTATAAAGGAGTAGACACAGATTTCGAACAAATCTTTGGAGGCTTTAAAGTCATAGATTTTTCTGGAAACCGATTCTCTGGACATATCCCTAGATCCATTGGTCTATTGAGCGAATTGCTTCATCTCAACTTGTCAGGCAATGCATTCACAGGAAACATCCCACCATCTTTGGCTAGTATTACAAAGCTCGAGACGCTAGACCTATCGCGAAACAACTTGTCAGGTGAAATTCCTCGAGGTCTCGGGAAACTCTCGTTTCTCTCCAACATCAACTTCTCCCACAACCATCTAGAGGGATTGGTGCCACAAAGCACACAGTTTGGAAGTCAAAATTGTTCTTCATTCATGGGTAATCCCAGACTCTATGGACTCGATCAAATTTGTGGAGAAACCCATGTCCCCATACCTACATCGCTGCACCCCGAGGAACCTTTGTTGGAACCGGAAGAGACAGTTCTGAACTGGATAGCAGCTGCAATAGCATTTGGACCTGGTGTGTTTTGTGGATTAGTGATTGGACATATTTTCACTTCATACAAGCACAAGTGGCTTATGGCGAAATTTTGTCGAAACAAGCGCAAAACCACCATAGGTACTTCTTAA

SEQ ID NO: 1999 - DNA, 2148 bp, Arabidopsis thaliana
  misc_feature (1)..(2148): Ceres cDNA ID no. 12730172
  misc_feature (1)..(2148): Also known as  Ceres CDNA ID no. 23372771
atgagttcatcaaaagccctaatcaaaaccctgattaagaatccaactcgaatcaaatccaaatctcaagcgaagcagcttcacgcacaattcatcagaactcaatcactctctcatacatcagcttcaatcgtaatctcaatctacacaaaccttaaacttttgcacgaagctttgcttcttttcaaaacccttaagtctcctcctgttctagcatggaagtcagtaatcagatgcttcaccgaccagtctctattctccaaggcgttagcttcgtttgtggaaatgcgagcttctgggagatgcccagatcacaatgtgtttccttctgttttgaaatcgtgtacgatgatgatggatttgagatttggtgagtctgttcatgggtttattgttaggcttggtatggattgtgatttgtatactggtaatgcgcttatgaatatgtatgctaagcttcttggtatgggttctaagattagtgtaggtaatgtgttcgatgaaatgcctcaaagaacgtccaattctggagacgaagatgtaaaggctgaaacttgcattatgccttttggaatagacagtgtgaggagggtttttgaagtgatgcctagaaaggatgttgtgtcgtataatactatcattgcagggtatgcacagagtggaatgtatgaagatgctttgagaatggttagggagatgggaactactgacttaaagcctgattcttttactttgtctagtgtgcttccgatattttctgagtatgtggatgttattaaggggaaagagattcatgggtatgtgattaggaaagggattgatagtgatgtatatattgggagtagtttggttgatatgtatgcgaaaagtgctcggattgaagactctgaaagagtgttttctcgcttgtattgtcgggatggtatctcgtggaactcgcttgtagctgggtatgtacagaatggtagatacaatgaggctctgagattgttcaggcaaatggtgaccgcaaaggttaagccaggggctgtggcgttctcaagtgtgattcctgcttgtgctcacctagccaccttgcaccttgggaaacaacttcacggatatgtattaaggggtggctttggcagtaacatattcatagctagtgcacttgttgatatgtactcgaaatgtgggaatattaaggctgctaggaagatttttgacaggatgaatgtactcgatgaagtatcatggacggctattataatggggcatgcgttacatggtcatgggcatgaagcagtttcgttgtttgaggagatgaaacgacaaggagtgaaaccgaatcaagtggcatttgttgctgtactaacggcttgtagtcatgtggggttggtagatgaggcatggggatatttcaacagcatgactaaggtttacggtttaaaccaggagttagaacattatgcagctgtagcggatcttctaggccgtgcagggaagctggaagaagcatacaatttcatttcaaagatgtgtgttgaaccaactggtagtgtctggtctaccttattgtcttcttgcagcgttcacaagaatcttgagttggctgagaaggtagcggagaagatattcactgtcgattctgaaaacatgggagcttatgttttgatgtgcaatatgtatgcgtctaatggaagatggaaagaaatggcgaaactaagattgcgtatgaggaagaaaggattgcggaaaaagccagcttgtagttggatcgaaatgaaaaacaagactcatggatttgtttcaggagatagatcgcatccgagtatggacaagatcaacgagtttcttaaagctgtaatggaacagatggagaaagaagggtatgttgcagacacaagcggcgtgcttcacgatgtagacgaagagcataagagagagcttttgttcggacacagtgagagattggctgttgcctttggtatcatcaacacagaacctggcacgacaattagagtcactaagaatataaggatatgcacggattgtcatgtcgcaatcaagtttatctcgaagatcacggaaagagagattatcgttagggataatagcagattccaccatttcaaccgtggaaactgttcttgtggagattattggtaa

SEQ ID NO: 2000 - protein, 2148 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGAGTTCATCAAAAGCCCTAATCAAAACCCTGATTAAGAATCCAACTCGAATCAAATCCAAATCTCAAGCGAAGCAGCTTCACGCACAATTCATCAGAACTCAATCACTCTCTCATACATCAGCTTCAATCGTAATCTCAATCTACACAAACCTTAAACTTTTGCACGAAGCTTTGCTTCTTTTCAAAACCCTTAAGTCTCCTCCTGTTCTAGCATGGAAGTCAGTAATCAGATGCTTCACCGACCAGTCTCTATTCTCCAAGGCGTTAGCTTCGTTTGTGGAAATGCGAGCTTCTGGGAGATGCCCAGATCACAATGTGTTTCCTTCTGTTTTGAAATCGTGTACGATGATGATGGATTTGAGATTTGGTGAGTCTGTTCATGGGTTTATTGTTAGGCTTGGTATGGATTGTGATTTGTATACTGGTAATGCGCTTATGAATATGTATGCTAAGCTTCTTGGTATGGGTTCTAAGATTAGTGTAGGTAATGTGTTCGATGAAATGCCTCAAAGAACGTCCAATTCTGGAGACGAAGATGTAAAGGCTGAAACTTGCATTATGCCTTTTGGAATAGACAGTGTGAGGAGGGTTTTTGAAGTGATGCCTAGAAAGGATGTTGTGTCGTATAATACTATCATTGCAGGGTATGCACAGAGTGGAATGTATGAAGATGCTTTGAGAATGGTTAGGGAGATGGGAACTACTGACTTAAAGCCTGATTCTTTTACTTTGTCTAGTGTGCTTCCGATATTTTCTGAGTATGTGGATGTTATTAAGGGGAAAGAGATTCATGGGTATGTGATTAGGAAAGGGATTGATAGTGATGTATATATTGGGAGTAGTTTGGTTGATATGTATGCGAAAAGTGCTCGGATTGAAGACTCTGAAAGAGTGTTTTCTCGCTTGTATTGTCGGGATGGTATCTCGTGGAACTCGCTTGTAGCTGGGTATGTACAGAATGGTAGATACAATGAGGCTCTGAGATTGTTCAGGCAAATGGTGACCGCAAAGGTTAAGCCAGGGGCTGTGGCGTTCTCAAGTGTGATTCCTGCTTGTGCTCACCTAGCCACCTTGCACCTTGGGAAACAACTTCACGGATATGTATTAAGGGGTGGCTTTGGCAGTAACATATTCATAGCTAGTGCACTTGTTGATATGTACTCGAAATGTGGGAATATTAAGGCTGCTAGGAAGATTTTTGACAGGATGAATGTACTCGATGAAGTATCATGGACGGCTATTATAATGGGGCATGCGTTACATGGTCATGGGCATGAAGCAGTTTCGTTGTTTGAGGAGATGAAACGACAAGGAGTGAAACCGAATCAAGTGGCATTTGTTGCTGTACTAACGGCTTGTAGTCATGTGGGGTTGGTAGATGAGGCATGGGGATATTTCAACAGCATGACTAAGGTTTACGGTTTAAACCAGGAGTTAGAACATTATGCAGCTGTAGCGGATCTTCTAGGCCGTGCAGGGAAGCTGGAAGAAGCATACAATTTCATTTCAAAGATGTGTGTTGAACCAACTGGTAGTGTCTGGTCTACCTTATTGTCTTCTTGCAGCGTTCACAAGAATCTTGAGTTGGCTGAGAAGGTAGCGGAGAAGATATTCACTGTCGATTCTGAAAACATGGGAGCTTATGTTTTGATGTGCAATATGTATGCGTCTAATGGAAGATGGAAAGAAATGGCGAAACTAAGATTGCGTATGAGGAAGAAAGGATTGCGGAAAAAGCCAGCTTGTAGTTGGATCGAAATGAAAAACAAGACTCATGGATTTGTTTCAGGAGATAGATCGCATCCGAGTATGGACAAGATCAACGAGTTTCTTAAAGCTGTAATGGAACAGATGGAGAAAGAAGGGTATGTTGCAGACACAAGCGGCGTGCTTCACGATGTAGACGAAGAGCATAAGAGAGAGCTTTTGTTCGGACACAGTGAGAGATTGGCTGTTGCCTTTGGTATCATCAACACAGAACCTGGCACGACAATTAGAGTCACTAAGAATATAAGGATATGCACGGATTGTCATGTCGCAATCAAGTTTATCTCGAAGATCACGGAAAGAGAGATTATCGTTAGGGATAATAGCAGATTCCACCATTTCAACCGTGGAAACTGTTCTTGTGGAGATTATTGGTAA

SEQ ID NO: 2001 - DNA, 950 bp, Arabidopsis thaliana
  misc_feature (1)..(950): Ceres cDNA ID no. 12730229
  misc_feature (1)..(950): Also known as  Ceres CDNA ID no. 23372771
atgaccagagaattcgaactggaaaacaactaccagctttgcgacgagatcggcagaggtagattcggaacaatcactcgctgtttctcacccgcgactaaagaattctacgcctgcaaaaccattgacaagcgcgtgctcatcgacgcattagatcgcgagtgtatagagacggagccgaggatcatggcgatgttaccgccgcatccgaatatcatcaggatcttcgatctctacgaaacagaggattctcttgcgatcgtcatggaattagtcgatccgccgatgacgatttacgatcggttaatctccgccggggggaggttatcagaatcagaatccgcctcatacgcgaaacagatcctcagtgcgcttgctcattgtcaccggtgcgacgtcgttcatcgggatgtgaaacctgacaacgtcttagtcgatctcgtaagcggcggtgttaagctctgtgatttcggatcagcggtgtggttaggcggagaaacggcggagggagttgtgggaacaccgtattacgtggcgccggaggtagtgatggggaggaagtacgacgagaaggttgatatatggagcgctggtgtagtgatatacacgatgctagctggagaaccgccgtttaacggtgagacggcggaagatatatttgaatcgatattgagagggaatttgaggtttccgccgaagaagtttgggtctgtatcatcggaagcgaaggatttgttgaggaaaatgatatgtcgtgatgtttctcggcgattttctgcagaggatgctcttcgacattcatggatgatgaacgttggaaacctccaaagcaattagtcgaagcttttcagatatgtgattagagagtgtaattagagaagtcgtaatatagatgtgagtgtgtaattgtttgattcgaatagtcaaacgtagttgtgtgtttcagcaat

SEQ ID NO: 2002 - protein, 950 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGACCAGAGAATTCGAACTGGAAAACAACTACCAGCTTTGCGACGAGATCGGCAGAGGTAGATTCGGAACAATCACTCGCTGTTTCTCACCCGCGACTAAAGAATTCTACGCCTGCAAAACCATTGACAAGCGCGTGCTCATCGACGCATTAGATCGCGAGTGTATAGAGACGGAGCCGAGGATCATGGCGATGTTACCGCCGCATCCGAATATCATCAGGATCTTCGATCTCTACGAAACAGAGGATTCTCTTGCGATCGTCATGGAATTAGTCGATCCGCCGATGACGATTTACGATCGGTTAATCTCCGCCGGGGGGAGGTTATCAGAATCAGAATCCGCCTCATACGCGAAACAGATCCTCAGTGCGCTTGCTCATTGTCACCGGTGCGACGTCGTTCATCGGGATGTGAAACCTGACAACGTCTTAGTCGATCTCGTAAGCGGCGGTGTTAAGCTCTGTGATTTCGGATCAGCGGTGTGGTTAGGCGGAGAAACGGCGGAGGGAGTTGTGGGAACACCGTATTACGTGGCGCCGGAGGTAGTGATGGGGAGGAAGTACGACGAGAAGGTTGATATATGGAGCGCTGGTGTAGTGATATACACGATGCTAGCTGGAGAACCGCCGTTTAACGGTGAGACGGCGGAAGATATATTTGAATCGATATTGAGAGGGAATTTGAGGTTTCCGCCGAAGAAGTTTGGGTCTGTATCATCGGAAGCGAAGGATTTGTTGAGGAAAATGATATGTCGTGATGTTTCTCGGCGATTTTCTGCAGAGGATGCTCTTCGACATTCATGGATGATGAACGTTGGAAACCTCCAAAGCAATTAGTCGAAGCTTTTCAGATATGTGATTAGAGAGTGTAATTAGAGAAGTCGTAATATAGATGTGAGTGTGTAATTGTTTGATTCGAATAGTCAAACGTAGTTGTGTGTTTCAGCAAT

SEQ ID NO: 2003 - DNA, 3204 bp, Arabidopsis thaliana
  misc_feature (1)..(3204): Ceres cDNA ID no. 12730643
  misc_feature (1)..(3204): Also known as  Ceres CDNA ID no. 23372771
acaatctccttttcttgctttttcattattgatattcaagaaactaagaaaaagaagaaaaacaacacttcgaaaaaatgatgaaaggctatattactctttcttttcttatcattctcatttttaatttccttgacgagtttgcggcttctactagacacttgtgtgatcctgatcaaagtgatgcaattctcgaattcaagaacgagtttgagactttggaggaatcttgttttgacagcaatattcctctgaagacggagtcatggacgaataacagtgattgttgttattgggatggtatcaaatgtgatgccaagttcggggatgtgatcgagctagatcttagctttagttgcctccgtggccagctcaattccaatagtagtctttttaggcttccacaacttcgttttctaaccactcttgacctttctaataatgattttattggtcaaatcccatcttcacttgaaaccctctctaatctcaccactctagacctttctagaaatcatttcagtggtagaattccttcttcgattggaaacctttctcatctcatatttgttgacttctctcataacaattttagtggtcaaatcccatcttcacttggatatctttcgcatctcacctcttttaacctttcttataacaattttagtggtagggttccttcttcaattggaaatctctcttatctcaccactttgcgcctctctcgtaatagtttttttggtgaacttccatcttcacttggaagtcttttccatctcaccgatttgatcctcgatactaaccattttgttggtaaaattccgtcttcacttggaaatctttcgcatctcacctctatcgacctccacaaaaataattttgttggcgaaataccattttcacttggaaatctttcttgtctcacctcttttatcctctctgataacaacattgttggtgaaattccatcttcttttggcaatttgaaccagttggacatcttaaatgttaagtccaataagcttagtggcagcttcccaattgcactactaaatctaagaaaactgtcaacattatctctctttaacaatcggttaaccggaacacttccttctaacatgagttcactctccaacttgaagttgtttgacgcaacggaaaaccatttcacgggacctctcccttcttcccttttcaacattccctctttgaaaactattactttggaaaataaccaacttaacggtagtcttgggtttgggaatatatcctcatactcgaatttaactgtgttacgccttgggaataacaactttagagggccaatccatagatctatatccaaattagtcaaccttaaggaacttgacctttcaaactacaacacccaagggttagttgactttaccatcttctcgcatctcaagtctatcgaataccttaacctctcccatttgaacaccactactacgattgacatgtacgagatcttatcaagtttcaagttattggatacactagatctctcaggcagccatgtttctactacaaacaagagttcactttctaattcttcattggtattgataagtcagttgtacttgtcgggatgcggtatcaccgagtttccaaagttcctaagatcccaagagcttatgctgactctagacatttccaacaacaagatcaaaggtcaagtgcctggatggttatggatgctccctgttttgaactacgtgaatctttccaacaacactttcatcggtttcgaaagatcaacgaaacttggactcacctctatccaagaaccaccagctatgaggcaattgttttgctccaacaacaatttcacgggaaacattccatctttcatatgtgagttgccttatctcagcactctcgatttttctaacaacaaattcaatggttcaattcctacttgtatgggaaatattcagtctccatatcttcaagctctaaatcttcgacataatcgtcttagtggacttcttccagagaatatatttgagagtctaatttctcttgacgtcggccataaccaactagtgggaaagcttccaagatcgttaagtcatatctcttcccttggacttctgaatgtggagagcaacaaaatcagtgatacgtttcctttatggttgagttctctacaagagctacaagttcttgtccttcgctccaatgcattttatggaccaatagagaaaacacagttttctaagctgcgaatcattgacatatccggtaatcaattcaatggtacgttgccagcaaatttctttgtcaactggactgcaatgttttcactggacgaaaatgaagatcaatctaacggagagaccatgagcaacatgtacatgagtacagattatttctactttgattcaatggttttgatgaataaaggagtagagatggagctggaacgtgtcctaaaagtcttcacagtgattgacttttcgggaaacaaatttgaaggagagattccaaagtccattggtttattgaaagagcttcatgttcttaacttatcaaacaatgctttaagtggccacatcgcatcatctatggggaacctcatggcacttgagtcactggacgtttcccaaaacaagctttcaggagaaattccacaagagttagggaaactcacgtaccttgcatacatgaacttctctcataaccagctggtaggtctattaccaggaggtactcaatttcaaacacagaagtgctcttctttcgaggacaatcatggcctttatggcccttcgcttgagaaaatttgtgatatccatgggaaaacaccgcaacaatctgacatggcgccagagccagaagaagatgaagaagaggtgataagttggatagcagctgttataggattcatacttggtactgccttgggattgacatttggatgcatattgttttcctacaaaccagattggttcaagaatcctttcgtccgagacaaacgcagaaacataggcaccataactcattagagagttggagaattttacacgaagtaaacaaaggaacaaaaccggaagaaacttgggaggaaagcaatctaattttaaataatcattttttctgtctcctcctccccccccattgttatgtctatgtccatttttaaatacaatgtaaaaatgaatagtatcataaaaaaattgt

SEQ ID NO: 2004 - protein, 3204 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ACAATCTCCTTTTCTTGCTTTTTCATTATTGATATTCAAGAAACTAAGAAAAAGAAGAAAAACAACACTTCGAAAAAATGATGAAAGGCTATATTACTCTTTCTTTTCTTATCATTCTCATTTTTAATTTCCTTGACGAGTTTGCGGCTTCTACTAGACACTTGTGTGATCCTGATCAAAGTGATGCAATTCTCGAATTCAAGAACGAGTTTGAGACTTTGGAGGAATCTTGTTTTGACAGCAATATTCCTCTGAAGACGGAGTCATGGACGAATAACAGTGATTGTTGTTATTGGGATGGTATCAAATGTGATGCCAAGTTCGGGGATGTGATCGAGCTAGATCTTAGCTTTAGTTGCCTCCGTGGCCAGCTCAATTCCAATAGTAGTCTTTTTAGGCTTCCACAACTTCGTTTTCTAACCACTCTTGACCTTTCTAATAATGATTTTATTGGTCAAATCCCATCTTCACTTGAAACCCTCTCTAATCTCACCACTCTAGACCTTTCTAGAAATCATTTCAGTGGTAGAATTCCTTCTTCGATTGGAAACCTTTCTCATCTCATATTTGTTGACTTCTCTCATAACAATTTTAGTGGTCAAATCCCATCTTCACTTGGATATCTTTCGCATCTCACCTCTTTTAACCTTTCTTATAACAATTTTAGTGGTAGGGTTCCTTCTTCAATTGGAAATCTCTCTTATCTCACCACTTTGCGCCTCTCTCGTAATAGTTTTTTTGGTGAACTTCCATCTTCACTTGGAAGTCTTTTCCATCTCACCGATTTGATCCTCGATACTAACCATTTTGTTGGTAAAATTCCGTCTTCACTTGGAAATCTTTCGCATCTCACCTCTATCGACCTCCACAAAAATAATTTTGTTGGCGAAATACCATTTTCACTTGGAAATCTTTCTTGTCTCACCTCTTTTATCCTCTCTGATAACAACATTGTTGGTGAAATTCCATCTTCTTTTGGCAATTTGAACCAGTTGGACATCTTAAATGTTAAGTCCAATAAGCTTAGTGGCAGCTTCCCAATTGCACTACTAAATCTAAGAAAACTGTCAACATTATCTCTCTTTAACAATCGGTTAACCGGAACACTTCCTTCTAACATGAGTTCACTCTCCAACTTGAAGTTGTTTGACGCAACGGAAAACCATTTCACGGGACCTCTCCCTTCTTCCCTTTTCAACATTCCCTCTTTGAAAACTATTACTTTGGAAAATAACCAACTTAACGGTAGTCTTGGGTTTGGGAATATATCCTCATACTCGAATTTAACTGTGTTACGCCTTGGGAATAACAACTTTAGAGGGCCAATCCATAGATCTATATCCAAATTAGTCAACCTTAAGGAACTTGACCTTTCAAACTACAACACCCAAGGGTTAGTTGACTTTACCATCTTCTCGCATCTCAAGTCTATCGAATACCTTAACCTCTCCCATTTGAACACCACTACTACGATTGACATGTACGAGATCTTATCAAGTTTCAAGTTATTGGATACACTAGATCTCTCAGGCAGCCATGTTTCTACTACAAACAAGAGTTCACTTTCTAATTCTTCATTGGTATTGATAAGTCAGTTGTACTTGTCGGGATGCGGTATCACCGAGTTTCCAAAGTTCCTAAGATCCCAAGAGCTTATGCTGACTCTAGACATTTCCAACAACAAGATCAAAGGTCAAGTGCCTGGATGGTTATGGATGCTCCCTGTTTTGAACTACGTGAATCTTTCCAACAACACTTTCATCGGTTTCGAAAGATCAACGAAACTTGGACTCACCTCTATCCAAGAACCACCAGCTATGAGGCAATTGTTTTGCTCCAACAACAATTTCACGGGAAACATTCCATCTTTCATATGTGAGTTGCCTTATCTCAGCACTCTCGATTTTTCTAACAACAAATTCAATGGTTCAATTCCTACTTGTATGGGAAATATTCAGTCTCCATATCTTCAAGCTCTAAATCTTCGACATAATCGTCTTAGTGGACTTCTTCCAGAGAATATATTTGAGAGTCTAATTTCTCTTGACGTCGGCCATAACCAACTAGTGGGAAAGCTTCCAAGATCGTTAAGTCATATCTCTTCCCTTGGACTTCTGAATGTGGAGAGCAACAAAATCAGTGATACGTTTCCTTTATGGTTGAGTTCTCTACAAGAGCTACAAGTTCTTGTCCTTCGCTCCAATGCATTTTATGGACCAATAGAGAAAACACAGTTTTCTAAGCTGCGAATCATTGACATATCCGGTAATCAATTCAATGGTACGTTGCCAGCAAATTTCTTTGTCAACTGGACTGCAATGTTTTCACTGGACGAAAATGAAGATCAATCTAACGGAGAGACCATGAGCAACATGTACATGAGTACAGATTATTTCTACTTTGATTCAATGGTTTTGATGAATAAAGGAGTAGAGATGGAGCTGGAACGTGTCCTAAAAGTCTTCACAGTGATTGACTTTTCGGGAAACAAATTTGAAGGAGAGATTCCAAAGTCCATTGGTTTATTGAAAGAGCTTCATGTTCTTAACTTATCAAACAATGCTTTAAGTGGCCACATCGCATCATCTATGGGGAACCTCATGGCACTTGAGTCACTGGACGTTTCCCAAAACAAGCTTTCAGGAGAAATTCCACAAGAGTTAGGGAAACTCACGTACCTTGCATACATGAACTTCTCTCATAACCAGCTGGTAGGTCTATTACCAGGAGGTACTCAATTTCAAACACAGAAGTGCTCTTCTTTCGAGGACAATCATGGCCTTTATGGCCCTTCGCTTGAGAAAATTTGTGATATCCATGGGAAAACACCGCAACAATCTGACATGGCGCCAGAGCCAGAAGAAGATGAAGAAGAGGTGATAAGTTGGATAGCAGCTGTTATAGGATTCATACTTGGTACTGCCTTGGGATTGACATTTGGATGCATATTGTTTTCCTACAAACCAGATTGGTTCAAGAATCCTTTCGTCCGAGACAAACGCAGAAACATAGGCACCATAACTCATTAGAGAGTTGGAGAATTTTACACGAAGTAAACAAAGGAACAAAACCGGAAGAAACTTGGGAGGAAAGCAATCTAATTTTAAATAATCATTTTTTCTGTCTCCTCCTCCCCCCCCATTGTTATGTCTATGTCCATTTTTAAATACAATGTAAAAATGAATAGTATCATAAAAAAATTGT

SEQ ID NO: 2005 - DNA, 1098 bp, Arabidopsis thaliana
  misc_feature (1)..(1098): Ceres cDNA ID no. 12730974
  misc_feature (1)..(1098): Also known as  Ceres CDNA ID no. 23372771
atgggttcgtcacaaggctccacactctcggctgatgtgatgagccttgtggatacattgcctgtgcttgcaaaaacccttatcgctggaggagctgctggggcaattgctaagactgctgttgcacctttggaaaggatcaaaattctattgcagactagaacaaacgactttaagacccttggtgtgtcccagtcattaaagaaggtgttacaatttgatggtcctctcggattctataaaggaaatggggcgagtgttattcggattattccatatgccgcccttcattacatgacgtatgaagtttatcgtgactggattttggaaaaaaatcttcccttaggttctggtccaattgttgatcttgtggctggttcagctgcaggtggaacagcagttttgtgcacatatccccttgatttagctcgtactaagctagcttaccaggtttctgacacaagacagagtctccgaggtggtgcgaatggattttaccgtcaacctacttattcaggcataaaagaggtgcttgcaatggcttataaagaagggggaccacgcgggctatatcgtggcatagggccaacgctgatcgggatccttccttacgcggggcttaagttctacatatatgaggaattgaaaaggcatgttcctgaagagcatcaaaactctgttcgaatgcatctaccatgtggagctttagctggtttatttggccagaccatcacttacccattggacgttgttaggagacaaatgcaggtagagaatctgcaacctatgacgagtgaaggcaacaacaagcgttacaagaacacatttgatgggcttaacacgattgttcgaactcagggttggaaacagttgtttgctggtttaagcatcaactacattaagattgttccatcggttgcgattggattcacagtctatgagtcgatgaagtcatggatgcgaattccaccgcgcgagagatcaaagccagcatgagggtctttgttccttcactctcttatagaagacacagaagacagaagaaaacatgattgttagacagatttttttttccctacttcttttcattttcaaggc

SEQ ID NO: 2006 - protein, 1098 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGGGTTCGTCACAAGGCTCCACACTCTCGGCTGATGTGATGAGCCTTGTGGATACATTGCCTGTGCTTGCAAAAACCCTTATCGCTGGAGGAGCTGCTGGGGCAATTGCTAAGACTGCTGTTGCACCTTTGGAAAGGATCAAAATTCTATTGCAGACTAGAACAAACGACTTTAAGACCCTTGGTGTGTCCCAGTCATTAAAGAAGGTGTTACAATTTGATGGTCCTCTCGGATTCTATAAAGGAAATGGGGCGAGTGTTATTCGGATTATTCCATATGCCGCCCTTCATTACATGACGTATGAAGTTTATCGTGACTGGATTTTGGAAAAAAATCTTCCCTTAGGTTCTGGTCCAATTGTTGATCTTGTGGCTGGTTCAGCTGCAGGTGGAACAGCAGTTTTGTGCACATATCCCCTTGATTTAGCTCGTACTAAGCTAGCTTACCAGGTTTCTGACACAAGACAGAGTCTCCGAGGTGGTGCGAATGGATTTTACCGTCAACCTACTTATTCAGGCATAAAAGAGGTGCTTGCAATGGCTTATAAAGAAGGGGGACCACGCGGGCTATATCGTGGCATAGGGCCAACGCTGATCGGGATCCTTCCTTACGCGGGGCTTAAGTTCTACATATATGAGGAATTGAAAAGGCATGTTCCTGAAGAGCATCAAAACTCTGTTCGAATGCATCTACCATGTGGAGCTTTAGCTGGTTTATTTGGCCAGACCATCACTTACCCATTGGACGTTGTTAGGAGACAAATGCAGGTAGAGAATCTGCAACCTATGACGAGTGAAGGCAACAACAAGCGTTACAAGAACACATTTGATGGGCTTAACACGATTGTTCGAACTCAGGGTTGGAAACAGTTGTTTGCTGGTTTAAGCATCAACTACATTAAGATTGTTCCATCGGTTGCGATTGGATTCACAGTCTATGAGTCGATGAAGTCATGGATGCGAATTCCACCGCGCGAGAGATCAAAGCCAGCATGAGGGTCTTTGTTCCTTCACTCTCTTATAGAAGACACAGAAGACAGAAGAAAACATGATTGTTAGACAGATTTTTTTTTCCCTACTTCTTTTCATTTTCAAGGC

SEQ ID NO: 2007 - DNA, 2175 bp, Arabidopsis thaliana
  misc_feature (1)..(2175): Ceres cDNA ID no. 12731454
  misc_feature (1)..(2175): Also known as  Ceres CDNA ID no. 23372771
atgcttttgaagtttgaagcttcttcagagttgagactagttgacccttcagtttctctcactgttcttcgaaagataagactgtcacatctcccggatatgacaatgaccagcgaatcttccggcaagaaatgcggagagggtgacggcaaagtcgccggtaaaagccagcgaaaggtgggtcttgtttatgacgagaccatgtgcaaacacgacacacctaacggtaaggttgacgtagagtgtcccgatcgtatcagagttatctgggagaagcttcagctcgccggagtcactcaaagatgtgtggttcttggtggtagtaaagctgaagataagcatctcaaattggttcacacaaagaaacatgttaatttagtgaagagtattagcacaaaaaagaaagattctcggagaaacaagattgcttcacagttggattcgatttatctgaatggaggttcatctgaagctgcatatcttgcagctggatctgttgtaaaggtggcagagaaagttgcagaaggagagttagattgtggctttgctattgtcaggcccccaggacaccatgccgagtcagatgaagccatgggtttttgtttattcaacaatgttgccgttgctgctagttttttactaaacgaaagacctgatctagatgtcaagaaaattctgattgtcgattgggatatccatcacggaaatggtacacagaagatgttctggaaagattctcgcgtactaatattctctgttcataggcatgatcacggaagtttctatccatttggcgatgatggagactttaacatggttggcgaaggtccaggtgaagggtttaacattaacgttccatgggagcaaggaggatgtggagatgcagactatcttgccgtatggaaccacatcttgatccctgtgaccaaggaattcaaaccagatattattttgctttcagctggatttgatgcagctattggtgatccgcttgggggttgttgtgttaccccatatggatattcagttatgttgaagaagctgatggagtttgcacatggaaagatagtgctggcattagagggaggatacaatcttgagtcattgggaaagtcttcactcgcatgtgtccaagttttgcttgaagacaaacaaattcatggttcatctgaaacatacccattagaatctacacggcgtgtcatacaagcggtacgcgagagactatgcacatattggccttcacttgacgcgtcaatggcgtctaatgagaatttaaagaacccaagtgcagaaagaaactccgctgacgccctccttcgtgaagtggaagagttaaagtctctaatggctgcccgagatggagaactggaggcaaggagaaaagagttaaaggccaaaaataaggagctagaagcgaacgagaaggagctagaagcgggactaatgttgattcgcgctcgggaggatgtaatctgtggtcttcatgcaaaaatagagagtttgcagcaggagcgagatgaggcggtagcgaaagctgaacgcatagataaggaactccaagaggatagggcaagaagccaggagttcaaagaagacacagagttttgcttgagtacgttaaggagggagaaggagcttgccatcatggccaaaaataaggacctagaagcgaaagagaaggagctagaagcgcggctaatgttggttcacgctcgggaggataaaattcatgccaaaatagagaggttgcagcaggagcgagatgaggccgtagcaaaagctgaacgcatagataaggaactccaagaggataggtcaagaagccgagttgggaatggatcttttgccttttctcaggagttctatgaagacatggacttagacgagctcgaacctctgtctccggagttcaatgaagacatggactcggaagagcttgaaccgtttcaggtcatcaagaaaaacatggagcgttcccacaagaagttcataaaagatatggagtgtatcaagtttatcgccagtgagagagccagggtactttaggttgggagcttgaggccgtagcagaagactaccacaagtttcgcgagatggttgataagctcgggaagagcaacatatacccttcttagaaagtacaatggtgtttcattgtaaccacagaacctt

SEQ ID NO: 2008 - protein, 2175 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGCTTTTGAAGTTTGAAGCTTCTTCAGAGTTGAGACTAGTTGACCCTTCAGTTTCTCTCACTGTTCTTCGAAAGATAAGACTGTCACATCTCCCGGATATGACAATGACCAGCGAATCTTCCGGCAAGAAATGCGGAGAGGGTGACGGCAAAGTCGCCGGTAAAAGCCAGCGAAAGGTGGGTCTTGTTTATGACGAGACCATGTGCAAACACGACACACCTAACGGTAAGGTTGACGTAGAGTGTCCCGATCGTATCAGAGTTATCTGGGAGAAGCTTCAGCTCGCCGGAGTCACTCAAAGATGTGTGGTTCTTGGTGGTAGTAAAGCTGAAGATAAGCATCTCAAATTGGTTCACACAAAGAAACATGTTAATTTAGTGAAGAGTATTAGCACAAAAAAGAAAGATTCTCGGAGAAACAAGATTGCTTCACAGTTGGATTCGATTTATCTGAATGGAGGTTCATCTGAAGCTGCATATCTTGCAGCTGGATCTGTTGTAAAGGTGGCAGAGAAAGTTGCAGAAGGAGAGTTAGATTGTGGCTTTGCTATTGTCAGGCCCCCAGGACACCATGCCGAGTCAGATGAAGCCATGGGTTTTTGTTTATTCAACAATGTTGCCGTTGCTGCTAGTTTTTTACTAAACGAAAGACCTGATCTAGATGTCAAGAAAATTCTGATTGTCGATTGGGATATCCATCACGGAAATGGTACACAGAAGATGTTCTGGAAAGATTCTCGCGTACTAATATTCTCTGTTCATAGGCATGATCACGGAAGTTTCTATCCATTTGGCGATGATGGAGACTTTAACATGGTTGGCGAAGGTCCAGGTGAAGGGTTTAACATTAACGTTCCATGGGAGCAAGGAGGATGTGGAGATGCAGACTATCTTGCCGTATGGAACCACATCTTGATCCCTGTGACCAAGGAATTCAAACCAGATATTATTTTGCTTTCAGCTGGATTTGATGCAGCTATTGGTGATCCGCTTGGGGGTTGTTGTGTTACCCCATATGGATATTCAGTTATGTTGAAGAAGCTGATGGAGTTTGCACATGGAAAGATAGTGCTGGCATTAGAGGGAGGATACAATCTTGAGTCATTGGGAAAGTCTTCACTCGCATGTGTCCAAGTTTTGCTTGAAGACAAACAAATTCATGGTTCATCTGAAACATACCCATTAGAATCTACACGGCGTGTCATACAAGCGGTACGCGAGAGACTATGCACATATTGGCCTTCACTTGACGCGTCAATGGCGTCTAATGAGAATTTAAAGAACCCAAGTGCAGAAAGAAACTCCGCTGACGCCCTCCTTCGTGAAGTGGAAGAGTTAAAGTCTCTAATGGCTGCCCGAGATGGAGAACTGGAGGCAAGGAGAAAAGAGTTAAAGGCCAAAAATAAGGAGCTAGAAGCGAACGAGAAGGAGCTAGAAGCGGGACTAATGTTGATTCGCGCTCGGGAGGATGTAATCTGTGGTCTTCATGCAAAAATAGAGAGTTTGCAGCAGGAGCGAGATGAGGCGGTAGCGAAAGCTGAACGCATAGATAAGGAACTCCAAGAGGATAGGGCAAGAAGCCAGGAGTTCAAAGAAGACACAGAGTTTTGCTTGAGTACGTTAAGGAGGGAGAAGGAGCTTGCCATCATGGCCAAAAATAAGGACCTAGAAGCGAAAGAGAAGGAGCTAGAAGCGCGGCTAATGTTGGTTCACGCTCGGGAGGATAAAATTCATGCCAAAATAGAGAGGTTGCAGCAGGAGCGAGATGAGGCCGTAGCAAAAGCTGAACGCATAGATAAGGAACTCCAAGAGGATAGGTCAAGAAGCCGAGTTGGGAATGGATCTTTTGCCTTTTCTCAGGAGTTCTATGAAGACATGGACTTAGACGAGCTCGAACCTCTGTCTCCGGAGTTCAATGAAGACATGGACTCGGAAGAGCTTGAACCGTTTCAGGTCATCAAGAAAAACATGGAGCGTTCCCACAAGAAGTTCATAAAAGATATGGAGTGTATCAAGTTTATCGCCAGTGAGAGAGCCAGGGTACTTTAGGTTGGGAGCTTGAGGCCGTAGCAGAAGACTACCACAAGTTTCGCGAGATGGTTGATAAGCTCGGGAAGAGCAACATATACCCTTCTTAGAAAGTACAATGGTGTTTCATTGTAACCACAGAACCTT

SEQ ID NO: 2009 - DNA, 2110 bp, Arabidopsis thaliana
  misc_feature (1)..(2110): Ceres cDNA ID no. 12731845
  misc_feature (1)..(2110): Also known as  Ceres CDNA ID no. 23372771
attataatccctcaacaattttaaaaaaagatcctgactttcaattttctctcttgtttcttcttttgatcatcttcaacaaaaaaaagttacgatctttctctccgggtcatcggaatttgagctagcttagctaaagttccgatctttcctctctgggtcgtcggaatttgagctttttaaaatcatgggaaattgttttgccaagaaccatggattgatgaagccacagcaaaatggtaataccactagatcagttgaagtaggagtaaccaaccaagatccaccgtcgtatactccacaagcgagaaccactcagcagccggagaaaccaggttccgtgaatagtcaaccaccaccgtggagggcggcggctgcagcaccaggactaagtcccaagaccaccactaagagcaattcaatactagagaacgctttcgaagacgtgaagctcttttacacattgggtaaagagctaggtcgtggtcaatttggggtaacgtatctgtgcacagagaattccacggggaagaagtacgcttgcaaatcgatctcgaagaagaagctggtgactaaagctgataaggatgatatgaggagagagattcagataatgcagcatttgagtgggcagcctaatattgtggagtttaaaggagcttatgaggatgagaaagctgtgaatttggtgatggagctttgtgctggtggtgaattgtttgatagaatcattgctaagggacattacactgagagagctgctgcttctgtttgtagacagattgtgaatgttgtcaagatttgtcatttcatgggtgtgttgcatagagacttgaagcctgagaatttcttgctctctagcaaagatgagaaggctttgatcaaggctactgatttcggattgtctgtctttattgaagagggaaaagtatatagagatattgttgggagtgcatactatgttgctccagaagtcttacgtcgcagatatgggaaagaagttgatatctggagtgctggaatcatcttatacattctactcagcggtgtgcccccgttttgggctgagactgagaaaggaatatttgatgctatattggaaggccatatcgactttgagagccaaccatggccgtcaatctccagcagtgccaaagatttggtacgtagaatgttgactgcggatccaaaaaggcggatttctgctgctgatgttcttcagcatccatggcttagagaaggtggagaagcatcagacaagccaattgacagtgctgttctctcaaggatgaaacaatttagagcaatgaataagctaaagaaacttgctttaaaggtcatagcggagaatattgacacggaagaaatccaaggattgaaggcaatgtttgctaacatagacactgacaacagtggcacaatcacttatgaagaactgaaagaaggattagccaaattgggatctaaactcacagaggcagaagtgaaacagctcatggatgctgctgatgttgatgggaacgggtccatcgactacatagagtttattacagcaacaatgcataggcacaggcttgaaagtaatgagaatctttacaaagctttccagcattttgacaaagacagcagcggatacattacaatagacgaactggaatctgcattgaaggaatatggaatgggagatgatgcaacaatcaaagaggttttgtcagatgtcgactccgataacgatggtagaatcaactatgaagagttctgcgcaatgatgagaagtggaaatccacaacaacaacaacctcggctgttctagtggacattgttgctggattaaaagtctttttgtttgtatctaatccagaaaaatcaggagctgaattaatgtttgttcagacaaaaaccacgtaaagaggaagatactcaaaactctgattgcttgtgttttgtattttgttcttcacttcttctgttttgtcctttgtgttctgtactcaggctgttgtgatatgagagaaagagaggtttcatttttaccgttaagattttgatcctgactgtgttaacattttacctcagttcctccacttttaatgtgattctccattccatc

SEQ ID NO: 2010 - protein, 2110 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATTATAATCCCTCAACAATTTTAAAAAAAGATCCTGACTTTCAATTTTCTCTCTTGTTTCTTCTTTTGATCATCTTCAACAAAAAAAAGTTACGATCTTTCTCTCCGGGTCATCGGAATTTGAGCTAGCTTAGCTAAAGTTCCGATCTTTCCTCTCTGGGTCGTCGGAATTTGAGCTTTTTAAAATCATGGGAAATTGTTTTGCCAAGAACCATGGATTGATGAAGCCACAGCAAAATGGTAATACCACTAGATCAGTTGAAGTAGGAGTAACCAACCAAGATCCACCGTCGTATACTCCACAAGCGAGAACCACTCAGCAGCCGGAGAAACCAGGTTCCGTGAATAGTCAACCACCACCGTGGAGGGCGGCGGCTGCAGCACCAGGACTAAGTCCCAAGACCACCACTAAGAGCAATTCAATACTAGAGAACGCTTTCGAAGACGTGAAGCTCTTTTACACATTGGGTAAAGAGCTAGGTCGTGGTCAATTTGGGGTAACGTATCTGTGCACAGAGAATTCCACGGGGAAGAAGTACGCTTGCAAATCGATCTCGAAGAAGAAGCTGGTGACTAAAGCTGATAAGGATGATATGAGGAGAGAGATTCAGATAATGCAGCATTTGAGTGGGCAGCCTAATATTGTGGAGTTTAAAGGAGCTTATGAGGATGAGAAAGCTGTGAATTTGGTGATGGAGCTTTGTGCTGGTGGTGAATTGTTTGATAGAATCATTGCTAAGGGACATTACACTGAGAGAGCTGCTGCTTCTGTTTGTAGACAGATTGTGAATGTTGTCAAGATTTGTCATTTCATGGGTGTGTTGCATAGAGACTTGAAGCCTGAGAATTTCTTGCTCTCTAGCAAAGATGAGAAGGCTTTGATCAAGGCTACTGATTTCGGATTGTCTGTCTTTATTGAAGAGGGAAAAGTATATAGAGATATTGTTGGGAGTGCATACTATGTTGCTCCAGAAGTCTTACGTCGCAGATATGGGAAAGAAGTTGATATCTGGAGTGCTGGAATCATCTTATACATTCTACTCAGCGGTGTGCCCCCGTTTTGGGCTGAGACTGAGAAAGGAATATTTGATGCTATATTGGAAGGCCATATCGACTTTGAGAGCCAACCATGGCCGTCAATCTCCAGCAGTGCCAAAGATTTGGTACGTAGAATGTTGACTGCGGATCCAAAAAGGCGGATTTCTGCTGCTGATGTTCTTCAGCATCCATGGCTTAGAGAAGGTGGAGAAGCATCAGACAAGCCAATTGACAGTGCTGTTCTCTCAAGGATGAAACAATTTAGAGCAATGAATAAGCTAAAGAAACTTGCTTTAAAGGTCATAGCGGAGAATATTGACACGGAAGAAATCCAAGGATTGAAGGCAATGTTTGCTAACATAGACACTGACAACAGTGGCACAATCACTTATGAAGAACTGAAAGAAGGATTAGCCAAATTGGGATCTAAACTCACAGAGGCAGAAGTGAAACAGCTCATGGATGCTGCTGATGTTGATGGGAACGGGTCCATCGACTACATAGAGTTTATTACAGCAACAATGCATAGGCACAGGCTTGAAAGTAATGAGAATCTTTACAAAGCTTTCCAGCATTTTGACAAAGACAGCAGCGGATACATTACAATAGACGAACTGGAATCTGCATTGAAGGAATATGGAATGGGAGATGATGCAACAATCAAAGAGGTTTTGTCAGATGTCGACTCCGATAACGATGGTAGAATCAACTATGAAGAGTTCTGCGCAATGATGAGAAGTGGAAATCCACAACAACAACAACCTCGGCTGTTCTAGTGGACATTGTTGCTGGATTAAAAGTCTTTTTGTTTGTATCTAATCCAGAAAAATCAGGAGCTGAATTAATGTTTGTTCAGACAAAAACCACGTAAAGAGGAAGATACTCAAAACTCTGATTGCTTGTGTTTTGTATTTTGTTCTTCACTTCTTCTGTTTTGTCCTTTGTGTTCTGTACTCAGGCTGTTGTGATATGAGAGAAAGAGAGGTTTCATTTTTACCGTTAAGATTTTGATCCTGACTGTGTTAACATTTTACCTCAGTTCCTCCACTTTTAATGTGATTCTCCATTCCATC

SEQ ID NO: 2011 - DNA, 2369 bp, Arabidopsis thaliana
  misc_feature (1)..(2369): Ceres cDNA ID no. 12731913
  misc_feature (1)..(2369): Also known as  Ceres CDNA ID no. 23372771
gagagatttgtgtttggtgttaaaaatcgcatgaatgctggaaatggaaagagttgctgagctcaagagacttcctagtaaaggtcctgtctctggtcacttatcaagaagaccatacttagactttgaaactagagatgccccgggtatgcatttggagagtttgagggaacgagctgctcgatacaacacgggaagatctgtgaatccaactacgacattggggagagaactaagccaagttctgaatgtgcatagggaagatatgatgatgactcagtttggtggtaacatgaatgattttcaggagtttgagcctgttgtatcgtctgttagaacgatgaaggccaagtatcctttgttggagattgaagaaattggagctgctgatgatgatgttacttgtaagggaagcaatgatatgtctgaggaagctggttctagctccttccgtggagttagtcatcctccagagcctgacgatatggatctaataacaactgtttatgtgcccatcagcgagaaaaacaaacctgattcggtttgcttgatgaagagcatgtctactactaaaggaccctttatcgaggatatttcgctctgtgtgcctccaaagaagccaagcccgagagtactttcacctgcagaaagcatagttgaggaacctgctacatcgctgtccccgttctctgtggctcgtgcatcgcagaacactgaaaactctctgctaccaccagattcagacaaagaatgtgtttgggatgcttctctgcctcccagtaccaatgtgagcccacatagcagtagtgttgaaagtatgaatttggctcgggctatgagtattgctaatagctcttctgcaacaagtactactcagcggagcgatgttgtgcttagtatggacaagaactactttgacaggagtatcagtatggttttggattcgtttgaaagcaccaagaccagtgcaagcagagcaagtgatagtagcggcctaagcgaagagagcagctggagcaatttcacgggaagccttaataagccacacaaagggaatgatccttggtggaatgctatcttggctatccgaacccgagatgggattttgggaatgagccacttcaagttgctgaaacgattaggttgtggtgatattgggagtgtctatctggctgaattaagcggaactcgatgccattttgctgtgaaagtcatggataaagcgtctcttgaggaccggaagaagttgaatcgagctcagaccgagagggatattctacaactattggatcatccgtttctaccgacattgtacactcattttgagactgacagattctcgtgtttggtcatggaatactgtcctggaggtgatctgcacactctaaggcaacgtcaacccgggaagcatttctcggagtacgctgctcgattttacgctgcagaggtgttgctagcactagagtatctccacatgctcggtgttgtttacagagacttgaagcctgagaatgttctggttcgagatgatggtcacataatgctttcagactttgatctctccttgaggtgcgcggtttcgccaacactgatcaaaacattcgactccgatccatctagacgaggcgcattctgcgttcaacctgcttgtatggagcctacatcagcttgcatcattcaaccctcatgcttcttaccgcgcagcatcttccctaacaaaaacaaaaaaaacaagtcccgtaaaacccaggcggatttcttcaaatcacactctggttctctcccagagctagtagctgaacctaacacacggtccatgtcctttgttggaacccacgagtacttagctccagagatcatcaaaggagaaggacatggaagcgcagtggattggtggacttttggtatctttgtgcatgagctcctatatgggaaaaccccgtttaaaggatcaggaaatcgagctactctgttcaatgtagtcggcgaacagttgaaattccccgagtcaccagcaactagctatgcaggcagggacttgatacaggctttactggtgaaagatccaaagaacaggttagggacaaagagaggagcaacggagataaagcagcatccattctttgaaggtgtgaattgggcattgataaggtgtagcactccacctgaagtaccgagacagatggagaccgaaccgccaccaaagtatggaccgattgatccggttgggtttggtagtaatagcaaaaggatgatgggaccaccagcagtatcagcagcagcagcagacacgaaatctggtggtaaatttctagactttgagtttttctaaagcttccaagatttggttccgtagtagccatttttag

SEQ ID NO: 2012 - protein, 2369 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
GAGAGATTTGTGTTTGGTGTTAAAAATCGCATGAATGCTGGAAATGGAAAGAGTTGCTGAGCTCAAGAGACTTCCTAGTAAAGGTCCTGTCTCTGGTCACTTATCAAGAAGACCATACTTAGACTTTGAAACTAGAGATGCCCCGGGTATGCATTTGGAGAGTTTGAGGGAACGAGCTGCTCGATACAACACGGGAAGATCTGTGAATCCAACTACGACATTGGGGAGAGAACTAAGCCAAGTTCTGAATGTGCATAGGGAAGATATGATGATGACTCAGTTTGGTGGTAACATGAATGATTTTCAGGAGTTTGAGCCTGTTGTATCGTCTGTTAGAACGATGAAGGCCAAGTATCCTTTGTTGGAGATTGAAGAAATTGGAGCTGCTGATGATGATGTTACTTGTAAGGGAAGCAATGATATGTCTGAGGAAGCTGGTTCTAGCTCCTTCCGTGGAGTTAGTCATCCTCCAGAGCCTGACGATATGGATCTAATAACAACTGTTTATGTGCCCATCAGCGAGAAAAACAAACCTGATTCGGTTTGCTTGATGAAGAGCATGTCTACTACTAAAGGACCCTTTATCGAGGATATTTCGCTCTGTGTGCCTCCAAAGAAGCCAAGCCCGAGAGTACTTTCACCTGCAGAAAGCATAGTTGAGGAACCTGCTACATCGCTGTCCCCGTTCTCTGTGGCTCGTGCATCGCAGAACACTGAAAACTCTCTGCTACCACCAGATTCAGACAAAGAATGTGTTTGGGATGCTTCTCTGCCTCCCAGTACCAATGTGAGCCCACATAGCAGTAGTGTTGAAAGTATGAATTTGGCTCGGGCTATGAGTATTGCTAATAGCTCTTCTGCAACAAGTACTACTCAGCGGAGCGATGTTGTGCTTAGTATGGACAAGAACTACTTTGACAGGAGTATCAGTATGGTTTTGGATTCGTTTGAAAGCACCAAGACCAGTGCAAGCAGAGCAAGTGATAGTAGCGGCCTAAGCGAAGAGAGCAGCTGGAGCAATTTCACGGGAAGCCTTAATAAGCCACACAAAGGGAATGATCCTTGGTGGAATGCTATCTTGGCTATCCGAACCCGAGATGGGATTTTGGGAATGAGCCACTTCAAGTTGCTGAAACGATTAGGTTGTGGTGATATTGGGAGTGTCTATCTGGCTGAATTAAGCGGAACTCGATGCCATTTTGCTGTGAAAGTCATGGATAAAGCGTCTCTTGAGGACCGGAAGAAGTTGAATCGAGCTCAGACCGAGAGGGATATTCTACAACTATTGGATCATCCGTTTCTACCGACATTGTACACTCATTTTGAGACTGACAGATTCTCGTGTTTGGTCATGGAATACTGTCCTGGAGGTGATCTGCACACTCTAAGGCAACGTCAACCCGGGAAGCATTTCTCGGAGTACGCTGCTCGATTTTACGCTGCAGAGGTGTTGCTAGCACTAGAGTATCTCCACATGCTCGGTGTTGTTTACAGAGACTTGAAGCCTGAGAATGTTCTGGTTCGAGATGATGGTCACATAATGCTTTCAGACTTTGATCTCTCCTTGAGGTGCGCGGTTTCGCCAACACTGATCAAAACATTCGACTCCGATCCATCTAGACGAGGCGCATTCTGCGTTCAACCTGCTTGTATGGAGCCTACATCAGCTTGCATCATTCAACCCTCATGCTTCTTACCGCGCAGCATCTTCCCTAACAAAAACAAAAAAAACAAGTCCCGTAAAACCCAGGCGGATTTCTTCAAATCACACTCTGGTTCTCTCCCAGAGCTAGTAGCTGAACCTAACACACGGTCCATGTCCTTTGTTGGAACCCACGAGTACTTAGCTCCAGAGATCATCAAAGGAGAAGGACATGGAAGCGCAGTGGATTGGTGGACTTTTGGTATCTTTGTGCATGAGCTCCTATATGGGAAAACCCCGTTTAAAGGATCAGGAAATCGAGCTACTCTGTTCAATGTAGTCGGCGAACAGTTGAAATTCCCCGAGTCACCAGCAACTAGCTATGCAGGCAGGGACTTGATACAGGCTTTACTGGTGAAAGATCCAAAGAACAGGTTAGGGACAAAGAGAGGAGCAACGGAGATAAAGCAGCATCCATTCTTTGAAGGTGTGAATTGGGCATTGATAAGGTGTAGCACTCCACCTGAAGTACCGAGACAGATGGAGACCGAACCGCCACCAAAGTATGGACCGATTGATCCGGTTGGGTTTGGTAGTAATAGCAAAAGGATGATGGGACCACCAGCAGTATCAGCAGCAGCAGCAGACACGAAATCTGGTGGTAAATTTCTAGACTTTGAGTTTTTCTAAAGCTTCCAAGATTTGGTTCCGTAGTAGCCATTTTTAG

SEQ ID NO: 2013 - DNA, 1437 bp, Arabidopsis thaliana
  misc_feature (1)..(1437): Ceres cDNA ID no. 12732189
  misc_feature (1)..(1437): Also known as  Ceres CDNA ID no. 23372771
atgaatctgttggccttcgtcgttggatttggaatcatgggtattgttatggtagatgggctaggtgtcaactggggaacaatggctacacataagcttccaccaaagaaagtggttcaaatgcttaaggacaataacattaacaaagttaagctttttgatgcggatgagaccactatgagtgcactttctggctctggtcttgaagttatggttgctattcctaatgatcagcttaaggttatgggaagttatgaccgagctaaagattgggttcataagaatgtcactcgttataacttcaatggtggtgtcaatatcacgtttgtagctgttggaaatgagccattcctcaaatcatacaatggatcatttataaacctcacattccctgcacttcaaaacatccaaaacgctttgaatgaagctggactaggaagctccgtcaaagcgacagtccctttaaacgcggatgtctacgattcaccatcaagcaaccctgtgccatctgcaggaagattccgtcctgatatcatcggtcaaatgactcagattgttgactttcttggcaataacagtgcacccatcaccattaacatctaccctttcttaagcctctatgggaatgatgattttccactcaattacgccttctttgatggtgctaaaccagtagatgacaatggtattgcttacacaaacgttttcgatgccaatttcgacactttggtatcggctttgaaagctgttggtcatggagatatgccaatcatcgttggagaagtcggttggccaacagagggtgacaaacacgcaaatagtggcagtgcttacagattctacaacggtcttttaccaaggcttggggaaaacagaggcactccactgagaccaacctacattgaggtatacttgtttggattacttgatgaggatgcgaaaagtatagcaccgggagagtttgaacgccactggggaatattcaaattcgacgggcaaccaaagtttcctatagatctatcaggtcaaggacagaacaagttgttgattggtgccgagaacgtgacgtatcaacctaagaagtggtgtatgtttaatacagaagccaaagatttgacaaaactcgctgctaacatagattacgcctgcactttttcggattgcactgcgcttggttacgggtcttcttgcaatactcttgatgcaaatgggaacgcttcatatgcgtttaacatgtattttcaagtaaagaaccaggatgaggatgcttgtatcttccaaggtttggccaccattaccacaaagaatatatctcagggacaatgcaatttccctattcagattgttgcttccacagcttcttcattttcttcttctttggttttgttgatcgctggagtttggtttctcttatcaggagtgatgtttgaggtttag

SEQ ID NO: 2014 - protein, 1437 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGAATCTGTTGGCCTTCGTCGTTGGATTTGGAATCATGGGTATTGTTATGGTAGATGGGCTAGGTGTCAACTGGGGAACAATGGCTACACATAAGCTTCCACCAAAGAAAGTGGTTCAAATGCTTAAGGACAATAACATTAACAAAGTTAAGCTTTTTGATGCGGATGAGACCACTATGAGTGCACTTTCTGGCTCTGGTCTTGAAGTTATGGTTGCTATTCCTAATGATCAGCTTAAGGTTATGGGAAGTTATGACCGAGCTAAAGATTGGGTTCATAAGAATGTCACTCGTTATAACTTCAATGGTGGTGTCAATATCACGTTTGTAGCTGTTGGAAATGAGCCATTCCTCAAATCATACAATGGATCATTTATAAACCTCACATTCCCTGCACTTCAAAACATCCAAAACGCTTTGAATGAAGCTGGACTAGGAAGCTCCGTCAAAGCGACAGTCCCTTTAAACGCGGATGTCTACGATTCACCATCAAGCAACCCTGTGCCATCTGCAGGAAGATTCCGTCCTGATATCATCGGTCAAATGACTCAGATTGTTGACTTTCTTGGCAATAACAGTGCACCCATCACCATTAACATCTACCCTTTCTTAAGCCTCTATGGGAATGATGATTTTCCACTCAATTACGCCTTCTTTGATGGTGCTAAACCAGTAGATGACAATGGTATTGCTTACACAAACGTTTTCGATGCCAATTTCGACACTTTGGTATCGGCTTTGAAAGCTGTTGGTCATGGAGATATGCCAATCATCGTTGGAGAAGTCGGTTGGCCAACAGAGGGTGACAAACACGCAAATAGTGGCAGTGCTTACAGATTCTACAACGGTCTTTTACCAAGGCTTGGGGAAAACAGAGGCACTCCACTGAGACCAACCTACATTGAGGTATACTTGTTTGGATTACTTGATGAGGATGCGAAAAGTATAGCACCGGGAGAGTTTGAACGCCACTGGGGAATATTCAAATTCGACGGGCAACCAAAGTTTCCTATAGATCTATCAGGTCAAGGACAGAACAAGTTGTTGATTGGTGCCGAGAACGTGACGTATCAACCTAAGAAGTGGTGTATGTTTAATACAGAAGCCAAAGATTTGACAAAACTCGCTGCTAACATAGATTACGCCTGCACTTTTTCGGATTGCACTGCGCTTGGTTACGGGTCTTCTTGCAATACTCTTGATGCAAATGGGAACGCTTCATATGCGTTTAACATGTATTTTCAAGTAAAGAACCAGGATGAGGATGCTTGTATCTTCCAAGGTTTGGCCACCATTACCACAAAGAATATATCTCAGGGACAATGCAATTTCCCTATTCAGATTGTTGCTTCCACAGCTTCTTCATTTTCTTCTTCTTTGGTTTTGTTGATCGCTGGAGTTTGGTTTCTCTTATCAGGAGTGATGTTTGAGGTTTAG

SEQ ID NO: 2015 - DNA, 1047 bp, Arabidopsis thaliana
  misc_feature (1)..(1047): Ceres cDNA ID no. 12732299
  misc_feature (1)..(1047): Also known as  Ceres CDNA ID no. 23372771
atggcgatgatggtcgagaatagctacggtggttacggtggtggcggcggagagaggatacaacttatggtcgaaggtcaaggcaaagctgttccggctccgtttttgacaaagacttatcaacttgttgatgatcctgcgacggatcatgtcgtttcttggggtgatgatgatactacttttgtcgtttggcgtccaccggagtttgctcgtgatcttcttcctaattactttaaacataacaacttctctagcttcgttcgtcagctcaatacttatggtttcagaaagattgtaccagatcgatgggagttcgcgaacgagtttttcaagagaggagagaaacatttactctgcgaaatccaccgccgtaaaacatctcaaatgataccacaacaacactctccgttcatgtcacaccaccacgctccgccgcagattccattctccggcggttctttcttcccattaccaccaccacgtgtcaccactccagaagaagaccattactggtgcgacgactcaccaccgtcaagaccacgagtcataccacaacaaattgacacggcggcgcaagtaacggcattgagtgaagacaacgagagattacgacgaagcaacacagtgttaatgtcggaactagctcacatgaagaaactctacaacgacattatctactttgttcaaaaccatgtcaagcctgttgctccaagtaacaactctagttatctctcttcatttctccagaagcaacaacaacaacaacctccaacacttgattattacaatactgccactgtcaatgccactaatctcaatgctttgaactcatctccaccaacttcacaaagctctattacagttcttgaagatgatcacactaatcatcatgatcagagtaatatgagaaagacaaagctttttggagtttcgttgccttcttctaagaagagatcacatcatttctcagaccaaacaagcaaaacgagacttgtgttggatcagtctgatcttgctttgaatctcatgactgcttctacacgttaa

SEQ ID NO: 2016 - protein, 1047 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGGCGATGATGGTCGAGAATAGCTACGGTGGTTACGGTGGTGGCGGCGGAGAGAGGATACAACTTATGGTCGAAGGTCAAGGCAAAGCTGTTCCGGCTCCGTTTTTGACAAAGACTTATCAACTTGTTGATGATCCTGCGACGGATCATGTCGTTTCTTGGGGTGATGATGATACTACTTTTGTCGTTTGGCGTCCACCGGAGTTTGCTCGTGATCTTCTTCCTAATTACTTTAAACATAACAACTTCTCTAGCTTCGTTCGTCAGCTCAATACTTATGGTTTCAGAAAGATTGTACCAGATCGATGGGAGTTCGCGAACGAGTTTTTCAAGAGAGGAGAGAAACATTTACTCTGCGAAATCCACCGCCGTAAAACATCTCAAATGATACCACAACAACACTCTCCGTTCATGTCACACCACCACGCTCCGCCGCAGATTCCATTCTCCGGCGGTTCTTTCTTCCCATTACCACCACCACGTGTCACCACTCCAGAAGAAGACCATTACTGGTGCGACGACTCACCACCGTCAAGACCACGAGTCATACCACAACAAATTGACACGGCGGCGCAAGTAACGGCATTGAGTGAAGACAACGAGAGATTACGACGAAGCAACACAGTGTTAATGTCGGAACTAGCTCACATGAAGAAACTCTACAACGACATTATCTACTTTGTTCAAAACCATGTCAAGCCTGTTGCTCCAAGTAACAACTCTAGTTATCTCTCTTCATTTCTCCAGAAGCAACAACAACAACAACCTCCAACACTTGATTATTACAATACTGCCACTGTCAATGCCACTAATCTCAATGCTTTGAACTCATCTCCACCAACTTCACAAAGCTCTATTACAGTTCTTGAAGATGATCACACTAATCATCATGATCAGAGTAATATGAGAAAGACAAAGCTTTTTGGAGTTTCGTTGCCTTCTTCTAAGAAGAGATCACATCATTTCTCAGACCAAACAAGCAAAACGAGACTTGTGTTGGATCAGTCTGATCTTGCTTTGAATCTCATGACTGCTTCTACACGTTAA

SEQ ID NO: 2017 - DNA, 945 bp, Arabidopsis thaliana
  misc_feature (1)..(945): Ceres cDNA ID no. 12732498
  misc_feature (1)..(945): Also known as  Ceres CDNA ID no. 23372771
atgggtggttgcgtctcctccaacctccttactccgaccgatgacagcagcttctctcacctcaccagctcctccttaagccaacatttcgtcaagctaacttccaccacttacggtcttctcaatctcgactcttcttcaccttctcctccgtctccttcctcctcctcctccgccaaatccgttatcacgccaatgactccgcctgagagattcactatcaacggtaaggaggcggcgatgatgatggttaagtctgagccgacgacggaggttattaacttctgggagctaatgtcaggtttagacggcgatacttgtcgattctctccgattccggtgaaatgtaatggattttccggcggattaaagaaagagaactccgatcctaatttgaaaaaccctaacgattacgaggttttgaaaccgttagatccgaaattagcggaggaatctgagaggttatgtgacggcggagagaatcgcgttgtgatttatacgacgtcgttgcgcggtgttcgacggacgtttgaggcgtgtaacgccgtgagagctgcgattgagagttttggtgtagtggtttgtgagagagatgtgtcaatggatagaggatttagagaagagttatccaatctaatggcggtagaatcgacggcggcggtgttgccgcctcgggtttttgtgaaggggaagtacattggtggagcagaggaagtgatgagattggtggaagaaggattgcttggtgaattgcttaaagagattccgaggaagaaagatcggtgtggcggcggttgcggtggttgcggcggattagcgtttttgccgtgttcgggttgtaatggaagctgtaaagtggtggaaggatgggggaatgatgcagtggtggtgaagtgtaaggagtgtaatgagaatggtcttgttcgttgtccaatatgcagctaa

SEQ ID NO: 2018 - protein, 945 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGGGTGGTTGCGTCTCCTCCAACCTCCTTACTCCGACCGATGACAGCAGCTTCTCTCACCTCACCAGCTCCTCCTTAAGCCAACATTTCGTCAAGCTAACTTCCACCACTTACGGTCTTCTCAATCTCGACTCTTCTTCACCTTCTCCTCCGTCTCCTTCCTCCTCCTCCTCCGCCAAATCCGTTATCACGCCAATGACTCCGCCTGAGAGATTCACTATCAACGGTAAGGAGGCGGCGATGATGATGGTTAAGTCTGAGCCGACGACGGAGGTTATTAACTTCTGGGAGCTAATGTCAGGTTTAGACGGCGATACTTGTCGATTCTCTCCGATTCCGGTGAAATGTAATGGATTTTCCGGCGGATTAAAGAAAGAGAACTCCGATCCTAATTTGAAAAACCCTAACGATTACGAGGTTTTGAAACCGTTAGATCCGAAATTAGCGGAGGAATCTGAGAGGTTATGTGACGGCGGAGAGAATCGCGTTGTGATTTATACGACGTCGTTGCGCGGTGTTCGACGGACGTTTGAGGCGTGTAACGCCGTGAGAGCTGCGATTGAGAGTTTTGGTGTAGTGGTTTGTGAGAGAGATGTGTCAATGGATAGAGGATTTAGAGAAGAGTTATCCAATCTAATGGCGGTAGAATCGACGGCGGCGGTGTTGCCGCCTCGGGTTTTTGTGAAGGGGAAGTACATTGGTGGAGCAGAGGAAGTGATGAGATTGGTGGAAGAAGGATTGCTTGGTGAATTGCTTAAAGAGATTCCGAGGAAGAAAGATCGGTGTGGCGGCGGTTGCGGTGGTTGCGGCGGATTAGCGTTTTTGCCGTGTTCGGGTTGTAATGGAAGCTGTAAAGTGGTGGAAGGATGGGGGAATGATGCAGTGGTGGTGAAGTGTAAGGAGTGTAATGAGAATGGTCTTGTTCGTTGTCCAATATGCAGCTAA

SEQ ID NO: 2019 - DNA, 1050 bp, Arabidopsis thaliana
  misc_feature (1)..(1050): Ceres cDNA ID no. 12732571
  misc_feature (1)..(1050): Also known as  Ceres CDNA ID no. 23372771
atgtcttgtttcttaagctgtgtccgtttcgaaacaaccaccgacaacaacaaacccacgagtacagaatctggttctgtctccggtgttacctgttatacctgggatgatgttgagtctctcacttccaatttctctagacttattggtactggtggctatagtagtatctacttagctcgtgtgtctggttctatcaacgcagctctcaaggttcatgtcagtagtcatcgtctttatcaagtgtttaggtctgagcttgagattttgcttcgtcttcaacatcctcacattgttaagcttcttggttactttgacgattcagaagaaagtggagcactattactagagtaccttcctcaaggtaaccttcaagagaagcttaaccggaacagcaaacaagtgttaccatggagaaacagaaccgctattgcgtttcaggttgcgcaagcaattgaacatattcatgagaaatgtagtcctcagattgtgcacggtgacatcaaatcttccaacatacttcttgacaaacatttcaactccaagctttgtgatttcggatcagctaaagttggtttctcgtctatggttcagccttctaagacgacgtcaactatgtcaccacgatccaagcaagtgatgatgattggttctccagggtacacagatcctcattacttgagaactggtattgcttcgaagaagatggatatgtatgggtttggagtggtggttcttgagttggtttcgggtaaagaagcggttagttctgagagaggtgagatgttggtgcattcaacagcttcgttgatacatgagattcttgattcgaatggagatattggagaagagaaagtgagacagttcttggatccaaggttgtccagggatggtagtattgatttggaagaggttaagacaatgctacgtgtggctgctttctgtcttcgtagccctccatcgctgagaccctctgcttctcaagtagttcaaactcttaacaagaagataccgtctctatctttcctcggttgtggtaaaaaagagtga

SEQ ID NO: 2020 - protein, 1050 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGTCTTGTTTCTTAAGCTGTGTCCGTTTCGAAACAACCACCGACAACAACAAACCCACGAGTACAGAATCTGGTTCTGTCTCCGGTGTTACCTGTTATACCTGGGATGATGTTGAGTCTCTCACTTCCAATTTCTCTAGACTTATTGGTACTGGTGGCTATAGTAGTATCTACTTAGCTCGTGTGTCTGGTTCTATCAACGCAGCTCTCAAGGTTCATGTCAGTAGTCATCGTCTTTATCAAGTGTTTAGGTCTGAGCTTGAGATTTTGCTTCGTCTTCAACATCCTCACATTGTTAAGCTTCTTGGTTACTTTGACGATTCAGAAGAAAGTGGAGCACTATTACTAGAGTACCTTCCTCAAGGTAACCTTCAAGAGAAGCTTAACCGGAACAGCAAACAAGTGTTACCATGGAGAAACAGAACCGCTATTGCGTTTCAGGTTGCGCAAGCAATTGAACATATTCATGAGAAATGTAGTCCTCAGATTGTGCACGGTGACATCAAATCTTCCAACATACTTCTTGACAAACATTTCAACTCCAAGCTTTGTGATTTCGGATCAGCTAAAGTTGGTTTCTCGTCTATGGTTCAGCCTTCTAAGACGACGTCAACTATGTCACCACGATCCAAGCAAGTGATGATGATTGGTTCTCCAGGGTACACAGATCCTCATTACTTGAGAACTGGTATTGCTTCGAAGAAGATGGATATGTATGGGTTTGGAGTGGTGGTTCTTGAGTTGGTTTCGGGTAAAGAAGCGGTTAGTTCTGAGAGAGGTGAGATGTTGGTGCATTCAACAGCTTCGTTGATACATGAGATTCTTGATTCGAATGGAGATATTGGAGAAGAGAAAGTGAGACAGTTCTTGGATCCAAGGTTGTCCAGGGATGGTAGTATTGATTTGGAAGAGGTTAAGACAATGCTACGTGTGGCTGCTTTCTGTCTTCGTAGCCCTCCATCGCTGAGACCCTCTGCTTCTCAAGTAGTTCAAACTCTTAACAAGAAGATACCGTCTCTATCTTTCCTCGGTTGTGGTAAAAAAGAGTGA

SEQ ID NO: 2021 - DNA, 984 bp, Arabidopsis thaliana
  misc_feature (1)..(984): Ceres cDNA ID no. 12732577
  misc_feature (1)..(984): Also known as  Ceres CDNA ID no. 23372771
atgtccgaaccaagtccaatcgctgatccttatgcttatcttaacatcgtaaataatccagatggttcaatcactcgcgacctcagcaacttcccctgcaccgcagctacacctgatccttccccactaaaccccgccgtttcaaaagatcttcccgttaaccaattaaagtcaacgtggctccgtctctaccttccctcctccgccgtcaacgagggtaacgtttcgtctcagaaactccccattgttgtgtattaccatggcggaggattcatcctctgcagcgtcgatatgcaactcttccacgatttctgctccgaggtggctcgtgatctcaacgccatcgtcgtatctccttcgtaccgattagctccagagcatcgattaccggcggcgtatgacgacggagttgaggcgttggattggattaaaacctccgacgatgagtggatcaaatctcacgccgatttctcaaatgtgtttcttatgggaactagcgccggagggaatttggcttacaacgtcggactaagatccgtcgattccgtctccgatctgagtccgttacagatccgtggattgattctacaccatccattcttcggcggagaagagcgaagtgaatctgagattagacttatgaacgatcaggtttgtcctcccatagtcaccgatgtaatgtgggatctgtctcttcccgtcggcgttgaccgagatcatgagtattcgaatccgacggttggagatggatcggagaagttggaaaaaatcggacggttgagatggaaagtgatgatgattggaggagaggatgatccgatgatagatctgcagaaagatgtggcaaagctgatgaagaagaaaggagtagaagtggtggagcattataccggcggccatgttcacggtgctgaaatcagagatccttctaaacgtaaaactctgtttctttccatcaaaaacttcatattctctgttctgtaa

SEQ ID NO: 2022 - protein, 984 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGTCCGAACCAAGTCCAATCGCTGATCCTTATGCTTATCTTAACATCGTAAATAATCCAGATGGTTCAATCACTCGCGACCTCAGCAACTTCCCCTGCACCGCAGCTACACCTGATCCTTCCCCACTAAACCCCGCCGTTTCAAAAGATCTTCCCGTTAACCAATTAAAGTCAACGTGGCTCCGTCTCTACCTTCCCTCCTCCGCCGTCAACGAGGGTAACGTTTCGTCTCAGAAACTCCCCATTGTTGTGTATTACCATGGCGGAGGATTCATCCTCTGCAGCGTCGATATGCAACTCTTCCACGATTTCTGCTCCGAGGTGGCTCGTGATCTCAACGCCATCGTCGTATCTCCTTCGTACCGATTAGCTCCAGAGCATCGATTACCGGCGGCGTATGACGACGGAGTTGAGGCGTTGGATTGGATTAAAACCTCCGACGATGAGTGGATCAAATCTCACGCCGATTTCTCAAATGTGTTTCTTATGGGAACTAGCGCCGGAGGGAATTTGGCTTACAACGTCGGACTAAGATCCGTCGATTCCGTCTCCGATCTGAGTCCGTTACAGATCCGTGGATTGATTCTACACCATCCATTCTTCGGCGGAGAAGAGCGAAGTGAATCTGAGATTAGACTTATGAACGATCAGGTTTGTCCTCCCATAGTCACCGATGTAATGTGGGATCTGTCTCTTCCCGTCGGCGTTGACCGAGATCATGAGTATTCGAATCCGACGGTTGGAGATGGATCGGAGAAGTTGGAAAAAATCGGACGGTTGAGATGGAAAGTGATGATGATTGGAGGAGAGGATGATCCGATGATAGATCTGCAGAAAGATGTGGCAAAGCTGATGAAGAAGAAAGGAGTAGAAGTGGTGGAGCATTATACCGGCGGCCATGTTCACGGTGCTGAAATCAGAGATCCTTCTAAACGTAAAACTCTGTTTCTTTCCATCAAAAACTTCATATTCTCTGTTCTGTAA

SEQ ID NO: 2023 - DNA, 462 bp, Arabidopsis thaliana
  misc_feature (1)..(462): Ceres cDNA ID no. 12732693
  misc_feature (1)..(462): Also known as  Ceres CDNA ID no. 23372771
atgattgatgtcgatgctattgaggatgatgttattgaatcatccgctagtgcttttgctgaagctaaaagcaaatcaagaaatgcacgtcggagacctttgatggttgatgtagagtcaggaggtacgactagattccctgccaacataagcaacaaacgcagaaggattccttctagtgaatctgtcatcgactgtgagcatgcctctgtaaatgatgaagtcaacatgtcttcgagagtgtctagatcaaaggctccagctcctccaccagaagagccaaagtttacatgtccaatctgcatgtgtccctttacggaggagatgtcaaccaagtgcggtcacatcttctgcaagggatgtataaagatggcaatatctcgccagggcaaatgccctacttgtaggaaaaaggttactgcaaaagagctgattcgagttttccttccaaccactagatga

SEQ ID NO: 2024 - protein, 462 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGATTGATGTCGATGCTATTGAGGATGATGTTATTGAATCATCCGCTAGTGCTTTTGCTGAAGCTAAAAGCAAATCAAGAAATGCACGTCGGAGACCTTTGATGGTTGATGTAGAGTCAGGAGGTACGACTAGATTCCCTGCCAACATAAGCAACAAACGCAGAAGGATTCCTTCTAGTGAATCTGTCATCGACTGTGAGCATGCCTCTGTAAATGATGAAGTCAACATGTCTTCGAGAGTGTCTAGATCAAAGGCTCCAGCTCCTCCACCAGAAGAGCCAAAGTTTACATGTCCAATCTGCATGTGTCCCTTTACGGAGGAGATGTCAACCAAGTGCGGTCACATCTTCTGCAAGGGATGTATAAAGATGGCAATATCTCGCCAGGGCAAATGCCCTACTTGTAGGAAAAAGGTTACTGCAAAAGAGCTGATTCGAGTTTTCCTTCCAACCACTAGATGA

SEQ ID NO: 2025 - DNA, 1791 bp, Arabidopsis thaliana
  misc_feature (1)..(1791): Ceres cDNA ID no. 12732828
  misc_feature (1)..(1791): Also known as  Ceres CDNA ID no. 23372771
aatcacccagaaagctaaagaaaagttttccttttttcccctcacgaaatctcagagaagatgatatatatctataaaagtatcatctcatagattccatcttttctctattacatggagaagaaaaaagaagaggatcatcatcatcaacaacaacaacaacaacaaaaggagatcaagaacacagagacaaagatcgagcaagaacaagaacaagaacaaaaacaagaaatctctcaagcatcatcatcatcaaacatggcgaatctagttacgtcatcagatcatcatccgttggagctagctggaaatctctcaagcatcttcgatacttcatctttaccttttccttattcttatttcgaagatcactcttctaataatcctaattctttcctagacttgctccgacaagatcatcagtttgcttcttcctctaattcctcttctttttcattcgatgcctttcctctccccaataacaacaacaacacctctttttttacggatttgcccttacctcaagctgagtcatcagaagtcgtgaacacaacaccgacttctccaaactcaacctcagtctcatcttcctccaacgaagctgcaaatgataacaacagtggtaaagaagttactgttaaagatcaagaagaaggagatcaacaacaagagcaaaagggtactaagccacagttgaaggcaaagaagaagaatcaaaagaaagctagagaagctaggtttgcgtttctgacgaagagcgatattgataatcttgacgacggttataggtggagaaaatacggccaaaaagctgtcaaaaacagtccttatcccagaagctattaccgttgcaccacagtgggttgcggagtgaagaagagagtggagagatcctccgatgatccttcgatcgtcatgacaacctacgaaggtcagcatacccatcctttccccatgacgccacgtggacacatcggaatgctcacgtcaccaatcctagaccacggtgcaaccaccgcgtcatcatcatcattctccatccctcagccacgttacttgctgactcaacatcaccagccctacaacatgtacaacaacaactctctaagtatgatcaatagaagatcatccgatggcactttcgtaaatccaggtccatcatcatcattccccggctttggttatgatatgtctcaagcttctacttcaacttcttcttccattagagatcatggattgcttcaagatattcttccttcgcagatcagatccgatactattaacactcaaaccaatgaagagaataagaaatgaagaagttttttttcccggggcaattgtttttttctttaggccggatccggtaggtaggtttcatgaggagtttttggtcggtttaggtaaaccgatgttgatggctttctaatgtttttttcttcattacatttagcatcggttttgtttcatcaccacgaaataagcaatcgacgctaagttggaacagaggtttatgtagcatatgtgatataggtataacttcattttttgtttgagtattaataaagatgtatcgttaactttttatgacttcggagagagaagagtttaatctagttatatagtatgtatttagttgtattatagtgtttctagaccatctaatttgtaatcatgctatcactagcccggctcagaatcttacatttattttattttcatatatccatcctaatcgatgtagatttacataacatacagtatacacaaagatacttcgaggtttgttgctat

SEQ ID NO: 2026 - protein, 1791 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
AATCACCCAGAAAGCTAAAGAAAAGTTTTCCTTTTTTCCCCTCACGAAATCTCAGAGAAGATGATATATATCTATAAAAGTATCATCTCATAGATTCCATCTTTTCTCTATTACATGGAGAAGAAAAAAGAAGAGGATCATCATCATCAACAACAACAACAACAACAAAAGGAGATCAAGAACACAGAGACAAAGATCGAGCAAGAACAAGAACAAGAACAAAAACAAGAAATCTCTCAAGCATCATCATCATCAAACATGGCGAATCTAGTTACGTCATCAGATCATCATCCGTTGGAGCTAGCTGGAAATCTCTCAAGCATCTTCGATACTTCATCTTTACCTTTTCCTTATTCTTATTTCGAAGATCACTCTTCTAATAATCCTAATTCTTTCCTAGACTTGCTCCGACAAGATCATCAGTTTGCTTCTTCCTCTAATTCCTCTTCTTTTTCATTCGATGCCTTTCCTCTCCCCAATAACAACAACAACACCTCTTTTTTTACGGATTTGCCCTTACCTCAAGCTGAGTCATCAGAAGTCGTGAACACAACACCGACTTCTCCAAACTCAACCTCAGTCTCATCTTCCTCCAACGAAGCTGCAAATGATAACAACAGTGGTAAAGAAGTTACTGTTAAAGATCAAGAAGAAGGAGATCAACAACAAGAGCAAAAGGGTACTAAGCCACAGTTGAAGGCAAAGAAGAAGAATCAAAAGAAAGCTAGAGAAGCTAGGTTTGCGTTTCTGACGAAGAGCGATATTGATAATCTTGACGACGGTTATAGGTGGAGAAAATACGGCCAAAAAGCTGTCAAAAACAGTCCTTATCCCAGAAGCTATTACCGTTGCACCACAGTGGGTTGCGGAGTGAAGAAGAGAGTGGAGAGATCCTCCGATGATCCTTCGATCGTCATGACAACCTACGAAGGTCAGCATACCCATCCTTTCCCCATGACGCCACGTGGACACATCGGAATGCTCACGTCACCAATCCTAGACCACGGTGCAACCACCGCGTCATCATCATCATTCTCCATCCCTCAGCCACGTTACTTGCTGACTCAACATCACCAGCCCTACAACATGTACAACAACAACTCTCTAAGTATGATCAATAGAAGATCATCCGATGGCACTTTCGTAAATCCAGGTCCATCATCATCATTCCCCGGCTTTGGTTATGATATGTCTCAAGCTTCTACTTCAACTTCTTCTTCCATTAGAGATCATGGATTGCTTCAAGATATTCTTCCTTCGCAGATCAGATCCGATACTATTAACACTCAAACCAATGAAGAGAATAAGAAATGAAGAAGTTTTTTTTCCCGGGGCAATTGTTTTTTTCTTTAGGCCGGATCCGGTAGGTAGGTTTCATGAGGAGTTTTTGGTCGGTTTAGGTAAACCGATGTTGATGGCTTTCTAATGTTTTTTTCTTCATTACATTTAGCATCGGTTTTGTTTCATCACCACGAAATAAGCAATCGACGCTAAGTTGGAACAGAGGTTTATGTAGCATATGTGATATAGGTATAACTTCATTTTTTGTTTGAGTATTAATAAAGATGTATCGTTAACTTTTTATGACTTCGGAGAGAGAAGAGTTTAATCTAGTTATATAGTATGTATTTAGTTGTATTATAGTGTTTCTAGACCATCTAATTTGTAATCATGCTATCACTAGCCCGGCTCAGAATCTTACATTTATTTTATTTTCATATATCCATCCTAATCGATGTAGATTTACATAACATACAGTATACACAAAGATACTTCGAGGTTTGTTGCTAT

SEQ ID NO: 2027 - DNA, 954 bp, Arabidopsis thaliana
  misc_feature (1)..(954): Ceres cDNA ID no. 12733000
  misc_feature (1)..(954): Also known as  Ceres CDNA ID no. 23372771
atggatcaggtctctcgctctcttcctccaccttttctctcaagagatctccatcttcacccacaccatcaattccagcatcagcagcagcagcagcaacagaatcacggccacgatatagaccagcaccgaatcggtgggctaaaacgtgaccgagatgctgatatcgatcccaacgagcactcttcagccggaaaagatcaaagtactcctggctccggtggagaaagcggcggcggaggaggaggagataatcacatcacgagaaggccacgtggcagaccagcgggatctaagaacaaaccaaaaccgccaatcatcatcactcgagacagcgcaaacgctctcaaatctcatgtcatggaagtagcaaacggatgtgacgtcatggaaagtgtcaccgtcttcgctcgccgtcgccaacgtggcatctgcgttttgagcggaaacggcgccgttaccaacgttaccataagacaaccagcttcagtacctggtggtggctcatctgtcgttaacttacacggacgtttcgagattctttctctctcgggatcattccttcctcctccggctccaccagctgcgtcaggtctaacgatttacttagccggtggtcagggacaggttgttggaggaagcgtggttggtccactcatggcttcaggacctgtagtgattatggcagcttcgtttggaaacgctgcgtatgagagactgccgttggaggaagacgatcaagaagagcaaacagctggagcggttgctaataatatcgatggaaacgcaacaatgggtggtggaacgcaaacgcaaactcagacgcagcagcaacagcaacaacagttgatgcaagatccgacgtcgtttatacaagggttgcctccgaatcttatgaattctgttcaattgccagctgaagcttattggggaactccgagaccatctttctaa

SEQ ID NO: 2028 - protein, 954 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGGATCAGGTCTCTCGCTCTCTTCCTCCACCTTTTCTCTCAAGAGATCTCCATCTTCACCCACACCATCAATTCCAGCATCAGCAGCAGCAGCAGCAACAGAATCACGGCCACGATATAGACCAGCACCGAATCGGTGGGCTAAAACGTGACCGAGATGCTGATATCGATCCCAACGAGCACTCTTCAGCCGGAAAAGATCAAAGTACTCCTGGCTCCGGTGGAGAAAGCGGCGGCGGAGGAGGAGGAGATAATCACATCACGAGAAGGCCACGTGGCAGACCAGCGGGATCTAAGAACAAACCAAAACCGCCAATCATCATCACTCGAGACAGCGCAAACGCTCTCAAATCTCATGTCATGGAAGTAGCAAACGGATGTGACGTCATGGAAAGTGTCACCGTCTTCGCTCGCCGTCGCCAACGTGGCATCTGCGTTTTGAGCGGAAACGGCGCCGTTACCAACGTTACCATAAGACAACCAGCTTCAGTACCTGGTGGTGGCTCATCTGTCGTTAACTTACACGGACGTTTCGAGATTCTTTCTCTCTCGGGATCATTCCTTCCTCCTCCGGCTCCACCAGCTGCGTCAGGTCTAACGATTTACTTAGCCGGTGGTCAGGGACAGGTTGTTGGAGGAAGCGTGGTTGGTCCACTCATGGCTTCAGGACCTGTAGTGATTATGGCAGCTTCGTTTGGAAACGCTGCGTATGAGAGACTGCCGTTGGAGGAAGACGATCAAGAAGAGCAAACAGCTGGAGCGGTTGCTAATAATATCGATGGAAACGCAACAATGGGTGGTGGAACGCAAACGCAAACTCAGACGCAGCAGCAACAGCAACAACAGTTGATGCAAGATCCGACGTCGTTTATACAAGGGTTGCCTCCGAATCTTATGAATTCTGTTCAATTGCCAGCTGAAGCTTATTGGGGAACTCCGAGACCATCTTTCTAA

SEQ ID NO: 2029 - DNA, 975 bp, Arabidopsis thaliana
  misc_feature (1)..(975): Ceres cDNA ID no. 12733020
  misc_feature (1)..(975): Also known as  Ceres CDNA ID no. 23372771
atgtcacgtgactctcctcccgcatttgatccatacaaacacctcaacataacaatcaaccccaacggctcttgcacgcgccatttcgtttggccgagggttgaacccgacccggatccatgccccggcaagctcgccgcttccaaagacgtaaccattaaccacgaaaccggcgtgtccgtacgtattttccgaccaactaatctaccatccaatgataacgccgtggctcgtctcccaatcatcatccatctccacggctccggttggatcctttacccggccaattctgccgcaaatgaccgttgttgctctcaaatggccagtgagttaacagtgattgttgtctccgtacactatcgtttgcctccggagcatagactcccagctcaatacgacgacgcattagatgctctgctttgggtcaaacaacaagtcgttgactcaaccaacggcgagccgtggcttaaggactacgccgatttctcacggtgttacatatgcggttcgagtaacggcgctaacatcgctttccaattggcactgagatcgttagaccacgatttaacgccgttacaaatcgacggttgcgtgttttaccaaccgctttttggcggtaaaacgaggacaaaatcggagcttaagaatttcgccgacccggtaatgccggttcctgcggttgacgccatgtgggaactatctttgccggtaggtgttgatcgggatcataggtactgtaatccattgggttacttgccgcaaaaggagaaagttggacggcttggacggtgtttggtgatcggttacggcggagacacgtcgttggatcgacaacaagatttcgtgaatttgttggttgcagctggagttagggttgaagcaaggtttgacgacgccggtttccatagcatcgagctggtcgatccacgacgagccgtcgctcttcttaatatgattagagattttataagttga

SEQ ID NO: 2030 - protein, 975 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGTCACGTGACTCTCCTCCCGCATTTGATCCATACAAACACCTCAACATAACAATCAACCCCAACGGCTCTTGCACGCGCCATTTCGTTTGGCCGAGGGTTGAACCCGACCCGGATCCATGCCCCGGCAAGCTCGCCGCTTCCAAAGACGTAACCATTAACCACGAAACCGGCGTGTCCGTACGTATTTTCCGACCAACTAATCTACCATCCAATGATAACGCCGTGGCTCGTCTCCCAATCATCATCCATCTCCACGGCTCCGGTTGGATCCTTTACCCGGCCAATTCTGCCGCAAATGACCGTTGTTGCTCTCAAATGGCCAGTGAGTTAACAGTGATTGTTGTCTCCGTACACTATCGTTTGCCTCCGGAGCATAGACTCCCAGCTCAATACGACGACGCATTAGATGCTCTGCTTTGGGTCAAACAACAAGTCGTTGACTCAACCAACGGCGAGCCGTGGCTTAAGGACTACGCCGATTTCTCACGGTGTTACATATGCGGTTCGAGTAACGGCGCTAACATCGCTTTCCAATTGGCACTGAGATCGTTAGACCACGATTTAACGCCGTTACAAATCGACGGTTGCGTGTTTTACCAACCGCTTTTTGGCGGTAAAACGAGGACAAAATCGGAGCTTAAGAATTTCGCCGACCCGGTAATGCCGGTTCCTGCGGTTGACGCCATGTGGGAACTATCTTTGCCGGTAGGTGTTGATCGGGATCATAGGTACTGTAATCCATTGGGTTACTTGCCGCAAAAGGAGAAAGTTGGACGGCTTGGACGGTGTTTGGTGATCGGTTACGGCGGAGACACGTCGTTGGATCGACAACAAGATTTCGTGAATTTGTTGGTTGCAGCTGGAGTTAGGGTTGAAGCAAGGTTTGACGACGCCGGTTTCCATAGCATCGAGCTGGTCGATCCACGACGAGCCGTCGCTCTTCTTAATATGATTAGAGATTTTATAAGTTGA

SEQ ID NO: 2031 - DNA, 1038 bp, Arabidopsis thaliana
  misc_feature (1)..(1038): Ceres cDNA ID no. 12733787
  misc_feature (1)..(1038): Also known as  Ceres CDNA ID no. 23372771
atggcgagtttcatcaaggcatggggtttagtgatcatctcactgtgttacacttttttcattgccaaattggttccaaaaggaatcaaaaggctcatactatttttccctgtcttcctcattttcttcatagtacctttcttgatatattccttacatttactcggcatcacggctttcttcatcgcttggctagcaaatttcaagctcttattatttgcattagggcgcggtcctctctcttcaaaccataaacccctatctctccctattttcttagctgtctcttgcttgcccatcaagattcagctgagcccaaaacctacaaaaactcactcccatgaaggatccacagagggtcctttgatttataccataaaggcagtttttgtggttctcatcatcaaagcctacgaatacagtaccaaattgcctgagaaagtcgtgctgactctctacgcgatccacatatatttcgcccttgagatcatccttgccgccacagctgctgcggttcgagccatgtcggatcttgagctcgagccacagttcaacaagccgtacctagcgacatcacttcaagatttctgggggagacgatggaacctgatggtcactggaatcttacggccaaccgtgtacgaaccgtcacttcaactgttctcggttttgggcccgaactattcccagattcttgcagctttcgggacgtttgttgtctctgggataatgcacgagctcatcttcttctacatgggacggttgaggccagactggaagatgatgtggttcttcctcataaatggattttgcacgaccgtggagatcgccatcaagaaaaccattaacggtaggtggagattcccgaaagcaatcagtcaggttttgacactcacttttgtgatggtgacggcattgtggctgttcttgcccgaatttaatcggtgcaacatagttgagaaggctcttgatgagtacgcagccataggcgcatttgcagtcgaggtcaggaggaaactgaccgcatatcttttttaa

SEQ ID NO: 2032 - protein, 1038 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGGCGAGTTTCATCAAGGCATGGGGTTTAGTGATCATCTCACTGTGTTACACTTTTTTCATTGCCAAATTGGTTCCAAAAGGAATCAAAAGGCTCATACTATTTTTCCCTGTCTTCCTCATTTTCTTCATAGTACCTTTCTTGATATATTCCTTACATTTACTCGGCATCACGGCTTTCTTCATCGCTTGGCTAGCAAATTTCAAGCTCTTATTATTTGCATTAGGGCGCGGTCCTCTCTCTTCAAACCATAAACCCCTATCTCTCCCTATTTTCTTAGCTGTCTCTTGCTTGCCCATCAAGATTCAGCTGAGCCCAAAACCTACAAAAACTCACTCCCATGAAGGATCCACAGAGGGTCCTTTGATTTATACCATAAAGGCAGTTTTTGTGGTTCTCATCATCAAAGCCTACGAATACAGTACCAAATTGCCTGAGAAAGTCGTGCTGACTCTCTACGCGATCCACATATATTTCGCCCTTGAGATCATCCTTGCCGCCACAGCTGCTGCGGTTCGAGCCATGTCGGATCTTGAGCTCGAGCCACAGTTCAACAAGCCGTACCTAGCGACATCACTTCAAGATTTCTGGGGGAGACGATGGAACCTGATGGTCACTGGAATCTTACGGCCAACCGTGTACGAACCGTCACTTCAACTGTTCTCGGTTTTGGGCCCGAACTATTCCCAGATTCTTGCAGCTTTCGGGACGTTTGTTGTCTCTGGGATAATGCACGAGCTCATCTTCTTCTACATGGGACGGTTGAGGCCAGACTGGAAGATGATGTGGTTCTTCCTCATAAATGGATTTTGCACGACCGTGGAGATCGCCATCAAGAAAACCATTAACGGTAGGTGGAGATTCCCGAAAGCAATCAGTCAGGTTTTGACACTCACTTTTGTGATGGTGACGGCATTGTGGCTGTTCTTGCCCGAATTTAATCGGTGCAACATAGTTGAGAAGGCTCTTGATGAGTACGCAGCCATAGGCGCATTTGCAGTCGAGGTCAGGAGGAAACTGACCGCATATCTTTTTTAA

SEQ ID NO: 2033 - DNA, 1764 bp, Arabidopsis thaliana
  misc_feature (1)..(1764): Ceres cDNA ID no. 12733838
  misc_feature (1)..(1764): Also known as  Ceres CDNA ID no. 23372771
atgagtgctccaaagtttggttatgtattactattgattgtattaatcaatattagcaataatggcgtcgatgcatttcacaaagttttcaagaaattgcaatcaaaatcgacatcattggagtcagtaagtcctcttcacagaaccgcttatcactttcaacctccccgccattggatcaacgctccaatgctctacaagggagtttaccatctcttctaccaatacaatcccaaaggtgcggtttggggtaacattgtgtgggctcactcggtttctaaggacttgatcaattgggaagcccttgaaccagccatttacccatccaaatggttcgacatcaacggtacatggtccggttcagctacccacgtaccgggaaaaggaccggttatcctctacaccggtatcaccgagaaccagactcagattcaaaactacgccattccacaagatctttccgacccatacctcaagacatggataaagccagacgataaccccatcgtaaaacccgataatggcgagaacggatccgctttccgtgacccgaccacggcttggttcaacaaaaaagatgggtattggagaatgcttgttggctcaaagagaaagaacagaggaattgcttatatgtacaagagccgtgacttcaaaaaatgggtcaaaagcaaacgtcctatccactcaagaaagaaaaccggtatgtgggaatgtcccgatttcttcccggtatccgtaaccgacaagaaaaacggtttggacttcagctacgacggtccaaacgccaagcatgtgttgaaggttagtttggacttgaccagatacgagtactacactcttggaacgtatgacaccaagaaggatcgttacaggccagacggttacactcctgacggttgggatggtttgagatttgattatggtaactactatgcgtcaaagacattctttgatgacaagacgaacagaagaattctttgggggtgggccaatgaatccgacaccgttcaagatgataccgtgaagggttgggccggaattcagcttatcccaagaacaatcttgcttgactctagcggtaagcaactcgtgttttggcctattgaagagattgagtcattgagaggaaagaatgtccaaatgaccaaccagaaaatggagatgggccaacgctttgaggtccaaggaatcactcctgctcaggtggatgtggatgtgacattcaacgttggaaatctagagaaggccgaaaagtttgacgaaagcttcgcaactaaaccactagagttatgtaacttgaaaggttcgaatgtgaatggtggagttggtccttttggtttgatcacgttggctacatctgacttagaagaatacactcctgttttctttagagtcttcaaagatgccgcatccaacaagcctaaggttctcatgtgctctgacgccaagccttcgagtctcaaaaaagacaccgggactgacgccaaggagaggatgtacaaaccatcgtttgctggttttgtggatgtcggtctccttgacggaaagatctctctaaggagtttgattgatcactcggttgtggagagctttggagcaaaaggaaagacagtgataacatctagagtgtatccgacaaaagcagtaggagaaaaagctcatttgtttgtctttaacaacggctcacaacctgtgaccgtagagagcctcaatgcatggaacatgcagaagcctctgaagatgaaccaaggtgcaaagtga

SEQ ID NO: 2034 - protein, 1764 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGAGTGCTCCAAAGTTTGGTTATGTATTACTATTGATTGTATTAATCAATATTAGCAATAATGGCGTCGATGCATTTCACAAAGTTTTCAAGAAATTGCAATCAAAATCGACATCATTGGAGTCAGTAAGTCCTCTTCACAGAACCGCTTATCACTTTCAACCTCCCCGCCATTGGATCAACGCTCCAATGCTCTACAAGGGAGTTTACCATCTCTTCTACCAATACAATCCCAAAGGTGCGGTTTGGGGTAACATTGTGTGGGCTCACTCGGTTTCTAAGGACTTGATCAATTGGGAAGCCCTTGAACCAGCCATTTACCCATCCAAATGGTTCGACATCAACGGTACATGGTCCGGTTCAGCTACCCACGTACCGGGAAAAGGACCGGTTATCCTCTACACCGGTATCACCGAGAACCAGACTCAGATTCAAAACTACGCCATTCCACAAGATCTTTCCGACCCATACCTCAAGACATGGATAAAGCCAGACGATAACCCCATCGTAAAACCCGATAATGGCGAGAACGGATCCGCTTTCCGTGACCCGACCACGGCTTGGTTCAACAAAAAAGATGGGTATTGGAGAATGCTTGTTGGCTCAAAGAGAAAGAACAGAGGAATTGCTTATATGTACAAGAGCCGTGACTTCAAAAAATGGGTCAAAAGCAAACGTCCTATCCACTCAAGAAAGAAAACCGGTATGTGGGAATGTCCCGATTTCTTCCCGGTATCCGTAACCGACAAGAAAAACGGTTTGGACTTCAGCTACGACGGTCCAAACGCCAAGCATGTGTTGAAGGTTAGTTTGGACTTGACCAGATACGAGTACTACACTCTTGGAACGTATGACACCAAGAAGGATCGTTACAGGCCAGACGGTTACACTCCTGACGGTTGGGATGGTTTGAGATTTGATTATGGTAACTACTATGCGTCAAAGACATTCTTTGATGACAAGACGAACAGAAGAATTCTTTGGGGGTGGGCCAATGAATCCGACACCGTTCAAGATGATACCGTGAAGGGTTGGGCCGGAATTCAGCTTATCCCAAGAACAATCTTGCTTGACTCTAGCGGTAAGCAACTCGTGTTTTGGCCTATTGAAGAGATTGAGTCATTGAGAGGAAAGAATGTCCAAATGACCAACCAGAAAATGGAGATGGGCCAACGCTTTGAGGTCCAAGGAATCACTCCTGCTCAGGTGGATGTGGATGTGACATTCAACGTTGGAAATCTAGAGAAGGCCGAAAAGTTTGACGAAAGCTTCGCAACTAAACCACTAGAGTTATGTAACTTGAAAGGTTCGAATGTGAATGGTGGAGTTGGTCCTTTTGGTTTGATCACGTTGGCTACATCTGACTTAGAAGAATACACTCCTGTTTTCTTTAGAGTCTTCAAAGATGCCGCATCCAACAAGCCTAAGGTTCTCATGTGCTCTGACGCCAAGCCTTCGAGTCTCAAAAAAGACACCGGGACTGACGCCAAGGAGAGGATGTACAAACCATCGTTTGCTGGTTTTGTGGATGTCGGTCTCCTTGACGGAAAGATCTCTCTAAGGAGTTTGATTGATCACTCGGTTGTGGAGAGCTTTGGAGCAAAAGGAAAGACAGTGATAACATCTAGAGTGTATCCGACAAAAGCAGTAGGAGAAAAAGCTCATTTGTTTGTCTTTAACAACGGCTCACAACCTGTGACCGTAGAGAGCCTCAATGCATGGAACATGCAGAAGCCTCTGAAGATGAACCAAGGTGCAAAGTGA

SEQ ID NO: 2035 - DNA, 2235 bp, Arabidopsis thaliana
  misc_feature (1)..(2235): Ceres cDNA ID no. 12733874
  misc_feature (1)..(2235): Also known as  Ceres CDNA ID no. 23372771
atgcctgtaaacgataaaccaagctcttcaaagagcgtacctcaacggtttgaagatccttctaaccccatttctgagccatctcaagctggaaccagttttggattacaaggagtggggaatcaaacgcgggagattaagctgttgcatagatccaacaaacctgggtcttgtcttagttctggcagtggagattatgagatagagttagatgaaaatgttgcgtctccttccactcatgcatttgttgaagatgatgtgatagaaatagacaaacacgttacttcactgccatctcactctagcaagaaagtcaatgcgacggagcttgacaagaatatttcctcatctgctgtagactcagagcagaaagggaagttggatgatgcacctaattcagggacagagaatggcaaaacagtacggaaggtaacaagaatgattccacgtcccaaacaaccgaaaaagaaaattttgcttaagaagaagttaaaaatcggggttgtgtcagcaacttacccaacaaaagacgatgaagaaattgttccttccttggactctagtgccaatcaacttctctgccagagatgtcactgttcgttgaagagcaccagcatcgatgacaacccaccttcatatacttctagtcataatcctaagatttgcacagatagtttgagctctgtttcaaataaagaagctcatcaaggatctgacgagaactcctctggctcgtgtaatgtcagtcaaagctctgaagctgacattgtcataatgaaacaagatgtttcctctagcaataatagtggaatcggtgcaatggtagaaaaagaaaccgagaatccgacttccagtgagaaattcgagttctctctgagttcaaaagatagtcttggggattatagcaggagcacaagcattagtgaggagagtaatctgagccgatttagctgtgggaataagcctcacatgtcgatggatgtgagatgggaagcgattaagcatatcaaggttcaatacggctctttgggtttacgacacttcaaccttctgaagaaacttggttgtggagatataggaacagtctatctcgccgagctgattggtacaaactgtttgtttgccataaaggttatggacaacgagttcttggcgagaaggaaaaagtctccccgggcacaagcagaaagagaaatacttaaaatgttggaccatccttttcttcctacattatacgcgcaatttacttcggataatttatcttgtctagtcatggaatattgtcctggaggagatcttcatgtcctcagacagaagcagctaggccggtgtttccctgaacctgcagcaagattctatgtggccgaaattctccttgcactggagtacttacacatgcttggtatcatataccgagatctgaaaccggaaaacattcttgtccgtgaagatggacacattatgcttacggattttgacctctcactccgttgtgcagtgaacccgactcttgtcaggtcaaactctccacctggtaaagatcccgcaaggatttcaggtccatacaacacatccaactgcatacaaccattctgtatcaccgaaccatcttgccaggtttcgtgtttcagccctaggctctcctcaaaccaacaacaaggtagaaaaccaaaaaggggtgatcatctttcgaaaacccaacaacacttgagtagatcattgcctcagctcgtggctgaaccaaccgaagcaagatccaattcctttgtgggaacacacgagtacctagccccagagatcatcaaaggagaaggacatggcgctgcagttgactggtggactttcggggttctcctttacgagcttttatacgggaaaacaccattcaaaggttacaacaacgacgagactttggccaatgttgtgttacagaacctcaagtttcctgatagcccgcttgtaagcttccaggcaaaagacttgatcaggggacttcttgttaaggaaccagagaacaggctcgggtcagagaaaggttctgtagagatcaaaagacatcctttttttgaaggattgaattgggctctgatccggtgtgcaatcccgcctgagctaccggatttctatgagtatggtggtggaccagaggcagcggcggattcgcctggaggcagtaataataggtatcttgaatgtaaagccataggcgatcatcttgagttcgagttgttttaa

SEQ ID NO: 2036 - protein, 2235 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGCCTGTAAACGATAAACCAAGCTCTTCAAAGAGCGTACCTCAACGGTTTGAAGATCCTTCTAACCCCATTTCTGAGCCATCTCAAGCTGGAACCAGTTTTGGATTACAAGGAGTGGGGAATCAAACGCGGGAGATTAAGCTGTTGCATAGATCCAACAAACCTGGGTCTTGTCTTAGTTCTGGCAGTGGAGATTATGAGATAGAGTTAGATGAAAATGTTGCGTCTCCTTCCACTCATGCATTTGTTGAAGATGATGTGATAGAAATAGACAAACACGTTACTTCACTGCCATCTCACTCTAGCAAGAAAGTCAATGCGACGGAGCTTGACAAGAATATTTCCTCATCTGCTGTAGACTCAGAGCAGAAAGGGAAGTTGGATGATGCACCTAATTCAGGGACAGAGAATGGCAAAACAGTACGGAAGGTAACAAGAATGATTCCACGTCCCAAACAACCGAAAAAGAAAATTTTGCTTAAGAAGAAGTTAAAAATCGGGGTTGTGTCAGCAACTTACCCAACAAAAGACGATGAAGAAATTGTTCCTTCCTTGGACTCTAGTGCCAATCAACTTCTCTGCCAGAGATGTCACTGTTCGTTGAAGAGCACCAGCATCGATGACAACCCACCTTCATATACTTCTAGTCATAATCCTAAGATTTGCACAGATAGTTTGAGCTCTGTTTCAAATAAAGAAGCTCATCAAGGATCTGACGAGAACTCCTCTGGCTCGTGTAATGTCAGTCAAAGCTCTGAAGCTGACATTGTCATAATGAAACAAGATGTTTCCTCTAGCAATAATAGTGGAATCGGTGCAATGGTAGAAAAAGAAACCGAGAATCCGACTTCCAGTGAGAAATTCGAGTTCTCTCTGAGTTCAAAAGATAGTCTTGGGGATTATAGCAGGAGCACAAGCATTAGTGAGGAGAGTAATCTGAGCCGATTTAGCTGTGGGAATAAGCCTCACATGTCGATGGATGTGAGATGGGAAGCGATTAAGCATATCAAGGTTCAATACGGCTCTTTGGGTTTACGACACTTCAACCTTCTGAAGAAACTTGGTTGTGGAGATATAGGAACAGTCTATCTCGCCGAGCTGATTGGTACAAACTGTTTGTTTGCCATAAAGGTTATGGACAACGAGTTCTTGGCGAGAAGGAAAAAGTCTCCCCGGGCACAAGCAGAAAGAGAAATACTTAAAATGTTGGACCATCCTTTTCTTCCTACATTATACGCGCAATTTACTTCGGATAATTTATCTTGTCTAGTCATGGAATATTGTCCTGGAGGAGATCTTCATGTCCTCAGACAGAAGCAGCTAGGCCGGTGTTTCCCTGAACCTGCAGCAAGATTCTATGTGGCCGAAATTCTCCTTGCACTGGAGTACTTACACATGCTTGGTATCATATACCGAGATCTGAAACCGGAAAACATTCTTGTCCGTGAAGATGGACACATTATGCTTACGGATTTTGACCTCTCACTCCGTTGTGCAGTGAACCCGACTCTTGTCAGGTCAAACTCTCCACCTGGTAAAGATCCCGCAAGGATTTCAGGTCCATACAACACATCCAACTGCATACAACCATTCTGTATCACCGAACCATCTTGCCAGGTTTCGTGTTTCAGCCCTAGGCTCTCCTCAAACCAACAACAAGGTAGAAAACCAAAAAGGGGTGATCATCTTTCGAAAACCCAACAACACTTGAGTAGATCATTGCCTCAGCTCGTGGCTGAACCAACCGAAGCAAGATCCAATTCCTTTGTGGGAACACACGAGTACCTAGCCCCAGAGATCATCAAAGGAGAAGGACATGGCGCTGCAGTTGACTGGTGGACTTTCGGGGTTCTCCTTTACGAGCTTTTATACGGGAAAACACCATTCAAAGGTTACAACAACGACGAGACTTTGGCCAATGTTGTGTTACAGAACCTCAAGTTTCCTGATAGCCCGCTTGTAAGCTTCCAGGCAAAAGACTTGATCAGGGGACTTCTTGTTAAGGAACCAGAGAACAGGCTCGGGTCAGAGAAAGGTTCTGTAGAGATCAAAAGACATCCTTTTTTTGAAGGATTGAATTGGGCTCTGATCCGGTGTGCAATCCCGCCTGAGCTACCGGATTTCTATGAGTATGGTGGTGGACCAGAGGCAGCGGCGGATTCGCCTGGAGGCAGTAATAATAGGTATCTTGAATGTAAAGCCATAGGCGATCATCTTGAGTTCGAGTTGTTTTAA

SEQ ID NO: 2037 - DNA, 1464 bp, Arabidopsis thaliana
  misc_feature (1)..(1464): Ceres cDNA ID no. 12734012
  misc_feature (1)..(1464): Also known as  Ceres CDNA ID no. 23372771
atggaagctacgaagtcgtcgaaacaaaattgttgcaacccggttaagaaacccggacccgtttcaattgatcatgttctcttagctctccgtgagacaagagaagagcgagatttacgaatcaggagcttattcagtttctttgattctgagaatgttggttacttagattgtgctcaaattgagaaggggttatgtgcgcttcaaatcccaagtgggtataaatacgctaaggagttgtttagggtttgtgatgcgaatagagatgggcgtgtggattatcatgagtttcgtagatatatggatgataaggagcttgagctgtatagaatctttcaagctattgatgttgagcataatggttgtatttctcctgagggactttgggattcactcgttaaagctgggattgagataaaagatgaggagcttgctcgttttgtggaacatgttgacaaggacaatgatggaatcattatgtttgaagaatggagagattttcttttgctgtaccctcacgaagctaccattgaaaatatataccatcactgggaaagagtatgtcttgtagatattggagaacaagctgtaattccagaaggcatcagcaaacatataaagaggagtaactatttcatcgcaggtggcatagctggtgcagcttctaggactgctactgcacctctagatcgcttaaaagttcttttgcaaattcagaaaaccgatgctagaatccgagaagccataaagttgatatggaagcagggtggagttagaggtttttttcgaggtaacgggttgaatattgtgaaggtagcaccagagagtgccatcaagttctatgcatatgagcttttcaaaaacgctatcggtgaaaacatgggtgaagacaaagcggatataggcacaacagttagactttttgctggaggaatggctggtgcagtagctcaagcctctatataccctttagatcttgtgaaaactcggttgcagacttacacgagccaagcaggtgttgctgttcccaggcttggaacgctcaccaaagatatattggttcatgagggtccacgtgccttctacaaaggtcttttcccttctcttcttgggattattccttacgcgggtattgaccttgctgcatatgagacattaaaggacttgtccaggacatatattcttcaagacgctgaaccaggtccgctcgtgcaactaggatgtggaacaatctcaggagctcttggagcaacctgtgtctatcctttgcaggttgtgagaacaagaatgcaagcggaacgagcaagaacctcgatgtcaggagtattcaggagaacaataagtgaagaaggttacagagcactctacaaagggctactaccgaaccttctaaaggtagttcctgctgcaagcattacatatatggtttacgaagcaatgaaaaagagtctagaacttgattga

SEQ ID NO: 2038 - protein, 1464 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGGAAGCTACGAAGTCGTCGAAACAAAATTGTTGCAACCCGGTTAAGAAACCCGGACCCGTTTCAATTGATCATGTTCTCTTAGCTCTCCGTGAGACAAGAGAAGAGCGAGATTTACGAATCAGGAGCTTATTCAGTTTCTTTGATTCTGAGAATGTTGGTTACTTAGATTGTGCTCAAATTGAGAAGGGGTTATGTGCGCTTCAAATCCCAAGTGGGTATAAATACGCTAAGGAGTTGTTTAGGGTTTGTGATGCGAATAGAGATGGGCGTGTGGATTATCATGAGTTTCGTAGATATATGGATGATAAGGAGCTTGAGCTGTATAGAATCTTTCAAGCTATTGATGTTGAGCATAATGGTTGTATTTCTCCTGAGGGACTTTGGGATTCACTCGTTAAAGCTGGGATTGAGATAAAAGATGAGGAGCTTGCTCGTTTTGTGGAACATGTTGACAAGGACAATGATGGAATCATTATGTTTGAAGAATGGAGAGATTTTCTTTTGCTGTACCCTCACGAAGCTACCATTGAAAATATATACCATCACTGGGAAAGAGTATGTCTTGTAGATATTGGAGAACAAGCTGTAATTCCAGAAGGCATCAGCAAACATATAAAGAGGAGTAACTATTTCATCGCAGGTGGCATAGCTGGTGCAGCTTCTAGGACTGCTACTGCACCTCTAGATCGCTTAAAAGTTCTTTTGCAAATTCAGAAAACCGATGCTAGAATCCGAGAAGCCATAAAGTTGATATGGAAGCAGGGTGGAGTTAGAGGTTTTTTTCGAGGTAACGGGTTGAATATTGTGAAGGTAGCACCAGAGAGTGCCATCAAGTTCTATGCATATGAGCTTTTCAAAAACGCTATCGGTGAAAACATGGGTGAAGACAAAGCGGATATAGGCACAACAGTTAGACTTTTTGCTGGAGGAATGGCTGGTGCAGTAGCTCAAGCCTCTATATACCCTTTAGATCTTGTGAAAACTCGGTTGCAGACTTACACGAGCCAAGCAGGTGTTGCTGTTCCCAGGCTTGGAACGCTCACCAAAGATATATTGGTTCATGAGGGTCCACGTGCCTTCTACAAAGGTCTTTTCCCTTCTCTTCTTGGGATTATTCCTTACGCGGGTATTGACCTTGCTGCATATGAGACATTAAAGGACTTGTCCAGGACATATATTCTTCAAGACGCTGAACCAGGTCCGCTCGTGCAACTAGGATGTGGAACAATCTCAGGAGCTCTTGGAGCAACCTGTGTCTATCCTTTGCAGGTTGTGAGAACAAGAATGCAAGCGGAACGAGCAAGAACCTCGATGTCAGGAGTATTCAGGAGAACAATAAGTGAAGAAGGTTACAGAGCACTCTACAAAGGGCTACTACCGAACCTTCTAAAGGTAGTTCCTGCTGCAAGCATTACATATATGGTTTACGAAGCAATGAAAAAGAGTCTAGAACTTGATTGA

SEQ ID NO: 2039 - DNA, 429 bp, Arabidopsis thaliana
  misc_feature (1)..(429): Ceres cDNA ID no. 12734416
  misc_feature (1)..(429): Also known as  Ceres CDNA ID no. 23372771
atggtagataaagaggatcctggcaaaggcgtcattgttcagatgtcaactggaaataggaaccaaaattgctcgctttcagtttctgttatttgccagaaaactaaagttgatggaccactcactttggcgaaatctggtacctgtcagtatgtgagtgctactcagctgcgacatcctgccggttgtgcagcagctatatccggccatagtagtggatggggctggtttagtaccttactaatcattatcttgtgcctgtttggagcttatctggtgggtggtgcagtatatcggtatttctcccttggaattcgtggcatagatgtaatcccgaatatggattactgggccactgtacctcacagtatacaggtattgttctgtgtttctatattctcttctggtagattggtgtctaagaattaa

SEQ ID NO: 2040 - protein, 429 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGGTAGATAAAGAGGATCCTGGCAAAGGCGTCATTGTTCAGATGTCAACTGGAAATAGGAACCAAAATTGCTCGCTTTCAGTTTCTGTTATTTGCCAGAAAACTAAAGTTGATGGACCACTCACTTTGGCGAAATCTGGTACCTGTCAGTATGTGAGTGCTACTCAGCTGCGACATCCTGCCGGTTGTGCAGCAGCTATATCCGGCCATAGTAGTGGATGGGGCTGGTTTAGTACCTTACTAATCATTATCTTGTGCCTGTTTGGAGCTTATCTGGTGGGTGGTGCAGTATATCGGTATTTCTCCCTTGGAATTCGTGGCATAGATGTAATCCCGAATATGGATTACTGGGCCACTGTACCTCACAGTATACAGGTATTGTTCTGTGTTTCTATATTCTCTTCTGGTAGATTGGTGTCTAAGAATTAA

SEQ ID NO: 2041 - DNA, 1396 bp, Arabidopsis thaliana
  misc_feature (1)..(1396): Ceres cDNA ID no. 12734969
  misc_feature (1)..(1396): Also known as  Ceres CDNA ID no. 23372771
aatttaccaaaacacccttctgccttcgcagaccaggttttaggggtttctctagggtttaccttctccacgacgatttctccaatctgacaatctccgatcacaaaaattcagaaaccctttccgctttaattgatgcgaattcagcttccatctccgccgcatcaaccacagagtaatctcacagagagaaagagatttgaatatggaagctcgagtcggtgtagtggtggaaggaggacagagagctcttaatacagccaccaccaccgccgttcataacaccgtcgtagacgccggaaacaggaaacttttacagcaacaaccacagacgcaacagacacaaagctgtcatcaacatcaccaaagtaataaacagtcgttgaatcagcagcaaggccatttcggcaccgttgagcgtcttctcgccggtggaatcgccggcgcatttagtaagacatgcaccgctcctcttgctcgtcttacaatcttgtttcagatacaaggtatgcagtcggaagctgcaatcttgagcagtccaaacatttggcatgaagcttcgcgtattgttaaggaggaaggttttagagcattttggaaaggaaacttggttactgtagctcatcggcttccttatggtgcagttaacttctatgcatatgaagaatacaagactttcttgcactcgaatccagtcttgcagagttataaaggaaatgcgggtgtggacatttctgtgcactttgtaagtggtggcttggctggactaacagctgcttcagctacctaccctctcgatcttgtaaggacacggctttctgcacagagaaattcaatctattatcagggtgttgggcatgccttccgtaccatttgcagagaagagggaattttgggtctatataaaggacttggtgcgacattgttgggtgtcggtccaagtcttgcaatcagcttcgcagcgtatgagacttttaaaacattttggctctctcataggcctaatgattcaaatgccgtggttagtcttggttgtggcagtctctccggaattgtttcctctacagcgacattcccattggacctggtgagaagaagaatgcagttggaaggagctggtgggcgagcgagagtgtataccacaggactctttggaacattcaaacacatatttaagacagaaggcatgagagggctatacagaggaatcataccagaatactacaaagtggttcctggtgttggcatcgccttcatgacattcgaggaattgaagaagctcttatcaactgtccctaattaataacgtcttatatactttagtgtaagctactttctgcttaagaaacagacaatcattttgtcctttgtttggtagtagtttttttgggtctgt

SEQ ID NO: 2042 - protein, 1396 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
AATTTACCAAAACACCCTTCTGCCTTCGCAGACCAGGTTTTAGGGGTTTCTCTAGGGTTTACCTTCTCCACGACGATTTCTCCAATCTGACAATCTCCGATCACAAAAATTCAGAAACCCTTTCCGCTTTAATTGATGCGAATTCAGCTTCCATCTCCGCCGCATCAACCACAGAGTAATCTCACAGAGAGAAAGAGATTTGAATATGGAAGCTCGAGTCGGTGTAGTGGTGGAAGGAGGACAGAGAGCTCTTAATACAGCCACCACCACCGCCGTTCATAACACCGTCGTAGACGCCGGAAACAGGAAACTTTTACAGCAACAACCACAGACGCAACAGACACAAAGCTGTCATCAACATCACCAAAGTAATAAACAGTCGTTGAATCAGCAGCAAGGCCATTTCGGCACCGTTGAGCGTCTTCTCGCCGGTGGAATCGCCGGCGCATTTAGTAAGACATGCACCGCTCCTCTTGCTCGTCTTACAATCTTGTTTCAGATACAAGGTATGCAGTCGGAAGCTGCAATCTTGAGCAGTCCAAACATTTGGCATGAAGCTTCGCGTATTGTTAAGGAGGAAGGTTTTAGAGCATTTTGGAAAGGAAACTTGGTTACTGTAGCTCATCGGCTTCCTTATGGTGCAGTTAACTTCTATGCATATGAAGAATACAAGACTTTCTTGCACTCGAATCCAGTCTTGCAGAGTTATAAAGGAAATGCGGGTGTGGACATTTCTGTGCACTTTGTAAGTGGTGGCTTGGCTGGACTAACAGCTGCTTCAGCTACCTACCCTCTCGATCTTGTAAGGACACGGCTTTCTGCACAGAGAAATTCAATCTATTATCAGGGTGTTGGGCATGCCTTCCGTACCATTTGCAGAGAAGAGGGAATTTTGGGTCTATATAAAGGACTTGGTGCGACATTGTTGGGTGTCGGTCCAAGTCTTGCAATCAGCTTCGCAGCGTATGAGACTTTTAAAACATTTTGGCTCTCTCATAGGCCTAATGATTCAAATGCCGTGGTTAGTCTTGGTTGTGGCAGTCTCTCCGGAATTGTTTCCTCTACAGCGACATTCCCATTGGACCTGGTGAGAAGAAGAATGCAGTTGGAAGGAGCTGGTGGGCGAGCGAGAGTGTATACCACAGGACTCTTTGGAACATTCAAACACATATTTAAGACAGAAGGCATGAGAGGGCTATACAGAGGAATCATACCAGAATACTACAAAGTGGTTCCTGGTGTTGGCATCGCCTTCATGACATTCGAGGAATTGAAGAAGCTCTTATCAACTGTCCCTAATTAATAACGTCTTATATACTTTAGTGTAAGCTACTTTCTGCTTAAGAAACAGACAATCATTTTGTCCTTTGTTTGGTAGTAGTTTTTTTGGGTCTGT

SEQ ID NO: 2043 - DNA, 921 bp, Arabidopsis thaliana
  misc_feature (1)..(921): Ceres cDNA ID no. 12735123
  misc_feature (1)..(921): Also known as  Ceres CDNA ID no. 23372771
atggccaaagctcttagccttacaatctttctctttctcttgatagcttccaatgtccaatccgctcgacttctcgatgaggttcaaactcagccacaattagtcccccaggtaccggaagaggaagatgatagtccacaagccgtaacaacaactccaacaccaattcctctcccaggacccgccacgggaggacccgagccaatcctagagttctttatgcatgacgtgctaggcgggtcacacccatcagcacgtgtggttacagggatagtagcacaaacagaggtgaatggaataccgttttctaaatccagcaacaacattttcccagtagataacgcagtgccgcttgtgaacgcaaacagcatcaacaacttaatcaatccaaacacagctccactcctaacaggacttagtggctctcaagccaacaccgtaatccaaaacagtaacggtaactctcaaggatcccttagctccaacaaccttccctttgtaaccacgggtcagctccctcccatagctgccctccaacagcttatgtttggctctatcaccgtggttgacgatgagctcaccgagggccatgagttgggctctgcgatcattgggagagcccaagggttttatctcgctagctctttggatggaactagccagaccctttcgttgacagtgttactccacgaagatcatgatcatcatgacacccttgatgatgccatcagcttctttggggttcaccgaaccgcttctcatgcgtcgcatatcgctgttgtgggtggaactgggagattcgagcatgctaaagggtatgctgtcgtggagactctacacaaccaggaagaccaacatgttactgatggtcatgataccattctccatttcagtgtttatcttacatactacaaagcttga

SEQ ID NO: 2044 - protein, 921 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGGCCAAAGCTCTTAGCCTTACAATCTTTCTCTTTCTCTTGATAGCTTCCAATGTCCAATCCGCTCGACTTCTCGATGAGGTTCAAACTCAGCCACAATTAGTCCCCCAGGTACCGGAAGAGGAAGATGATAGTCCACAAGCCGTAACAACAACTCCAACACCAATTCCTCTCCCAGGACCCGCCACGGGAGGACCCGAGCCAATCCTAGAGTTCTTTATGCATGACGTGCTAGGCGGGTCACACCCATCAGCACGTGTGGTTACAGGGATAGTAGCACAAACAGAGGTGAATGGAATACCGTTTTCTAAATCCAGCAACAACATTTTCCCAGTAGATAACGCAGTGCCGCTTGTGAACGCAAACAGCATCAACAACTTAATCAATCCAAACACAGCTCCACTCCTAACAGGACTTAGTGGCTCTCAAGCCAACACCGTAATCCAAAACAGTAACGGTAACTCTCAAGGATCCCTTAGCTCCAACAACCTTCCCTTTGTAACCACGGGTCAGCTCCCTCCCATAGCTGCCCTCCAACAGCTTATGTTTGGCTCTATCACCGTGGTTGACGATGAGCTCACCGAGGGCCATGAGTTGGGCTCTGCGATCATTGGGAGAGCCCAAGGGTTTTATCTCGCTAGCTCTTTGGATGGAACTAGCCAGACCCTTTCGTTGACAGTGTTACTCCACGAAGATCATGATCATCATGACACCCTTGATGATGCCATCAGCTTCTTTGGGGTTCACCGAACCGCTTCTCATGCGTCGCATATCGCTGTTGTGGGTGGAACTGGGAGATTCGAGCATGCTAAAGGGTATGCTGTCGTGGAGACTCTACACAACCAGGAAGACCAACATGTTACTGATGGTCATGATACCATTCTCCATTTCAGTGTTTATCTTACATACTACAAAGCTTGA

SEQ ID NO: 2045 - DNA, 1737 bp, Arabidopsis thaliana
  misc_feature (1)..(1737): Ceres cDNA ID no. 12735452
  misc_feature (1)..(1737): Also known as  Ceres CDNA ID no. 23372771
atggattcttcttcatcagtcgtttacgttggttcatcatccaaatccagaaactttcaatctaaatccaaaggttcgattacatctttctcaatcgattcaagaggcaccaagaaatcaatgaagacgttattaatcccagaaccagaaccaacttcccctgaagttatagaaagttctgtgtcctctgtttcagctgaatccgagacaccaatttcgattatacgtaagaagaaacaatcagagccaaggttttactctagcccaaccaacacgttttacacagaagcaaaacaaagctttaccaacacagaattcagtgaatgtgcaagcataagcactattggtataggtggtattgatttggagaagaatggtgtaatgatatacagaggaagtatagggagtgatgttagtgatgagagtagctcaagtggtctgagtaatgcagcttacaagccacatagagataataacgataagcgttgggttgcgattcaggaggttcgttctcgggttggttcgtcgcttgaggctaaagatttcaagctgattaagaagttaggaggaggtgatattggtaatgtttacttagctgagttgattggaactggagtgagttttgctgtgaaagttatggagaaagctgctattgcagcgaggaagaagcttgttagagctcagactgagaaagagatacttcaatcgttagatcatcctttcttgcctacgctttactcacatttcgaaacagagatgaattcttgtttggttatggagttttgtcctggtggtgatttacattctcttagacaaaaacagcgtggaaagtacttccctgagcaagctgctagattttatgttgctgaagttcttcttgctatggagtatctacatatgcttgggatcatatacagagaccttaagcctgagaatgttttagttcgtgaagatggacatataatgctatctgatttcgacctctctttgagatgtgcagtctctccaacgttggttcggttcgcagcaatcacgcttgagtccaaaagctcaagctactgtatccaaccaacatgtgtagaccaatcgagctgcattgttcagcctgactgcatccagccagtgtgtttcactcctcggttcttgtctaaaggaaagcacaggaagaagtcgaacgatatgagccgccaaatcagaccgcttcctgagctgatagctgaaccgactagcgcaaggtcaatgtcgtttgttggtacacacgagtacctagcaccagagattatcaaaggagaaggtcatggaagcgcggttgactggtggacattcgggatattcctctatgagcttctatttgggataacaccgtttagaggaggcgataacagagcgacactctttaacgtagttggacagccattgcggtttcccgagcatccaaatgtgagctttgcagctagagatttgatcagaggattgctagtgaaagagcctcagcatcggttggcttatagaagaggagctactgagattaagcagcatccgtttttccaaagtgtgaattgggctttgatcagatgcaccagtccaccacagattcctcaaccggttaaaccaatggatcaagctcacagtgttcgtcatggttttagtcaaggacatggacatgttggttatgataagcctcctactgtggatgtgaagccttctggtaattatttggaaattgatttcttctga

SEQ ID NO: 2046 - protein, 1737 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGGATTCTTCTTCATCAGTCGTTTACGTTGGTTCATCATCCAAATCCAGAAACTTTCAATCTAAATCCAAAGGTTCGATTACATCTTTCTCAATCGATTCAAGAGGCACCAAGAAATCAATGAAGACGTTATTAATCCCAGAACCAGAACCAACTTCCCCTGAAGTTATAGAAAGTTCTGTGTCCTCTGTTTCAGCTGAATCCGAGACACCAATTTCGATTATACGTAAGAAGAAACAATCAGAGCCAAGGTTTTACTCTAGCCCAACCAACACGTTTTACACAGAAGCAAAACAAAGCTTTACCAACACAGAATTCAGTGAATGTGCAAGCATAAGCACTATTGGTATAGGTGGTATTGATTTGGAGAAGAATGGTGTAATGATATACAGAGGAAGTATAGGGAGTGATGTTAGTGATGAGAGTAGCTCAAGTGGTCTGAGTAATGCAGCTTACAAGCCACATAGAGATAATAACGATAAGCGTTGGGTTGCGATTCAGGAGGTTCGTTCTCGGGTTGGTTCGTCGCTTGAGGCTAAAGATTTCAAGCTGATTAAGAAGTTAGGAGGAGGTGATATTGGTAATGTTTACTTAGCTGAGTTGATTGGAACTGGAGTGAGTTTTGCTGTGAAAGTTATGGAGAAAGCTGCTATTGCAGCGAGGAAGAAGCTTGTTAGAGCTCAGACTGAGAAAGAGATACTTCAATCGTTAGATCATCCTTTCTTGCCTACGCTTTACTCACATTTCGAAACAGAGATGAATTCTTGTTTGGTTATGGAGTTTTGTCCTGGTGGTGATTTACATTCTCTTAGACAAAAACAGCGTGGAAAGTACTTCCCTGAGCAAGCTGCTAGATTTTATGTTGCTGAAGTTCTTCTTGCTATGGAGTATCTACATATGCTTGGGATCATATACAGAGACCTTAAGCCTGAGAATGTTTTAGTTCGTGAAGATGGACATATAATGCTATCTGATTTCGACCTCTCTTTGAGATGTGCAGTCTCTCCAACGTTGGTTCGGTTCGCAGCAATCACGCTTGAGTCCAAAAGCTCAAGCTACTGTATCCAACCAACATGTGTAGACCAATCGAGCTGCATTGTTCAGCCTGACTGCATCCAGCCAGTGTGTTTCACTCCTCGGTTCTTGTCTAAAGGAAAGCACAGGAAGAAGTCGAACGATATGAGCCGCCAAATCAGACCGCTTCCTGAGCTGATAGCTGAACCGACTAGCGCAAGGTCAATGTCGTTTGTTGGTACACACGAGTACCTAGCACCAGAGATTATCAAAGGAGAAGGTCATGGAAGCGCGGTTGACTGGTGGACATTCGGGATATTCCTCTATGAGCTTCTATTTGGGATAACACCGTTTAGAGGAGGCGATAACAGAGCGACACTCTTTAACGTAGTTGGACAGCCATTGCGGTTTCCCGAGCATCCAAATGTGAGCTTTGCAGCTAGAGATTTGATCAGAGGATTGCTAGTGAAAGAGCCTCAGCATCGGTTGGCTTATAGAAGAGGAGCTACTGAGATTAAGCAGCATCCGTTTTTCCAAAGTGTGAATTGGGCTTTGATCAGATGCACCAGTCCACCACAGATTCCTCAACCGGTTAAACCAATGGATCAAGCTCACAGTGTTCGTCATGGTTTTAGTCAAGGACATGGACATGTTGGTTATGATAAGCCTCCTACTGTGGATGTGAAGCCTTCTGGTAATTATTTGGAAATTGATTTCTTCTGA

SEQ ID NO: 2047 - DNA, 735 bp, Arabidopsis thaliana
  misc_feature (1)..(735): Ceres cDNA ID no. 12735583
  misc_feature (1)..(735): Also known as  Ceres CDNA ID no. 23372771
atggaagatgctggtgaacatttacggtgtaacgataacgttaacgacgaggagcgtttgccattggagtttatgatcggaaactcaacatccacggcggagctacagccgcctccaccgttcttggtaaagacatacaaagtggtggaggatccgacgacggacggggttatatcttggaacgaatacggaactggtttcgtcgtgtggcagccggcagaattcgctagagatctgttaccaacacttttcaagcattgcaacttctctagcttcgttcgccagctcaatacttacggttttcgaaaagtaacgacgataagatgggaatttagtaatgagatgtttcgaaaggggcaaagagagcttatgagcaatatccgaagaaggaagagccaacattggtcacacaacaagtctaatcaccaggttgtaccaacaacaacgatggtgaatcaagaaggtcatcaacggattgggattgatcatcaccatgaggatcaacagtcttccgccacttcatcctctttcgtatacactgcattactcgacgaaaacaaatgcttgaagaatgaaaacgagttattaagctgcgaacttgggaaaaccaagaagaaatgcaagcagcttatggagttggtggagagatacagaggagaagacgaagatgcaactgatgaaagtgatgatgaagaagatgaagggcttaagttgttcggagtaaaacttgaatga

SEQ ID NO: 2048 - protein, 735 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGGAAGATGCTGGTGAACATTTACGGTGTAACGATAACGTTAACGACGAGGAGCGTTTGCCATTGGAGTTTATGATCGGAAACTCAACATCCACGGCGGAGCTACAGCCGCCTCCACCGTTCTTGGTAAAGACATACAAAGTGGTGGAGGATCCGACGACGGACGGGGTTATATCTTGGAACGAATACGGAACTGGTTTCGTCGTGTGGCAGCCGGCAGAATTCGCTAGAGATCTGTTACCAACACTTTTCAAGCATTGCAACTTCTCTAGCTTCGTTCGCCAGCTCAATACTTACGGTTTTCGAAAAGTAACGACGATAAGATGGGAATTTAGTAATGAGATGTTTCGAAAGGGGCAAAGAGAGCTTATGAGCAATATCCGAAGAAGGAAGAGCCAACATTGGTCACACAACAAGTCTAATCACCAGGTTGTACCAACAACAACGATGGTGAATCAAGAAGGTCATCAACGGATTGGGATTGATCATCACCATGAGGATCAACAGTCTTCCGCCACTTCATCCTCTTTCGTATACACTGCATTACTCGACGAAAACAAATGCTTGAAGAATGAAAACGAGTTATTAAGCTGCGAACTTGGGAAAACCAAGAAGAAATGCAAGCAGCTTATGGAGTTGGTGGAGAGATACAGAGGAGAAGACGAAGATGCAACTGATGAAAGTGATGATGAAGAAGATGAAGGGCTTAAGTTGTTCGGAGTAAAACTTGAATGA

SEQ ID NO: 2049 - DNA, 1329 bp, Arabidopsis thaliana
  misc_feature (1)..(1329): Ceres cDNA ID no. 12736012
  misc_feature (1)..(1329): Also known as  Ceres CDNA ID no. 23372771
atggagccaacgttccatgcttttatgtttccctggtttgcttttggtcatatgattccttttctacatcttgcaaacaaactagctgagaaaggtcatcaaatcactttcttgctacctaagaaagcccaaaaacagttggaacatcacaatctgttcccagacagtattgtctttcaccctctcacaatccctcatgtcaatggcctccctgctggtgctgagacaacctcggatatctcaatctcgatggacaacttactgtcggaagccttggatctcactcgcgatcaggttgaagctgcggttcgtgctctgagaccggacttgatcttttttgattttgctcattggattccagaaattgccaaagagcatatgatcaagagtgtgagttacatgatagtatctgcaacaacaatagcttatacatttgcccctggtggtgtattaggtgttcccccaccaggttatccttcatcaaaggtgttgtaccgtgaaaacgatgctcatgccttagcaaccttatctatcttctacaagagactttatcatcagatcactacaggttttaagagctgtgacatcattgcattgaggacatgtaatgaaatcgaaggtaaattctgcgactatatatcaagtcaataccataagaaggttctcttgactggtccaatgctccctgagcaagacacaagtaaaccactagaagaacagttgagtcattttctgagcaggttcccaccgaggtcagtggtgttttgtgcacttggtagccagatcgttcttgaaaaggatcaattccaagaactctgcttagggatggagctgacaggtttaccgtttcttatagcggtaaagccaccgagaggatcatcgacggtcgaagaagggttaccagaagggttccaggagcgggtgaaagggcgtggtgtggtttggggaggatgggtgcaacaaccattgatattggatcatccgtcaataggctgctttgtgaaccattgtggtccgggaacaatatgggagtgtcttatgactgattgtcaaatggttttgcttccatttttaggtgatcaagttctcttcacaagattgatgaccgaggaattcaaggtgtctgtagaagtgtcgagagaaaaaacaggatggttttcaaaggagagcttgagcgatgcgatcaagtctgtgatggataaagatagcgacctcggaaagctagtgaggagtaaccacgccaaattgaaggagactcttggtagtcatggattattaactggttacgtggataaatttgtagaggaattgcaagagtatttgatttga

SEQ ID NO: 2050 - protein, 1329 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGGAGCCAACGTTCCATGCTTTTATGTTTCCCTGGTTTGCTTTTGGTCATATGATTCCTTTTCTACATCTTGCAAACAAACTAGCTGAGAAAGGTCATCAAATCACTTTCTTGCTACCTAAGAAAGCCCAAAAACAGTTGGAACATCACAATCTGTTCCCAGACAGTATTGTCTTTCACCCTCTCACAATCCCTCATGTCAATGGCCTCCCTGCTGGTGCTGAGACAACCTCGGATATCTCAATCTCGATGGACAACTTACTGTCGGAAGCCTTGGATCTCACTCGCGATCAGGTTGAAGCTGCGGTTCGTGCTCTGAGACCGGACTTGATCTTTTTTGATTTTGCTCATTGGATTCCAGAAATTGCCAAAGAGCATATGATCAAGAGTGTGAGTTACATGATAGTATCTGCAACAACAATAGCTTATACATTTGCCCCTGGTGGTGTATTAGGTGTTCCCCCACCAGGTTATCCTTCATCAAAGGTGTTGTACCGTGAAAACGATGCTCATGCCTTAGCAACCTTATCTATCTTCTACAAGAGACTTTATCATCAGATCACTACAGGTTTTAAGAGCTGTGACATCATTGCATTGAGGACATGTAATGAAATCGAAGGTAAATTCTGCGACTATATATCAAGTCAATACCATAAGAAGGTTCTCTTGACTGGTCCAATGCTCCCTGAGCAAGACACAAGTAAACCACTAGAAGAACAGTTGAGTCATTTTCTGAGCAGGTTCCCACCGAGGTCAGTGGTGTTTTGTGCACTTGGTAGCCAGATCGTTCTTGAAAAGGATCAATTCCAAGAACTCTGCTTAGGGATGGAGCTGACAGGTTTACCGTTTCTTATAGCGGTAAAGCCACCGAGAGGATCATCGACGGTCGAAGAAGGGTTACCAGAAGGGTTCCAGGAGCGGGTGAAAGGGCGTGGTGTGGTTTGGGGAGGATGGGTGCAACAACCATTGATATTGGATCATCCGTCAATAGGCTGCTTTGTGAACCATTGTGGTCCGGGAACAATATGGGAGTGTCTTATGACTGATTGTCAAATGGTTTTGCTTCCATTTTTAGGTGATCAAGTTCTCTTCACAAGATTGATGACCGAGGAATTCAAGGTGTCTGTAGAAGTGTCGAGAGAAAAAACAGGATGGTTTTCAAAGGAGAGCTTGAGCGATGCGATCAAGTCTGTGATGGATAAAGATAGCGACCTCGGAAAGCTAGTGAGGAGTAACCACGCCAAATTGAAGGAGACTCTTGGTAGTCATGGATTATTAACTGGTTACGTGGATAAATTTGTAGAGGAATTGCAAGAGTATTTGATTTGA

SEQ ID NO: 2051 - DNA, 2445 bp, Arabidopsis thaliana
  misc_feature (1)..(2445): Ceres cDNA ID no. 12736308
  misc_feature (1)..(2445): Also known as  Ceres CDNA ID no. 23372771
atgaagaggtttatcaactcaaccgtgacgttttccgtcaccgtcaccatcgccgttatcatcttcttcctcttgtctcccgtcacctccttaggttcaggctcaacttacgcagtcgtatacggctccgacaccgtctgcgcattgatctccggtcaacccacacaacgtatcctctgttacgacacgcgtcttaatatcaacgtcactctaaaccccggcgtctcattctcctcaatagccgccggagataatttcctctgcggtatacgctccggtggttacagccttctctgttgggataacatcggaagctactctccaaaccggaaacgaatctaccaaaacgacaacgttttactcgagactctctccgtcggggataaacaaatctgcgcaaccgttaacggtacaaattccttaaaatgctggagaggttccgtttccgatcaatcaaaacctccgaacgagagattccgatcaatttcatccggcgttggtttctcctgcggcgtttcgattcgaaataaccgaatcctttgctggggaaccgatccggttaaatcgaatcagatccaaaccggattcggaaacacgccgatggtgaccatctccgcaggtaaatcacacgcttgtggattaaacactactgggaatttgatttgcatcggaaacaacgattctggtcagctcaatgttattgctccagatcaacctaacctttactcatcatctctctctctcggatcaaatttcacctgcgcgatgcgaatctcgaataattctgtggtttgttggggcggaggagcagagagattcaacaatgtcacggattcgatctctttcgaatcgatttcctcgggtccgggtctaatttgcgggttgatttcaagtaatctctcaatcatgtgttggaatcctacaaatttctccagaatcttcctccctttcccagaagttttaccaggtccttgcgttgaatcatcatcatcctctctttgctcttgtggtgtttatccacaatctgataagctctgttctggtactggctcgatttgtaaatcatgtccgattcaatttccagcgagtcctccgagtcaatttcctcttccaccaccaccaccaccaccaccgccatcaccgtcaacttcatctccaccgtcgaaagctttaacaagaggattattagcgtttgcgatcgttggatcagttggagcatttgcagggatctgtagtgtggtttactgtttatggactggagtttgcttggggaagaagaaagttcataactcggttcaaccgacgataactcgcggtggttctaatagccggtctaacagttcgaatagccggtcgttatctataagacgtcaaggatcgagaatgctatcaatgaggaggcagagaagtggaacatcgtcgatgaagcacgccgataaagcggaagagttttcgttctccgagcttgcttcggctaccggaaacttctctctagagaacaaaatcggttcggggagctttggtgttgtttacagaggtaaactcaatgacgggagagaagtagcgatcaaacgcggggaagtaaacgcgaagatgaagaagtttcaagagaaagaaaccgcgtttgattcggaaatcgcgtttttatcgaggcttcatcataagcatttggtgagactagttggttactgcgaagaaagagaagagaagcttctcgtttacgattacatgaagaatggtgcgctttacgatcatctacacgacaagaacaacgtcgaaaaacatagtagcttgatcaattcttggaaaatgcggatcaaaatcgcgttagatgcggctagaggaatcgagtatctacataactacgcagtgccaccgattattcatagagatattaagtcgtctaacatcttgcttgactctaattgggtcgctagagtttcggatttcgggttatcattaatgggtccggtgctagggaaagatcataatccttatcaacgtccaacgaaagctgcggggacggtcggatatattgatccagagtattatagtcttaatgttttaacggataagagcgatgtgtatggactaggagtggtgttgttagaattgttgaccgggaaaagagcgatatttaggaacaatggtgatgtggaggaggaggaagggtgtgttccggtgcatttggtggattactcggttccggcgataacggctgatgagttgagtacaattttggatccgagagttggatcaccggagctaggtgaaggagatgcggtggagctggtggcttatacggctatgcattgtgtgaatgcggaagggagaaacaggccgacaatgacggatatagtagggaatttggagagagcattggatttgtgtggggatagtcatgggagtatctctagtggcatttgttctattgtctctgattga

SEQ ID NO: 2052 - protein, 2445 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGAAGAGGTTTATCAACTCAACCGTGACGTTTTCCGTCACCGTCACCATCGCCGTTATCATCTTCTTCCTCTTGTCTCCCGTCACCTCCTTAGGTTCAGGCTCAACTTACGCAGTCGTATACGGCTCCGACACCGTCTGCGCATTGATCTCCGGTCAACCCACACAACGTATCCTCTGTTACGACACGCGTCTTAATATCAACGTCACTCTAAACCCCGGCGTCTCATTCTCCTCAATAGCCGCCGGAGATAATTTCCTCTGCGGTATACGCTCCGGTGGTTACAGCCTTCTCTGTTGGGATAACATCGGAAGCTACTCTCCAAACCGGAAACGAATCTACCAAAACGACAACGTTTTACTCGAGACTCTCTCCGTCGGGGATAAACAAATCTGCGCAACCGTTAACGGTACAAATTCCTTAAAATGCTGGAGAGGTTCCGTTTCCGATCAATCAAAACCTCCGAACGAGAGATTCCGATCAATTTCATCCGGCGTTGGTTTCTCCTGCGGCGTTTCGATTCGAAATAACCGAATCCTTTGCTGGGGAACCGATCCGGTTAAATCGAATCAGATCCAAACCGGATTCGGAAACACGCCGATGGTGACCATCTCCGCAGGTAAATCACACGCTTGTGGATTAAACACTACTGGGAATTTGATTTGCATCGGAAACAACGATTCTGGTCAGCTCAATGTTATTGCTCCAGATCAACCTAACCTTTACTCATCATCTCTCTCTCTCGGATCAAATTTCACCTGCGCGATGCGAATCTCGAATAATTCTGTGGTTTGTTGGGGCGGAGGAGCAGAGAGATTCAACAATGTCACGGATTCGATCTCTTTCGAATCGATTTCCTCGGGTCCGGGTCTAATTTGCGGGTTGATTTCAAGTAATCTCTCAATCATGTGTTGGAATCCTACAAATTTCTCCAGAATCTTCCTCCCTTTCCCAGAAGTTTTACCAGGTCCTTGCGTTGAATCATCATCATCCTCTCTTTGCTCTTGTGGTGTTTATCCACAATCTGATAAGCTCTGTTCTGGTACTGGCTCGATTTGTAAATCATGTCCGATTCAATTTCCAGCGAGTCCTCCGAGTCAATTTCCTCTTCCACCACCACCACCACCACCACCGCCATCACCGTCAACTTCATCTCCACCGTCGAAAGCTTTAACAAGAGGATTATTAGCGTTTGCGATCGTTGGATCAGTTGGAGCATTTGCAGGGATCTGTAGTGTGGTTTACTGTTTATGGACTGGAGTTTGCTTGGGGAAGAAGAAAGTTCATAACTCGGTTCAACCGACGATAACTCGCGGTGGTTCTAATAGCCGGTCTAACAGTTCGAATAGCCGGTCGTTATCTATAAGACGTCAAGGATCGAGAATGCTATCAATGAGGAGGCAGAGAAGTGGAACATCGTCGATGAAGCACGCCGATAAAGCGGAAGAGTTTTCGTTCTCCGAGCTTGCTTCGGCTACCGGAAACTTCTCTCTAGAGAACAAAATCGGTTCGGGGAGCTTTGGTGTTGTTTACAGAGGTAAACTCAATGACGGGAGAGAAGTAGCGATCAAACGCGGGGAAGTAAACGCGAAGATGAAGAAGTTTCAAGAGAAAGAAACCGCGTTTGATTCGGAAATCGCGTTTTTATCGAGGCTTCATCATAAGCATTTGGTGAGACTAGTTGGTTACTGCGAAGAAAGAGAAGAGAAGCTTCTCGTTTACGATTACATGAAGAATGGTGCGCTTTACGATCATCTACACGACAAGAACAACGTCGAAAAACATAGTAGCTTGATCAATTCTTGGAAAATGCGGATCAAAATCGCGTTAGATGCGGCTAGAGGAATCGAGTATCTACATAACTACGCAGTGCCACCGATTATTCATAGAGATATTAAGTCGTCTAACATCTTGCTTGACTCTAATTGGGTCGCTAGAGTTTCGGATTTCGGGTTATCATTAATGGGTCCGGTGCTAGGGAAAGATCATAATCCTTATCAACGTCCAACGAAAGCTGCGGGGACGGTCGGATATATTGATCCAGAGTATTATAGTCTTAATGTTTTAACGGATAAGAGCGATGTGTATGGACTAGGAGTGGTGTTGTTAGAATTGTTGACCGGGAAAAGAGCGATATTTAGGAACAATGGTGATGTGGAGGAGGAGGAAGGGTGTGTTCCGGTGCATTTGGTGGATTACTCGGTTCCGGCGATAACGGCTGATGAGTTGAGTACAATTTTGGATCCGAGAGTTGGATCACCGGAGCTAGGTGAAGGAGATGCGGTGGAGCTGGTGGCTTATACGGCTATGCATTGTGTGAATGCGGAAGGGAGAAACAGGCCGACAATGACGGATATAGTAGGGAATTTGGAGAGAGCATTGGATTTGTGTGGGGATAGTCATGGGAGTATCTCTAGTGGCATTTGTTCTATTGTCTCTGATTGA

SEQ ID NO: 2053 - DNA, 1809 bp, Arabidopsis thaliana
  misc_feature (1)..(1809): Ceres cDNA ID no. 12736691
  misc_feature (1)..(1809): Also known as  Ceres CDNA ID no. 23372771
caaatcacagatcacacttaccagatcacaagacaaacacaaactaatagtttcgtgtgacacaagtaaagagtttcgtgagatagaagcaacaccaaaagatgcttgaaactggagccatatggggaataaccggcacgacggtgacgagctttatgttcttctgggcgatttacaaacaatacgtccctgcccatttccgagcctatgtggagagatacttccacaagatgattggatggatctcttactacgttgacatcaaattcaccgagtacacagatgaaggtctgaagagaagccaagcctacgactccatacgcaactacttagcgtcgaaatcaacggctcttgctaaaagactaaaggccaacgaaacgaaaaacagcaaatctttggtgtttagtatggatgatcatgaggaaattgaagatgagttcgaaggtgtgaaggtgaagtggtattcgaatgtgaaagtgattcagcctcagtctaattatggtcaacgcagctcagaggagagaaggcactttactcttagtttccataggcgacaccgaggtatgatcattgagacttatcttgatcatgttttgagagaagggaaagctattggattgatgaacagagagaggaagctttacactaataactcaagtcaagaatggtatccttggaggtcaggaaagtggagcaacgttccttttcaccatccggcgacgtttgagactttggctatggatccagagaagaaagaagggattaagaaggatttgataaagtttagcaaagggaaagattattacaagaaggttgggaagccatggaagcgcggttatctcttgtttggcccgcccgggacagggaaatcgacgatgatagctgcaatagcgaatttcttggactatgatgtgtatgatcttgagctaacgacggtgaaggataactcagagctgaagaagttgttgttggatacaactagtaagtctatcattgtgattgaagatattgattgctcgcttgatcttacggggcagcgaaagaagaaaaaagaggaagatgaagaggaggatggagaggagaagaaggaaggtgagaagaagcccaaggtagatgataagcagagcaaggttactttgtcaggtttattaaactccattgatgggttatggtcagcttgtagtggtgagaagatcatagtgttcacaactaattttgtggataagcttgatccagcattgatacgtagaggaagaatggacaaccacattgagatgtcttattgcaagtttgaagcattcaaggttttggctaagaactacttggagattgaaacacacgacttgtatggagaaatcgaaagaaagctcgaagaaaccgatatgtcccccgcggatgttgcggagactttgatgccgaaatctgacgaagaagatgcagatatttgcatcaagcgtttggtcaagactttggaggaagagaaggagaaagcaaggaagttggctgaggaagaagagaagaagaaagcagagaaggaagcaaagaagatgaagaaagcagaggaagcagaggagaagaagaagaagacagaggaagatgagaagaaggagaaagtgaaggccaaggaggaaaacggcaacgtttctcaacaaaatggcaactcaattgatttgaacaagaaaagtgactcatgatgaattttagtttattgtataaggatgtaatttggcaattattcttctctcctcttatcatatgcttttaaagaatttgtatttactatctatagatttcatcattgtgttccat

SEQ ID NO: 2054 - protein, 1809 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
CAAATCACAGATCACACTTACCAGATCACAAGACAAACACAAACTAATAGTTTCGTGTGACACAAGTAAAGAGTTTCGTGAGATAGAAGCAACACCAAAAGATGCTTGAAACTGGAGCCATATGGGGAATAACCGGCACGACGGTGACGAGCTTTATGTTCTTCTGGGCGATTTACAAACAATACGTCCCTGCCCATTTCCGAGCCTATGTGGAGAGATACTTCCACAAGATGATTGGATGGATCTCTTACTACGTTGACATCAAATTCACCGAGTACACAGATGAAGGTCTGAAGAGAAGCCAAGCCTACGACTCCATACGCAACTACTTAGCGTCGAAATCAACGGCTCTTGCTAAAAGACTAAAGGCCAACGAAACGAAAAACAGCAAATCTTTGGTGTTTAGTATGGATGATCATGAGGAAATTGAAGATGAGTTCGAAGGTGTGAAGGTGAAGTGGTATTCGAATGTGAAAGTGATTCAGCCTCAGTCTAATTATGGTCAACGCAGCTCAGAGGAGAGAAGGCACTTTACTCTTAGTTTCCATAGGCGACACCGAGGTATGATCATTGAGACTTATCTTGATCATGTTTTGAGAGAAGGGAAAGCTATTGGATTGATGAACAGAGAGAGGAAGCTTTACACTAATAACTCAAGTCAAGAATGGTATCCTTGGAGGTCAGGAAAGTGGAGCAACGTTCCTTTTCACCATCCGGCGACGTTTGAGACTTTGGCTATGGATCCAGAGAAGAAAGAAGGGATTAAGAAGGATTTGATAAAGTTTAGCAAAGGGAAAGATTATTACAAGAAGGTTGGGAAGCCATGGAAGCGCGGTTATCTCTTGTTTGGCCCGCCCGGGACAGGGAAATCGACGATGATAGCTGCAATAGCGAATTTCTTGGACTATGATGTGTATGATCTTGAGCTAACGACGGTGAAGGATAACTCAGAGCTGAAGAAGTTGTTGTTGGATACAACTAGTAAGTCTATCATTGTGATTGAAGATATTGATTGCTCGCTTGATCTTACGGGGCAGCGAAAGAAGAAAAAAGAGGAAGATGAAGAGGAGGATGGAGAGGAGAAGAAGGAAGGTGAGAAGAAGCCCAAGGTAGATGATAAGCAGAGCAAGGTTACTTTGTCAGGTTTATTAAACTCCATTGATGGGTTATGGTCAGCTTGTAGTGGTGAGAAGATCATAGTGTTCACAACTAATTTTGTGGATAAGCTTGATCCAGCATTGATACGTAGAGGAAGAATGGACAACCACATTGAGATGTCTTATTGCAAGTTTGAAGCATTCAAGGTTTTGGCTAAGAACTACTTGGAGATTGAAACACACGACTTGTATGGAGAAATCGAAAGAAAGCTCGAAGAAACCGATATGTCCCCCGCGGATGTTGCGGAGACTTTGATGCCGAAATCTGACGAAGAAGATGCAGATATTTGCATCAAGCGTTTGGTCAAGACTTTGGAGGAAGAGAAGGAGAAAGCAAGGAAGTTGGCTGAGGAAGAAGAGAAGAAGAAAGCAGAGAAGGAAGCAAAGAAGATGAAGAAAGCAGAGGAAGCAGAGGAGAAGAAGAAGAAGACAGAGGAAGATGAGAAGAAGGAGAAAGTGAAGGCCAAGGAGGAAAACGGCAACGTTTCTCAACAAAATGGCAACTCAATTGATTTGAACAAGAAAAGTGACTCATGATGAATTTTAGTTTATTGTATAAGGATGTAATTTGGCAATTATTCTTCTCTCCTCTTATCATATGCTTTTAAAGAATTTGTATTTACTATCTATAGATTTCATCATTGTGTTCCAT

SEQ ID NO: 2055 - DNA, 1533 bp, Arabidopsis thaliana
  misc_feature (1)..(1533): Ceres cDNA ID no. 12736699
  misc_feature (1)..(1533): Also known as  Ceres CDNA ID no. 23372771
atgtttgaagccggaggattatttggtttcaccggcacgaccatggcaagtcttatgttcttctggtcagtgtacagacagtttgtgccataccaaatcagagactacttggagaagtgtttttacaagatgttcggtttggtctcaaattctgttcacatcaaattcactgaatacacagaagataaaggtctcaagaaaagccaagcctatgatttgatacgcaactacttatcctcgaaatcaacggctcgtgctcagaggttaaaggccaacgaatcaaaaaacagcaaatcgttggtgcttagtttggacaatcacgaagcagttgaagatgtgttccaaggtgtgaaggtggtgtggtctttgagcgtgtggaagagtaatgatcaggctgattctagcgagaaaaggtacttgactttgagtttccataatcggtatagggagatgatcacaacgacttatcttgatcatgttttgagagaagggaaagagattggtttgaagaacagagagaggaagctttacactaataactcgagtcaagattattcggcttggagagaaggaaggtggagcaacgttccttttgatcatcccgcaacgtttgagactttggctatggatcttgagaagaaagaagggatgaaaaaggatttgattaagtttactaaagggaaagattattataggaaggttgggaagccgtggaagagaggttatctgttgtttggaccgccggggacagggaaatcgacgatgatatcggctatggcgaacttcttggagtatgatgtgtatgatcttgagttgactactgtgaaggataactcggagttgaagaagctaatgttggatacaaaagggaagtctattgttgtgattgaagatatcgattgttcgcttgatcttacgggacagagaaagaagaagaaggaggaagatgaggatgaagaggaagaagaaaagaagaaagaagctgagaagttgttgaagagagaaagaggtgaaagagagagtaaggttactttgtcggggctattaaacgccattgatgggttgtggtcagcttgtagtggagagaagattattgtgtttactacgaattatttggataagcttgatccagctttgatacgtagaggaagaatggacaaccatattgagatgtcttattgtaggtttgaagcgtttaaggttttggctaagaactacttggagattgagtcacatgacttgtttggagaaatcaagcgattggtggaggaaactgacatgtctccagctgatgttgctgagaacttgatgccgaaatctgatgaagacgatgccgatatttgccttacgcggttggttaagtctttggaggaagagaaggagaaagcaaagaagttggctgaggaagaaaagatgaagaaagcagcgagggatgcaaggaggatcaagaagaaagcagaggaagaacacaaaaagaagaataaagtagaggaaaacggcgacgtatctcacgataatggtaaccatatttga

SEQ ID NO: 2056 - protein, 1533 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGTTTGAAGCCGGAGGATTATTTGGTTTCACCGGCACGACCATGGCAAGTCTTATGTTCTTCTGGTCAGTGTACAGACAGTTTGTGCCATACCAAATCAGAGACTACTTGGAGAAGTGTTTTTACAAGATGTTCGGTTTGGTCTCAAATTCTGTTCACATCAAATTCACTGAATACACAGAAGATAAAGGTCTCAAGAAAAGCCAAGCCTATGATTTGATACGCAACTACTTATCCTCGAAATCAACGGCTCGTGCTCAGAGGTTAAAGGCCAACGAATCAAAAAACAGCAAATCGTTGGTGCTTAGTTTGGACAATCACGAAGCAGTTGAAGATGTGTTCCAAGGTGTGAAGGTGGTGTGGTCTTTGAGCGTGTGGAAGAGTAATGATCAGGCTGATTCTAGCGAGAAAAGGTACTTGACTTTGAGTTTCCATAATCGGTATAGGGAGATGATCACAACGACTTATCTTGATCATGTTTTGAGAGAAGGGAAAGAGATTGGTTTGAAGAACAGAGAGAGGAAGCTTTACACTAATAACTCGAGTCAAGATTATTCGGCTTGGAGAGAAGGAAGGTGGAGCAACGTTCCTTTTGATCATCCCGCAACGTTTGAGACTTTGGCTATGGATCTTGAGAAGAAAGAAGGGATGAAAAAGGATTTGATTAAGTTTACTAAAGGGAAAGATTATTATAGGAAGGTTGGGAAGCCGTGGAAGAGAGGTTATCTGTTGTTTGGACCGCCGGGGACAGGGAAATCGACGATGATATCGGCTATGGCGAACTTCTTGGAGTATGATGTGTATGATCTTGAGTTGACTACTGTGAAGGATAACTCGGAGTTGAAGAAGCTAATGTTGGATACAAAAGGGAAGTCTATTGTTGTGATTGAAGATATCGATTGTTCGCTTGATCTTACGGGACAGAGAAAGAAGAAGAAGGAGGAAGATGAGGATGAAGAGGAAGAAGAAAAGAAGAAAGAAGCTGAGAAGTTGTTGAAGAGAGAAAGAGGTGAAAGAGAGAGTAAGGTTACTTTGTCGGGGCTATTAAACGCCATTGATGGGTTGTGGTCAGCTTGTAGTGGAGAGAAGATTATTGTGTTTACTACGAATTATTTGGATAAGCTTGATCCAGCTTTGATACGTAGAGGAAGAATGGACAACCATATTGAGATGTCTTATTGTAGGTTTGAAGCGTTTAAGGTTTTGGCTAAGAACTACTTGGAGATTGAGTCACATGACTTGTTTGGAGAAATCAAGCGATTGGTGGAGGAAACTGACATGTCTCCAGCTGATGTTGCTGAGAACTTGATGCCGAAATCTGATGAAGACGATGCCGATATTTGCCTTACGCGGTTGGTTAAGTCTTTGGAGGAAGAGAAGGAGAAAGCAAAGAAGTTGGCTGAGGAAGAAAAGATGAAGAAAGCAGCGAGGGATGCAAGGAGGATCAAGAAGAAAGCAGAGGAAGAACACAAAAAGAAGAATAAAGTAGAGGAAAACGGCGACGTATCTCACGATAATGGTAACCATATTTGA

SEQ ID NO: 2057 - DNA, 1506 bp, Arabidopsis thaliana
  misc_feature (1)..(1506): Ceres cDNA ID no. 12736967
  misc_feature (1)..(1506): Also known as  Ceres CDNA ID no. 23372771
atgtcaattttcctctgtttcctcttgcttttgctacttcttttagtaacaataatcttcacaagaaaatctcaatcctcaaaactgaaacttcctccgggtccaccaaaacttccgattatcggaaacttacactaccttaacggattacctcacaaatgtctcctaaacctctggaaaatccacggaccagtgatgcagctccagttaggatacgtccctctagtcgtaatctcctcaaaccaagcagcagaagaagttctcaaaactcatgacctagattgttgcagccgaccagaaaccatagcgtcaaaaacaatatcttacaacttcaaagacataggattcgctccttacggcgaagaatggagagcgttgaggaagctcgctgtgatcgagctattcagcttgaaaaaattcaactcttttaggtatataagagaagaagagaatgacttgttggtcaagaaactctctgaagcttcagagaaacaatctcccgtgaatttgaagaaagcccttttcactctaagcgctagtatcgtgtgtagactcgctttcggtcaaaatcttcacgaatccgagtttatagatgaagatagcatggaggatttagcttctaggtcggagaagattcaggcgaaattcgctttctctaacttcttccccggaggttggattcttgataaaatcaccggtcaaagcaagagccttaacgaaatttttgctgatctcgacggattctttaaccaagtgctcgatgatcatctaaagccaggaagaaaagtattagagactccagatgttgtggatgtgatgattgatatgatgaataaacaaagccaagatggttcttttaagctcactactgatcatatcaaaggaatcatctctgatatatttctagccggagtaaacacaagtgcaacgaccattctttgggcaatgacagagttaataagaaacccaagagtgatgaagaaagtgcaagatgaggttaggacagtacttggtgaaaaaagagacagaatcacagaacaagatcttaaccaacttaactacttcaagctagtgatcaaagagacatttagattacacccagcagctccacttttattaccaagagaggcaatggctaaaatcaagatccaaggctatgacattccagagaaaactcagatcatggtcaatgtttacgcgataggacgtgatcctgacctctgggagaatccagaagagtttaaaccggaaagattcgttgatagttctgttgattatagaggacttaacttcgagcttctaccgtttggttctggtagaaggatttgtcccggtatgacgatggggatcgcgacagtcgaattaggattgttgaatttactttacttctttgattggggattgcctgaaggaaggacagtgaaagatatcgatttggaagaagaaggtgcgattattattggcaagaaagtttcgcttgaacttgtgcctactcgtcgtcaatga

SEQ ID NO: 2058 - protein, 1506 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGTCAATTTTCCTCTGTTTCCTCTTGCTTTTGCTACTTCTTTTAGTAACAATAATCTTCACAAGAAAATCTCAATCCTCAAAACTGAAACTTCCTCCGGGTCCACCAAAACTTCCGATTATCGGAAACTTACACTACCTTAACGGATTACCTCACAAATGTCTCCTAAACCTCTGGAAAATCCACGGACCAGTGATGCAGCTCCAGTTAGGATACGTCCCTCTAGTCGTAATCTCCTCAAACCAAGCAGCAGAAGAAGTTCTCAAAACTCATGACCTAGATTGTTGCAGCCGACCAGAAACCATAGCGTCAAAAACAATATCTTACAACTTCAAAGACATAGGATTCGCTCCTTACGGCGAAGAATGGAGAGCGTTGAGGAAGCTCGCTGTGATCGAGCTATTCAGCTTGAAAAAATTCAACTCTTTTAGGTATATAAGAGAAGAAGAGAATGACTTGTTGGTCAAGAAACTCTCTGAAGCTTCAGAGAAACAATCTCCCGTGAATTTGAAGAAAGCCCTTTTCACTCTAAGCGCTAGTATCGTGTGTAGACTCGCTTTCGGTCAAAATCTTCACGAATCCGAGTTTATAGATGAAGATAGCATGGAGGATTTAGCTTCTAGGTCGGAGAAGATTCAGGCGAAATTCGCTTTCTCTAACTTCTTCCCCGGAGGTTGGATTCTTGATAAAATCACCGGTCAAAGCAAGAGCCTTAACGAAATTTTTGCTGATCTCGACGGATTCTTTAACCAAGTGCTCGATGATCATCTAAAGCCAGGAAGAAAAGTATTAGAGACTCCAGATGTTGTGGATGTGATGATTGATATGATGAATAAACAAAGCCAAGATGGTTCTTTTAAGCTCACTACTGATCATATCAAAGGAATCATCTCTGATATATTTCTAGCCGGAGTAAACACAAGTGCAACGACCATTCTTTGGGCAATGACAGAGTTAATAAGAAACCCAAGAGTGATGAAGAAAGTGCAAGATGAGGTTAGGACAGTACTTGGTGAAAAAAGAGACAGAATCACAGAACAAGATCTTAACCAACTTAACTACTTCAAGCTAGTGATCAAAGAGACATTTAGATTACACCCAGCAGCTCCACTTTTATTACCAAGAGAGGCAATGGCTAAAATCAAGATCCAAGGCTATGACATTCCAGAGAAAACTCAGATCATGGTCAATGTTTACGCGATAGGACGTGATCCTGACCTCTGGGAGAATCCAGAAGAGTTTAAACCGGAAAGATTCGTTGATAGTTCTGTTGATTATAGAGGACTTAACTTCGAGCTTCTACCGTTTGGTTCTGGTAGAAGGATTTGTCCCGGTATGACGATGGGGATCGCGACAGTCGAATTAGGATTGTTGAATTTACTTTACTTCTTTGATTGGGGATTGCCTGAAGGAAGGACAGTGAAAGATATCGATTTGGAAGAAGAAGGTGCGATTATTATTGGCAAGAAAGTTTCGCTTGAACTTGTGCCTACTCGTCGTCAATGA

SEQ ID NO: 2059 - DNA, 1440 bp, Arabidopsis thaliana
  misc_feature (1)..(1440): Ceres cDNA ID no. 12737200
  misc_feature (1)..(1440): Also known as  Ceres CDNA ID no. 23372771
atgaactcggcaagcgtttccggtgaatcctctctctccgatatgattcagacagttcatttttcctctggaaaccctagaatcggcgagactcgcggtgtcatgcatctaatttccgacaatgctgtttcgtcatcttcttcttcctcctcctcgaatctccctattggaaggaaccctctcgtttgcgttcttggggtgcccaaccacatgacatatgcagatttttgccagttctgcggctccttcattcagcacatactggatatgcgaaccgtcaggaatgatgacattgaaaatagatacagcattttgataaggtttgatagtcaggaatctaccgatacattcttccagcatttcagagggaaacagttcaactctctggacgaagatgtctgtcgcctgctttttgctcttgatgttcagtttaccggttatagtggatccattgaccatacacagccttctgctgctggcccaatagagcaacctacttgcccagtgtgtcttgagagattggaccaagacacaggtggcattctcacaaccatgtgcaatcattccttccattgctcatgtatttctaattggccagattcttcttgcccagtttgtcgatattgccaacagcaacctgaaaattcagtatgttgtgtttgccaaacaacggagaatctctggatgtgtgttatctgtggggttgttggctgcggaaggtacaaggaaggacatgccagaaggcactgggaggagacagagcattgctattcacttgagcttgaaacacaacgtgtttgggattatgctggtgacaattatgttcaccggcttattcaatccaaaactgatggcaagctagtggagttgaattctcatggaagtctgagcaaggatggttgtggaagctgtgaatattctgacagtggaatgactgatgctctcctgaacagcaaagtggacatgatcattagtgagtacaacgaacttctccaggcacaactagagaatcaaaaacaatattttgaaaagttgctacaaaatgtcaaagaggaaacggaacagaaaatctcagaagctgcgagcaaggcaataagccagagactgcagaagctgcaaaccaggtttgacagatgtgtcaaagagaagcaatttcttgaagatttgaacgaaaatcttgtgaaaaataaggacgtatggagcaccaagattacagaaatgaaagaaagggagaagaaggcagttcgggcaaaggatgaaaagattcagggcttagaagaacagcttggaaacctaatggcccaaatggatggtgagagtgaagtctcagagacgaaagaggtccaggacgccactgtctcgaccaccaatacctcttcttctggggcagggaatgttatacatgcaaataaaaagaagagtaacagaagaaagggttag

SEQ ID NO: 2060 - protein, 1440 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGAACTCGGCAAGCGTTTCCGGTGAATCCTCTCTCTCCGATATGATTCAGACAGTTCATTTTTCCTCTGGAAACCCTAGAATCGGCGAGACTCGCGGTGTCATGCATCTAATTTCCGACAATGCTGTTTCGTCATCTTCTTCTTCCTCCTCCTCGAATCTCCCTATTGGAAGGAACCCTCTCGTTTGCGTTCTTGGGGTGCCCAACCACATGACATATGCAGATTTTTGCCAGTTCTGCGGCTCCTTCATTCAGCACATACTGGATATGCGAACCGTCAGGAATGATGACATTGAAAATAGATACAGCATTTTGATAAGGTTTGATAGTCAGGAATCTACCGATACATTCTTCCAGCATTTCAGAGGGAAACAGTTCAACTCTCTGGACGAAGATGTCTGTCGCCTGCTTTTTGCTCTTGATGTTCAGTTTACCGGTTATAGTGGATCCATTGACCATACACAGCCTTCTGCTGCTGGCCCAATAGAGCAACCTACTTGCCCAGTGTGTCTTGAGAGATTGGACCAAGACACAGGTGGCATTCTCACAACCATGTGCAATCATTCCTTCCATTGCTCATGTATTTCTAATTGGCCAGATTCTTCTTGCCCAGTTTGTCGATATTGCCAACAGCAACCTGAAAATTCAGTATGTTGTGTTTGCCAAACAACGGAGAATCTCTGGATGTGTGTTATCTGTGGGGTTGTTGGCTGCGGAAGGTACAAGGAAGGACATGCCAGAAGGCACTGGGAGGAGACAGAGCATTGCTATTCACTTGAGCTTGAAACACAACGTGTTTGGGATTATGCTGGTGACAATTATGTTCACCGGCTTATTCAATCCAAAACTGATGGCAAGCTAGTGGAGTTGAATTCTCATGGAAGTCTGAGCAAGGATGGTTGTGGAAGCTGTGAATATTCTGACAGTGGAATGACTGATGCTCTCCTGAACAGCAAAGTGGACATGATCATTAGTGAGTACAACGAACTTCTCCAGGCACAACTAGAGAATCAAAAACAATATTTTGAAAAGTTGCTACAAAATGTCAAAGAGGAAACGGAACAGAAAATCTCAGAAGCTGCGAGCAAGGCAATAAGCCAGAGACTGCAGAAGCTGCAAACCAGGTTTGACAGATGTGTCAAAGAGAAGCAATTTCTTGAAGATTTGAACGAAAATCTTGTGAAAAATAAGGACGTATGGAGCACCAAGATTACAGAAATGAAAGAAAGGGAGAAGAAGGCAGTTCGGGCAAAGGATGAAAAGATTCAGGGCTTAGAAGAACAGCTTGGAAACCTAATGGCCCAAATGGATGGTGAGAGTGAAGTCTCAGAGACGAAAGAGGTCCAGGACGCCACTGTCTCGACCACCAATACCTCTTCTTCTGGGGCAGGGAATGTTATACATGCAAATAAAAAGAAGAGTAACAGAAGAAAGGGTTAG

SEQ ID NO: 2061 - DNA, 2268 bp, Arabidopsis thaliana
  misc_feature (1)..(2268): Ceres cDNA ID no. 12737543
  misc_feature (1)..(2268): Also known as  Ceres CDNA ID no. 23372771
atggcggaatcaagctctcctctccctcctctttgtgaaaggatctcacacaaaagctatttcttaagagctgtggatctcactattctaggtcttctcctttctcttctattgtaccgtatcctacatgtgaaccaaaaggacaccgtttggatcgtggctttcctctgtgaaacttgtttcaccttcgtatggttgcttattaccaacataaaatggagtcctgctgattataaaacatatcctgaaagacttgatgaaagggttcatgaacttccaccggtagatatgttcgtgaccacagctgatccagtaagggagccaccgcttatcgttgtaaacacagtgctttcactgttagctgtgaattatccggcgaacaaactagcttgttatgtgtcggacgatggatgttcacctctcacttacttctctctcaaggaagcttctaagtttgccaagatttgggttcctttctgcaagaaatacaacgttagagttagagctccttttatgtacttcagaaactctccggaagcagcagaaggttctgaattcagtaaagactgggaaatgactaagagggagtacgagaagttaagccagaaagtagaagatgccactggaagttcccactggttggatgcagaagatgactttgaagctttcttaaacacaaaatcaaatgatcattcaactatagttaaggtggtatgggaaaacaagggaggtgtgggagacgaaaaagaggtccctcatgttgtttacatttcaagagagaaaagaccaaatcactttcatcattacaaagctggagccatgaactttctggtaagagtgtcagggttgatgacaaatgcaccatacatgttgaacgtagactgcgacatgtatgtcaatgaagcagatgtggtgcgacaagcaatgtgtatatttctgcaaaaatcaatggattcaaaccattgtgcttttgttcaataccctcaagatttctatgattctaatgtcggtgaactcaccgtcttacaattatacttgggacgaggaattgcgggaatccaaggacctcagtatgcgggttcaggatgcttccatactagaagagttatgtacggtctttctctagacgatttaggagacgatggaagtctttcttcaattgctacaaggaagtatttagctgaggagagtctaacgagagaatttgggaattctaaggagatggtgaaatcggtggtcgatgcgttacaaagaaaaccatttccccaaaaaaaccttaaggactctctagaaacggctcaagaaatgggacattgtcactacgagtaccaaaccagctggggaaaaaacatcggttggttatacgattcaacaacggaagatgtgaacacgagtatcggaattcattcgagagggtggactagctcatatatttttccggatccaccggcgtttcttgggtgtatgccacaaggaggaccggaggtaatggttcagcagcgacgatgggccacgggactgctcgaaatccttttcaacaaacaaagtccgttgatcggaatgttttgtcggaaaataagatttcgacaaagcttggcttatttatacgttttcagttggggtctaagatcaatccctgagctcttttactgtctcctgcctgcttattgcctactccacaactctgctttatttcccaagggagtttacttaggtataatcatcacacttgtggggatacattgtctttacactttatgggaattcatgaaccttggtttttccatacaatcgtggtatgtcactcaatcatttgggaggataaaaacaacttgtagttggttatttagcgtccttgatgtcatactcaagcttcttggaatatcgaaaaccgtcttcatagtcactaaaaagactatgcctgagaccaagtcagggtctggatccaaaaaatctcaacgagaagttgattgtccaaaccaagattccggtaaatttgaatttgatggctcgctttatttcttgccgggcacattcattgtgttagtgaatctagccgctctagccggttgtttggtgggtctacaaagtcgcggaggaggtggttcgggtttggcagaagcctgtggctgtattttggtggttattttgttccttccatttctaaagggtatgtttgagaagggaaaatatggtatcccattttctactctttctaaagctgcctttttagcagcgttatttgttgttttatctgtgggaaactag

SEQ ID NO: 2062 - protein, 2268 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGGCGGAATCAAGCTCTCCTCTCCCTCCTCTTTGTGAAAGGATCTCACACAAAAGCTATTTCTTAAGAGCTGTGGATCTCACTATTCTAGGTCTTCTCCTTTCTCTTCTATTGTACCGTATCCTACATGTGAACCAAAAGGACACCGTTTGGATCGTGGCTTTCCTCTGTGAAACTTGTTTCACCTTCGTATGGTTGCTTATTACCAACATAAAATGGAGTCCTGCTGATTATAAAACATATCCTGAAAGACTTGATGAAAGGGTTCATGAACTTCCACCGGTAGATATGTTCGTGACCACAGCTGATCCAGTAAGGGAGCCACCGCTTATCGTTGTAAACACAGTGCTTTCACTGTTAGCTGTGAATTATCCGGCGAACAAACTAGCTTGTTATGTGTCGGACGATGGATGTTCACCTCTCACTTACTTCTCTCTCAAGGAAGCTTCTAAGTTTGCCAAGATTTGGGTTCCTTTCTGCAAGAAATACAACGTTAGAGTTAGAGCTCCTTTTATGTACTTCAGAAACTCTCCGGAAGCAGCAGAAGGTTCTGAATTCAGTAAAGACTGGGAAATGACTAAGAGGGAGTACGAGAAGTTAAGCCAGAAAGTAGAAGATGCCACTGGAAGTTCCCACTGGTTGGATGCAGAAGATGACTTTGAAGCTTTCTTAAACACAAAATCAAATGATCATTCAACTATAGTTAAGGTGGTATGGGAAAACAAGGGAGGTGTGGGAGACGAAAAAGAGGTCCCTCATGTTGTTTACATTTCAAGAGAGAAAAGACCAAATCACTTTCATCATTACAAAGCTGGAGCCATGAACTTTCTGGTAAGAGTGTCAGGGTTGATGACAAATGCACCATACATGTTGAACGTAGACTGCGACATGTATGTCAATGAAGCAGATGTGGTGCGACAAGCAATGTGTATATTTCTGCAAAAATCAATGGATTCAAACCATTGTGCTTTTGTTCAATACCCTCAAGATTTCTATGATTCTAATGTCGGTGAACTCACCGTCTTACAATTATACTTGGGACGAGGAATTGCGGGAATCCAAGGACCTCAGTATGCGGGTTCAGGATGCTTCCATACTAGAAGAGTTATGTACGGTCTTTCTCTAGACGATTTAGGAGACGATGGAAGTCTTTCTTCAATTGCTACAAGGAAGTATTTAGCTGAGGAGAGTCTAACGAGAGAATTTGGGAATTCTAAGGAGATGGTGAAATCGGTGGTCGATGCGTTACAAAGAAAACCATTTCCCCAAAAAAACCTTAAGGACTCTCTAGAAACGGCTCAAGAAATGGGACATTGTCACTACGAGTACCAAACCAGCTGGGGAAAAAACATCGGTTGGTTATACGATTCAACAACGGAAGATGTGAACACGAGTATCGGAATTCATTCGAGAGGGTGGACTAGCTCATATATTTTTCCGGATCCACCGGCGTTTCTTGGGTGTATGCCACAAGGAGGACCGGAGGTAATGGTTCAGCAGCGACGATGGGCCACGGGACTGCTCGAAATCCTTTTCAACAAACAAAGTCCGTTGATCGGAATGTTTTGTCGGAAAATAAGATTTCGACAAAGCTTGGCTTATTTATACGTTTTCAGTTGGGGTCTAAGATCAATCCCTGAGCTCTTTTACTGTCTCCTGCCTGCTTATTGCCTACTCCACAACTCTGCTTTATTTCCCAAGGGAGTTTACTTAGGTATAATCATCACACTTGTGGGGATACATTGTCTTTACACTTTATGGGAATTCATGAACCTTGGTTTTTCCATACAATCGTGGTATGTCACTCAATCATTTGGGAGGATAAAAACAACTTGTAGTTGGTTATTTAGCGTCCTTGATGTCATACTCAAGCTTCTTGGAATATCGAAAACCGTCTTCATAGTCACTAAAAAGACTATGCCTGAGACCAAGTCAGGGTCTGGATCCAAAAAATCTCAACGAGAAGTTGATTGTCCAAACCAAGATTCCGGTAAATTTGAATTTGATGGCTCGCTTTATTTCTTGCCGGGCACATTCATTGTGTTAGTGAATCTAGCCGCTCTAGCCGGTTGTTTGGTGGGTCTACAAAGTCGCGGAGGAGGTGGTTCGGGTTTGGCAGAAGCCTGTGGCTGTATTTTGGTGGTTATTTTGTTCCTTCCATTTCTAAAGGGTATGTTTGAGAAGGGAAAATATGGTATCCCATTTTCTACTCTTTCTAAAGCTGCCTTTTTAGCAGCGTTATTTGTTGTTTTATCTGTGGGAAACTAG

SEQ ID NO: 2063 - DNA, 2514 bp, Arabidopsis thaliana
  misc_feature (1)..(2514): Ceres cDNA ID no. 12737653
  misc_feature (1)..(2514): Also known as  Ceres CDNA ID no. 23372771
atgaagtctcttcatttttgtttgctctttatgatcgtatcttttacagtttcgagacccgtcgaagctcaagatcaagcaggattcatcagcttggattgtgggttggtgcctaaggaaaccacttatgtggaaacgtcgacgaatataacatacaaatcagacgcaaattacaccgacagcggattggtcgggaagatcaatgatgcacacaagacactggttcaacaaccgctttgggccttgagaagcttccctgagggtgaaagaaactgttacaacttcaaccttaccgtgaacagcacatatttgatcagaggaacttttttgtatgggaattatgacggcttgaatcaatccccaagctttgaccttcacattggtgctagcaaatggacctctgttaacatagtaggagtaacagataccgtaatgcccgagataatccatgtcttaacacaaaaacgtcttcaagtctgtcttgttaagacaggaaagacgacaccgttcatttcgtcattggaattgcgtccgttgataaataacatttacatcgcggaaagtggatcaatggtcttgcaaaatagagtatattttccatctgattcaacatctatcgtcaggtacgatgaggacatacacgaccgagtatggaatccagtttcagatgatgattcctcatcgataagcacggacctccaggtccaaacaaataacttatatgacgtgcctcaattcgtaatgaagactgctgctatccctaaagatgctagtgcgccatggagcttagtgtggactatagataacaccactgctctgtcatatgtatatatgcatttcgcagaaattcaggatttaaaagccaatgaccttagagaattcgacattacttacaatggtggcaagctttggttttcccagtttaggcctaacaaactcagcattctaacgatgttcagtcaagtccccttgacttcatcaaatggcgagtataatttcactttcgaaatgactagtaactcaactcttccaccccttatcaacgccctcgagatatatacaggtctagaaattctacagcttcagacagacaaggatgaagtttctgctatgatgaacatcaaaacgacttatgatttgagcaaaaagataagctggcagggagatccatgtgctcctcagctgtatcggtgggaaggtctagattgtagttatccggacaccgaggcatcacggattatatccttgaacttgaatgcgagcgggttgaacggtaccataacatctgacataaccaagctaacacagttgagcgagcttttgggtgaaaaggttaaaatgaatcccacagccaaaaaagagagtaaaaaggttcccatagttcctatcgcagcatcagtggctggcgtgtttgctctgatagttatattggccatctttttcattgttaaaggaaaaaaagggaaaagtgctgaaggaccacccttatcagtcactagtggtacagctaaaagtgagacaagatcatccaatccatcaatcatgagaaaagatcgcaagatcacatatcctcaggtattgaagatgactaataacttcgagagagttcttggtaaaggagggtttggaacagtatatcatggaaacatggaagatgctcaagtagctgtgaaaatgctctcgcactcatcggctcaaggttataaagagttcaaagcagaggttgaacttcttttaagagttcaccacagacatttggtgggacttgtgggttactgtgatgatggagataacttggctctgatttatgaatatatggcaaatggagacctgagggagaatatgttaggaaaacgtggaggcaatgtccttacctgggaaaacaggatgcaaatagctgtagaggctgcacaaggactggagtatctgcacaatggatgtacgcctccaatggtccatagagatgttaaaactactaacatcttattgaatgcacagtgtggagcgaaactagccgactttgggctctctagatcttttccaatcgatggtgaatgtcatgtctcaacagtcgttgcgggtacacctgggtacctagaccctgagtattacagaacaaactggctaagcgagaagagtgacgtgtacagcttcggtgtagtgctattagagatagtcacaaaccagcctgttataaatcaaacaagagagagacctcacatcaatgaatgggttggcttcatgctcagtaaaggagacatcaagagcatcgtcgacccaaaactgatgggggactatgacacaaacggtgcatggaagattgtggagctgggtcttgcctgtgtgaacccgtcttcgaacctaagaccaacaatggcacacgttgtgattgagctaaacgagtgtgtggcctttgaaaatgcaaggcgacaaggtagtgaagagatgtacacaagaagttctactaactttagtcacacgtctgcttccgaattttcccccggggcaagataa

SEQ ID NO: 2064 - protein, 2514 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGAAGTCTCTTCATTTTTGTTTGCTCTTTATGATCGTATCTTTTACAGTTTCGAGACCCGTCGAAGCTCAAGATCAAGCAGGATTCATCAGCTTGGATTGTGGGTTGGTGCCTAAGGAAACCACTTATGTGGAAACGTCGACGAATATAACATACAAATCAGACGCAAATTACACCGACAGCGGATTGGTCGGGAAGATCAATGATGCACACAAGACACTGGTTCAACAACCGCTTTGGGCCTTGAGAAGCTTCCCTGAGGGTGAAAGAAACTGTTACAACTTCAACCTTACCGTGAACAGCACATATTTGATCAGAGGAACTTTTTTGTATGGGAATTATGACGGCTTGAATCAATCCCCAAGCTTTGACCTTCACATTGGTGCTAGCAAATGGACCTCTGTTAACATAGTAGGAGTAACAGATACCGTAATGCCCGAGATAATCCATGTCTTAACACAAAAACGTCTTCAAGTCTGTCTTGTTAAGACAGGAAAGACGACACCGTTCATTTCGTCATTGGAATTGCGTCCGTTGATAAATAACATTTACATCGCGGAAAGTGGATCAATGGTCTTGCAAAATAGAGTATATTTTCCATCTGATTCAACATCTATCGTCAGGTACGATGAGGACATACACGACCGAGTATGGAATCCAGTTTCAGATGATGATTCCTCATCGATAAGCACGGACCTCCAGGTCCAAACAAATAACTTATATGACGTGCCTCAATTCGTAATGAAGACTGCTGCTATCCCTAAAGATGCTAGTGCGCCATGGAGCTTAGTGTGGACTATAGATAACACCACTGCTCTGTCATATGTATATATGCATTTCGCAGAAATTCAGGATTTAAAAGCCAATGACCTTAGAGAATTCGACATTACTTACAATGGTGGCAAGCTTTGGTTTTCCCAGTTTAGGCCTAACAAACTCAGCATTCTAACGATGTTCAGTCAAGTCCCCTTGACTTCATCAAATGGCGAGTATAATTTCACTTTCGAAATGACTAGTAACTCAACTCTTCCACCCCTTATCAACGCCCTCGAGATATATACAGGTCTAGAAATTCTACAGCTTCAGACAGACAAGGATGAAGTTTCTGCTATGATGAACATCAAAACGACTTATGATTTGAGCAAAAAGATAAGCTGGCAGGGAGATCCATGTGCTCCTCAGCTGTATCGGTGGGAAGGTCTAGATTGTAGTTATCCGGACACCGAGGCATCACGGATTATATCCTTGAACTTGAATGCGAGCGGGTTGAACGGTACCATAACATCTGACATAACCAAGCTAACACAGTTGAGCGAGCTTTTGGGTGAAAAGGTTAAAATGAATCCCACAGCCAAAAAAGAGAGTAAAAAGGTTCCCATAGTTCCTATCGCAGCATCAGTGGCTGGCGTGTTTGCTCTGATAGTTATATTGGCCATCTTTTTCATTGTTAAAGGAAAAAAAGGGAAAAGTGCTGAAGGACCACCCTTATCAGTCACTAGTGGTACAGCTAAAAGTGAGACAAGATCATCCAATCCATCAATCATGAGAAAAGATCGCAAGATCACATATCCTCAGGTATTGAAGATGACTAATAACTTCGAGAGAGTTCTTGGTAAAGGAGGGTTTGGAACAGTATATCATGGAAACATGGAAGATGCTCAAGTAGCTGTGAAAATGCTCTCGCACTCATCGGCTCAAGGTTATAAAGAGTTCAAAGCAGAGGTTGAACTTCTTTTAAGAGTTCACCACAGACATTTGGTGGGACTTGTGGGTTACTGTGATGATGGAGATAACTTGGCTCTGATTTATGAATATATGGCAAATGGAGACCTGAGGGAGAATATGTTAGGAAAACGTGGAGGCAATGTCCTTACCTGGGAAAACAGGATGCAAATAGCTGTAGAGGCTGCACAAGGACTGGAGTATCTGCACAATGGATGTACGCCTCCAATGGTCCATAGAGATGTTAAAACTACTAACATCTTATTGAATGCACAGTGTGGAGCGAAACTAGCCGACTTTGGGCTCTCTAGATCTTTTCCAATCGATGGTGAATGTCATGTCTCAACAGTCGTTGCGGGTACACCTGGGTACCTAGACCCTGAGTATTACAGAACAAACTGGCTAAGCGAGAAGAGTGACGTGTACAGCTTCGGTGTAGTGCTATTAGAGATAGTCACAAACCAGCCTGTTATAAATCAAACAAGAGAGAGACCTCACATCAATGAATGGGTTGGCTTCATGCTCAGTAAAGGAGACATCAAGAGCATCGTCGACCCAAAACTGATGGGGGACTATGACACAAACGGTGCATGGAAGATTGTGGAGCTGGGTCTTGCCTGTGTGAACCCGTCTTCGAACCTAAGACCAACAATGGCACACGTTGTGATTGAGCTAAACGAGTGTGTGGCCTTTGAAAATGCAAGGCGACAAGGTAGTGAAGAGATGTACACAAGAAGTTCTACTAACTTTAGTCACACGTCTGCTTCCGAATTTTCCCCCGGGGCAAGATAA

SEQ ID NO: 2065 - DNA, 1092 bp, Arabidopsis thaliana
  misc_feature (1)..(1092): Ceres cDNA ID no. 12737675
  misc_feature (1)..(1092): Also known as  Ceres CDNA ID no. 23372771
atgatttctctacaaacttccggaggatcaagcgaagaagaagatatgttattagccatacaactaggcgggctaaactttgtcccgtacattgtaaaaactgctagagaactagatttgttcgagattatggctaaggccagacctttagggtcctatctctcaccggtggatttggcttccatggctgcgccgaaaaatccacacgctccaatgatgattgatagattgctacgtttccttgtggcatattcggtgtgcacgtgtaagttggtgaaagatgaagaaggacgagagtctagagcatacggattaggaaaagttggaaagaagttgattaaggatgaagacggattttcaattgcgccctatgtgctagctggctgtacaaaagccaagggaggtgtatggtcttaccttacggaggcaatacaagaaggcggagcatcggcatgggagcgagctaatgaggcattgatctttgaatacatgaagaaaaatgagaatttaaagaaaattttcaatgaatcgatgacgaatcatacatcaatagtaatgaagaaaatactagagaattacattggttttgaaggtgtgagtgactttgtagatgtaggaggaagcttaggcagtaatcttgcccaaatcctctccaagtacccacatatcaaaggcatcaacttcgacttgcctcacatagtcaaagaagctccccaaattcatggcgtggaacacattggtggtgatatgtttgatgaaattccacgaggcgaagttatattgatgaagtggatacttcatgattggaacgatgaaaaatgtgtggagatactaaaaaactgtaagaaagcattaccggaaactgggcgaataattgtaattgaaatgatagtaccccgagaggtatcagaaaccgatcttgcaaccaagaactcactcagtgcagatttgacgatgatgagcttaacgtctggaggcaaagagagaaccaaaaaggaatttgaagatctagctaaggaagctggctttaagctcccaaagattatttacggcgcgtattcttattggatcattgaattatatcctaattga

SEQ ID NO: 2066 - protein, 1092 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGATTTCTCTACAAACTTCCGGAGGATCAAGCGAAGAAGAAGATATGTTATTAGCCATACAACTAGGCGGGCTAAACTTTGTCCCGTACATTGTAAAAACTGCTAGAGAACTAGATTTGTTCGAGATTATGGCTAAGGCCAGACCTTTAGGGTCCTATCTCTCACCGGTGGATTTGGCTTCCATGGCTGCGCCGAAAAATCCACACGCTCCAATGATGATTGATAGATTGCTACGTTTCCTTGTGGCATATTCGGTGTGCACGTGTAAGTTGGTGAAAGATGAAGAAGGACGAGAGTCTAGAGCATACGGATTAGGAAAAGTTGGAAAGAAGTTGATTAAGGATGAAGACGGATTTTCAATTGCGCCCTATGTGCTAGCTGGCTGTACAAAAGCCAAGGGAGGTGTATGGTCTTACCTTACGGAGGCAATACAAGAAGGCGGAGCATCGGCATGGGAGCGAGCTAATGAGGCATTGATCTTTGAATACATGAAGAAAAATGAGAATTTAAAGAAAATTTTCAATGAATCGATGACGAATCATACATCAATAGTAATGAAGAAAATACTAGAGAATTACATTGGTTTTGAAGGTGTGAGTGACTTTGTAGATGTAGGAGGAAGCTTAGGCAGTAATCTTGCCCAAATCCTCTCCAAGTACCCACATATCAAAGGCATCAACTTCGACTTGCCTCACATAGTCAAAGAAGCTCCCCAAATTCATGGCGTGGAACACATTGGTGGTGATATGTTTGATGAAATTCCACGAGGCGAAGTTATATTGATGAAGTGGATACTTCATGATTGGAACGATGAAAAATGTGTGGAGATACTAAAAAACTGTAAGAAAGCATTACCGGAAACTGGGCGAATAATTGTAATTGAAATGATAGTACCCCGAGAGGTATCAGAAACCGATCTTGCAACCAAGAACTCACTCAGTGCAGATTTGACGATGATGAGCTTAACGTCTGGAGGCAAAGAGAGAACCAAAAAGGAATTTGAAGATCTAGCTAAGGAAGCTGGCTTTAAGCTCCCAAAGATTATTTACGGCGCGTATTCTTATTGGATCATTGAATTATATCCTAATTGA

SEQ ID NO: 2067 - DNA, 645 bp, Arabidopsis thaliana
  misc_feature (1)..(645): Ceres cDNA ID no. 12737723
  misc_feature (1)..(645): Also known as  Ceres CDNA ID no. 23372771
atgacggtagaagaagatcctaaagcaactccgtcattaccagactacaagcctttaccttcatcatcaagtcacgagctaaacgacgccgttctgatctcatcacatccttctcctccctcacgacgccgtttcatcatctctatatttctcatatcttttgcctcgatcctcatctacatcttctggccgtccgatccacgcatcaagatcatacgggtcaaaatttcccacgtgcacgttcaccgccgtccggtgccgtctatagacatgacgttgctcgttacgcttaaggtatcaaatgctgacgtgtactcttttgacttcacggatcttgacgtcacgattgactatagagggaagacgttaggtcacgtgagttctgatggcgggcacgtgacggcttttggttcttcttaccttgacgcggaggctgagcttgacggcgtcatggtgtttcctgacgtcattcatttgattcacgatttagctaaaggctccgttgaatttgacaccgttacggagactaacgggaaacttggcgttttgttcttccgtttccctttaaaggcaaaagtggcatgtgggattctagtagatactgttaatcagacaatttctcgtcaaagttgtagtcctctctaa

SEQ ID NO: 2068 - protein, 645 aa, Arabidopsis thaliana
  misc_feature: PFam Name: zf-TRAF; PFam Description: TRAF-type zinc finger
  misc_feature: GI Number: 21593788; NR Description: unknown [Arabidopsis thaliana]
  misc_feature: GI Number: 50939745; NR Description: XIAP associated factor-1-like protein [Oryza sativa (japonica cultivar-group)] >gi|33354198|dbj|BAC81156.1| XIAP associated factor-1-like protein [Oryza sativa (japonica cultivar-group)] [Oryza sativa
  misc_feature: GI Number: 49114926; NR Description: MGC80116 protein
  misc_feature: GI Number: 34872552; NR Description: similar to FLN29 gene
  misc_feature: GI Number: 50756455; NR Description: PREDICTED: similar to
ATGACGGTAGAAGAAGATCCTAAAGCAACTCCGTCATTACCAGACTACAAGCCTTTACCTTCATCATCAAGTCACGAGCTAAACGACGCCGTTCTGATCTCATCACATCCTTCTCCTCCCTCACGACGCCGTTTCATCATCTCTATATTTCTCATATCTTTTGCCTCGATCCTCATCTACATCTTCTGGCCGTCCGATCCACGCATCAAGATCATACGGGTCAAAATTTCCCACGTGCACGTTCACCGCCGTCCGGTGCCGTCTATAGACATGACGTTGCTCGTTACGCTTAAGGTATCAAATGCTGACGTGTACTCTTTTGACTTCACGGATCTTGACGTCACGATTGACTATAGAGGGAAGACGTTAGGTCACGTGAGTTCTGATGGCGGGCACGTGACGGCTTTTGGTTCTTCTTACCTTGACGCGGAGGCTGAGCTTGACGGCGTCATGGTGTTTCCTGACGTCATTCATTTGATTCACGATTTAGCTAAAGGCTCCGTTGAATTTGACACCGTTACGGAGACTAACGGGAAACTTGGCGTTTTGTTCTTCCGTTTCCCTTTAAAGGCAAAAGTGGCATGTGGGATTCTAGTAGATACTGTTAATCAGACAATTTCTCGTCAAAGTTGTAGTCCTCTCTAA

SEQ ID NO: 2069 - DNA, 1418 bp, Arabidopsis thaliana
  misc_feature (1)..(1418): Ceres cDNA ID no. 12738006
gtcagatatttttctcaacgtgaaagagagaaaagagaatctctcagaaggtgagcctccaacaaagcgtgaatctctctttctctctctatctctctatctccgagatcgcatcaccggaaatctccttctacggtggtggtggtgacagttgaccagagatggcggcggagaatgagagaaaatctccttcagcagtctccgatatgggagcttgggcaatgaatgtgataagctccgttggaatcatcatggcgaataaacaacttatgtcctcttctggattcgcatttagtttcgctacaactctcaccggtttccacttcgctttaaccgcattggtcggtatggtatcaaacgctaccggattctctgcttcgaagcatgtacctatgtgggagcttatttggttctccattgtcgctaatgtctctattgctgctatgaacttcagtctcatgctcaattccgttggcttctaccaaatctcgaagctgagcatgattcctgtggtatgtgtaatggaatggattctacatagcaagagatactcaagagaagtgaaaatatctgttgtggttgttgttgttggtgttggtatttgtactgtgactgatgttaaagttaatgccaaaggttttatctgtgcttgtgttgcgattttctcgtcatccttgcagcaaattttaataggttctctacagaagaaatattcaattgggtcctttgagttgttgagtaaaacagcgccgattcaagctttttcgcttcttgttgtcggtcctttagttgattatcttcttagtgggaagttcattatgaagtataatatgtcttccggttgctttctattcattcttctctcatgtggtctagctgtgttctgcaacataagccagtacctttgcatcgggcggttttcagcagtatcgttccaagttattggtcacatgaaaaccgtctgtatcctcacgcttggatggctcctatttgattctgcaatgactttcaaaaacgtagcggggatgattgttgcgattgttgggatggtaatctatagttgggcaatggaattggagaaacagtcgattattgcagcaaaggctttaaacagtgtgaaacatagcttaacagaggaagagtttgaacttttgaaggaaggtgtagaaactacacaatcaaaagatgttgaacttggccgcacaaaagattagagacagatggatagagaaagaaacatagtcttcaggtacaatttgttctgttataatttttgtatgttttgtgttatctaaaccaagagatcggatcctcggagattagtgtctaggcttcgatctaaagtttccttggttatacaaatgttttgtgttatttatatctttttacccaattccatggaaataacttcaatgacc

SEQ ID NO: 2070 - protein, 350 aa, Arabidopsis thaliana
  misc_feature: GI Number: 21536703; NR Description: unknown [Arabidopsis thaliana]
  misc_feature: GI Number: 51979016; NR Description: PREDICTED P0453G03.28 gene product [Oryza sativa (japonica cultivar-group)] >gi|51963502|ref|XP_506427.1| PREDICTED P0453G03.28 gene product [Oryza sativa (japonica cultivar-group)] (japonica
  misc_feature: GI Number: 30313364; NR Description: putative transmembrane
  misc_feature: GI Number: 50910467; NR Description: transmembrane protein-like [Oryza sativa (japonica cultivar-group)] >gi|47496808|dbj|BAD19452.1| transmembrane protein-like [Oryza sativa (japonica cultivar-group)] >gi|47497659|dbj|BAD19727.1|
  misc_feature: GI Number: 21595054; NR Description: unknown [Arabidopsis thaliana]
MAAENERKSPSAVSDMGAWAMNVISSVGIIMANKQLMSSSGFAFSFATTLTGFHFALTALVGMVSNATGFSASKHVPMWELIWFSIVANVSIAAMNFSLMLNSVGFYQISKLSMIPVVCVMEWILHSKRYSREVKISVVVVVVGVGICTVTDVKVNAKGFICACVAIFSSSLQQILIGSLQKKYSIGSFELLSKTAPIQAFSLLVVGPLVDYLLSGKFIMKYNMSSGCFLFILLSCGLAVFCNISQYLCIGRFSAVSFQVIGHMKTVCILTLGWLLFDSAMTFKNVAGMIVAIVGMVIYSWAMELEKQSIIAAKALNSVKHSLTEEEFELLKEGVETTQSKDVELGRTKD

SEQ ID NO: 2071 - DNA, 1598 bp, Arabidopsis thaliana
  misc_feature (1)..(1598): Ceres cDNA ID no. 12738448
  misc_feature (1)..(1598): Ceres CLONE  ID no. 7567
  misc_feature (1)..(1598): Also known as  Ceres CDNA ID no. 23556685
actcgccactttcctcgagaaaacgaaaaaaaaagatggtaggaagaagaaaagctttactcttttctctctgtttcttcttcctctctcttccttccttctcttcccttccatccttccaaaccctattccccaattctcattcccttccttgtgcttctcccgtctccttccaacccgactccgactccgagtcactgctagaatccgaatttgaatccggatccgactccgagtcttcttcttccattactctaaacctcgaccacatcgatgctctctcctccaacaaaacacctcaagagctattcagctcccgtctccaacgtgactcccggcgcgtgagatcaatcgccacactcgccgctcaaatccccggaagaaacgtgactcacgcgccacgacccggtggattcagcagctcagtcgtctctggtctctctcaaggaagcggtgaatacttcacgcgcctcggtgtcggtactccggcgagatatgtttacatggtgctcgacaccggcagcgacatcgtctggctacaatgcgctccttgtcggagatgttactctcaatccgacccgatattcgacccgagaaaatccaagacctatgccacaatcccctgttcttcacctcactgccgccgattagactccgccggatgcaacacccgtcgtaagacttgtctctaccaagtctcttacggagatggttctttcaccgtcggcgatttctccaccgaaacgctaactttccggcgaaatcgcgttaaaggcgttgctctcggatgtggccacgacaacgaaggtctcttcgtcggagccgccggtttattaggactcggtaaaggtaaattatcgttccccggtcaaaccggtcaccggtttaatcagaaattctcttactgtttagtcgacagatccgcttcttcgaaaccttcctcggtcgtcttcggaaacgccgccgtttcacgaatcgcgagattcacgccacttttgtcaaacccaaaactcgacactttctactacgtcgggcttctgggaattagcgtcggagggacacgtgtccccggcgtaacggcttctctttttaaacttgaccagatcggtaacggtggagttattatcgattcgggtacgtctgtgacccggttgatccgaccagcttatattgctatgagagacgcgttccgggtcggagctaagacattgaaaagagctccgaatttctcactcttcgacacgtgtttcgatctctccaatatgaacgaggttaaagtaccgacggtggttttacatttccgtagagctgacgtatcacttccggcgacgaattacctgatccctgtggataccaacggcaagttctgttttgcgtttgccggtacgatgggcggactatccataattggaaatatccagcaacagggtttccgggttgtatacgacttagcgagttcccgggtcgggtttgctccaggaggatgcgcttaataattagatctgaccggagccggtacggataatgtacttttgttttctcaatttaatgcttagacttgtttttttttcttttataaatcggacaagtgaatcttt

SEQ ID NO: 2072 - protein, 1598 aa, Arabidopsis thaliana
  misc_feature: PFam Name: Asp; PFam Description: Eukaryotic aspartyl protease
  misc_feature: GI Number: 21594980; NR Description: chloroplast nucleoid DNA
  misc_feature: GI Number: 50901910; NR Description: nucleoid DNA-binding protein cnd41-like protein [Oryza sativa (japonica cultivar-group)] >gi|15290061|dbj|BAB63755.1| nucleoid DNA-binding protein
  misc_feature: GI Number: 49328116; NR Description: putative nucleoid
  misc_feature: GI Number: 50932953; NR Description: unknow protein [Oryza sativa (japonica cultivar-group)] >gi|47777372|gb|AAT38006.1|
  misc_feature: GI Number: 23297732; NR Description: putative chloroplast nucleoid DNA-binding protein [Arabidopsis thaliana] >gi|11994113|dbj|BAB01116.1| CND41, chloroplast nucleoid DNA binding protein-like [Arabidopsis thaliana]
ACTCGCCACTTTCCTCGAGAAAACGAAAAAAAAAGATGGTAGGAAGAAGAAAAGCTTTACTCTTTTCTCTCTGTTTCTTCTTCCTCTCTCTTCCTTCCTTCTCTTCCCTTCCATCCTTCCAAACCCTATTCCCCAATTCTCATTCCCTTCCTTGTGCTTCTCCCGTCTCCTTCCAACCCGACTCCGACTCCGAGTCACTGCTAGAATCCGAATTTGAATCCGGATCCGACTCCGAGTCTTCTTCTTCCATTACTCTAAACCTCGACCACATCGATGCTCTCTCCTCCAACAAAACACCTCAAGAGCTATTCAGCTCCCGTCTCCAACGTGACTCCCGGCGCGTGAGATCAATCGCCACACTCGCCGCTCAAATCCCCGGAAGAAACGTGACTCACGCGCCACGACCCGGTGGATTCAGCAGCTCAGTCGTCTCTGGTCTCTCTCAAGGAAGCGGTGAATACTTCACGCGCCTCGGTGTCGGTACTCCGGCGAGATATGTTTACATGGTGCTCGACACCGGCAGCGACATCGTCTGGCTACAATGCGCTCCTTGTCGGAGATGTTACTCTCAATCCGACCCGATATTCGACCCGAGAAAATCCAAGACCTATGCCACAATCCCCTGTTCTTCACCTCACTGCCGCCGATTAGACTCCGCCGGATGCAACACCCGTCGTAAGACTTGTCTCTACCAAGTCTCTTACGGAGATGGTTCTTTCACCGTCGGCGATTTCTCCACCGAAACGCTAACTTTCCGGCGAAATCGCGTTAAAGGCGTTGCTCTCGGATGTGGCCACGACAACGAAGGTCTCTTCGTCGGAGCCGCCGGTTTATTAGGACTCGGTAAAGGTAAATTATCGTTCCCCGGTCAAACCGGTCACCGGTTTAATCAGAAATTCTCTTACTGTTTAGTCGACAGATCCGCTTCTTCGAAACCTTCCTCGGTCGTCTTCGGAAACGCCGCCGTTTCACGAATCGCGAGATTCACGCCACTTTTGTCAAACCCAAAACTCGACACTTTCTACTACGTCGGGCTTCTGGGAATTAGCGTCGGAGGGACACGTGTCCCCGGCGTAACGGCTTCTCTTTTTAAACTTGACCAGATCGGTAACGGTGGAGTTATTATCGATTCGGGTACGTCTGTGACCCGGTTGATCCGACCAGCTTATATTGCTATGAGAGACGCGTTCCGGGTCGGAGCTAAGACATTGAAAAGAGCTCCGAATTTCTCACTCTTCGACACGTGTTTCGATCTCTCCAATATGAACGAGGTTAAAGTACCGACGGTGGTTTTACATTTCCGTAGAGCTGACGTATCACTTCCGGCGACGAATTACCTGATCCCTGTGGATACCAACGGCAAGTTCTGTTTTGCGTTTGCCGGTACGATGGGCGGACTATCCATAATTGGAAATATCCAGCAACAGGGTTTCCGGGTTGTATACGACTTAGCGAGTTCCCGGGTCGGGTTTGCTCCAGGAGGATGCGCTTAATAATTAGATCTGACCGGAGCCGGTACGGATAATGTACTTTTGTTTTCTCAATTTAATGCTTAGACTTGTTTTTTTTTCTTTTATAAATCGGACAAGTGAATCTTT

SEQ ID NO: 2073 - DNA, 1571 bp, Arabidopsis thaliana
  misc_feature (1)..(1571): Ceres cDNA ID no. 13486971
  misc_feature (1)..(1571): Ceres CLONE  ID no. 19586
  misc_feature (1)..(1571): Also known as  Ceres CDNA ID no. 23357769
attttgtcttaacgactctttattgtcccgacacacgaaaatggcgtctcttagccaaatcaccctgccacgcgcgccgtcgtcggagattggcctcttacgccgtcgattggagcggccgatcatcagaacccggatcggattcaacggccggattgcgagcgtattgactaacgcaggggaccaagcggtgtcggtaaaagcgagtgtgagccagaaggtgattgaagaggaagccaaagttattgtgggtacctacgcgcgagctccagtggttctctcgagtgggaaaggttgtaaattgttcgaccctgaaggaaaagagtatctggattgtgcatctggaatcgctgtgaatgctcttggtcatggagatcctgattggcttcgagctgtcactgagcaagctggtgttcttgcccatgtcagcaatgtttattacacgatccctcagatagagctcgcaaaacgcttggtggcgagttcttttgcagaccgtgtattcttttgtaactcgggaacggaagccaatgaagcagccattaagttttcaagaaaattccagagattcacccatccagaagacaaagaagtcgcgacaggtttcatcgcctttacaaacagcttccatggaagaaccttaggagctcttgccttgacaagcaaagaacaatacagaactcctttcgaacccatcatgcctggtgtaaccttcttagaatatggtaacattcaagcagccacagaccttatccgctcaggtaaaatagctgcagtttttgtggaaccaattcaaggagaaggcgggatttactctgctacaaaagagtttctgcaatctctgcgctctgcttgtgatgccgctggatctcttctcgtcttcgatgaggttcaatgtggtttgggtcgaacgggtctcatgtgggcttatgaagccttcggtgtgactcctgacataatgacggttgcaaagcctttagctggtggtttacctattggagcggtgctggtgactgaaaaggttgcagagaccataaactacggagatcatggaagtacatttgcaggcagccctcttgtgtgcagtgcagccattgcagttatggataaagtatcgaaaccctctttcttgtccagtgtctcaaataaaggtcgatactttagagacctgttggtgaaaaaacttggaggaaactcgcacgtgaaggaagtgagaggcgaagggcttatcataggagtggagctcgatgtgccggcaagctcactggttgatgcttgccgagattcgggtcttctgatcttgacagcggggaaaggaaatgtcgtcaggattgttcctccgttggttatatcagaggaggaaatcgaacgtgcggttgagatcatgtctcaaaatttgactgcgcttgattgaagttcttggaagagaaatgatgtggtgttgaagaagagctaatgttttatattcgatcttgtcttaaattagcctcaagtgtaccggtaaagatgctctgcacaattgaaaagaaataaaatttgacacaaaacttgatgaactaattgttcaatct

SEQ ID NO: 2074 - protein, 1571 aa, Arabidopsis thaliana
  misc_feature: PFam Name: Aminotran_3; PFam Description: Aminotransferase
  misc_feature: GI Number: 1944511; NR Description: acetylornithine aminotransferase [Alnus glutinosa] >gi|2811029|sp|O04866|ARGD_ALNGL Acetylornithine aminotransferase, mitochondrial precursor (ACOAT)
  misc_feature: GI Number: 51854368; NR Description: putative acetylornithine
  misc_feature: GI Number: 21554043; NR Description: putative acetylornithine
  misc_feature: GI Number: 50936909; NR Description: putative acetylornithine aminotransferase [Oryza sativa (japonica cultivar-group)] >gi|34394063|dbj|BAC84165.1| putative acetylornithine
  misc_feature: GI Number: 53794956; NR Description: COG4992: Ornithine/acetylornithine aminotransferase [Chloroflexus
ATTTTGTCTTAACGACTCTTTATTGTCCCGACACACGAAAATGGCGTCTCTTAGCCAAATCACCCTGCCACGCGCGCCGTCGTCGGAGATTGGCCTCTTACGCCGTCGATTGGAGCGGCCGATCATCAGAACCCGGATCGGATTCAACGGCCGGATTGCGAGCGTATTGACTAACGCAGGGGACCAAGCGGTGTCGGTAAAAGCGAGTGTGAGCCAGAAGGTGATTGAAGAGGAAGCCAAAGTTATTGTGGGTACCTACGCGCGAGCTCCAGTGGTTCTCTCGAGTGGGAAAGGTTGTAAATTGTTCGACCCTGAAGGAAAAGAGTATCTGGATTGTGCATCTGGAATCGCTGTGAATGCTCTTGGTCATGGAGATCCTGATTGGCTTCGAGCTGTCACTGAGCAAGCTGGTGTTCTTGCCCATGTCAGCAATGTTTATTACACGATCCCTCAGATAGAGCTCGCAAAACGCTTGGTGGCGAGTTCTTTTGCAGACCGTGTATTCTTTTGTAACTCGGGAACGGAAGCCAATGAAGCAGCCATTAAGTTTTCAAGAAAATTCCAGAGATTCACCCATCCAGAAGACAAAGAAGTCGCGACAGGTTTCATCGCCTTTACAAACAGCTTCCATGGAAGAACCTTAGGAGCTCTTGCCTTGACAAGCAAAGAACAATACAGAACTCCTTTCGAACCCATCATGCCTGGTGTAACCTTCTTAGAATATGGTAACATTCAAGCAGCCACAGACCTTATCCGCTCAGGTAAAATAGCTGCAGTTTTTGTGGAACCAATTCAAGGAGAAGGCGGGATTTACTCTGCTACAAAAGAGTTTCTGCAATCTCTGCGCTCTGCTTGTGATGCCGCTGGATCTCTTCTCGTCTTCGATGAGGTTCAATGTGGTTTGGGTCGAACGGGTCTCATGTGGGCTTATGAAGCCTTCGGTGTGACTCCTGACATAATGACGGTTGCAAAGCCTTTAGCTGGTGGTTTACCTATTGGAGCGGTGCTGGTGACTGAAAAGGTTGCAGAGACCATAAACTACGGAGATCATGGAAGTACATTTGCAGGCAGCCCTCTTGTGTGCAGTGCAGCCATTGCAGTTATGGATAAAGTATCGAAACCCTCTTTCTTGTCCAGTGTCTCAAATAAAGGTCGATACTTTAGAGACCTGTTGGTGAAAAAACTTGGAGGAAACTCGCACGTGAAGGAAGTGAGAGGCGAAGGGCTTATCATAGGAGTGGAGCTCGATGTGCCGGCAAGCTCACTGGTTGATGCTTGCCGAGATTCGGGTCTTCTGATCTTGACAGCGGGGAAAGGAAATGTCGTCAGGATTGTTCCTCCGTTGGTTATATCAGAGGAGGAAATCGAACGTGCGGTTGAGATCATGTCTCAAAATTTGACTGCGCTTGATTGAAGTTCTTGGAAGAGAAATGATGTGGTGTTGAAGAAGAGCTAATGTTTTATATTCGATCTTGTCTTAAATTAGCCTCAAGTGTACCGGTAAAGATGCTCTGCACAATTGAAAAGAAATAAAATTTGACACAAAACTTGATGAACTAATTGTTCAATCT

SEQ ID NO: 2075 - DNA, 1708 bp, Arabidopsis thaliana
  misc_feature (1)..(1708): Ceres cDNA ID no. 13486985
  misc_feature (1)..(1708): Ceres CLONE  ID no. 29037
  misc_feature (1)..(1708): Also known as  Ceres CDNA ID no. 13486985
atcttcttcccccataacactcttcttctctcatcaaaatctctaactcaaaccttcctttgatcccaagaaatctcttccaaagccctaagccaaaagcttcaagagaaaaaatggcgatgatgggtcagttatggactaacacaggctctgctcttgcaacactaatgtttgtatacacaatcttcaaacaattcttccctctcttcggaccccagttggaaccattcctttatagactcttcggtcgcttctacccttacatccaaataacattccatgaatacagcggagagcatttcaagagaagcgaagcctacttggggatccagagctatctaagcaaagactcttctgctagagcaaagaaactcaaagccaacacaactaaaggaagcaaatctattgttcttagcatggatgataaggaagagatcactgacgattttgagggcattagggtttggtggcagtcgaagaaagagggagctactaggcaatctttctcgttttaccctgaagctaatgagaagagatattacatgttaaggttccacagacgtgaccgagaagtaatcatagagaggtatcttgagcatgttatgagagaagggaagacgatagagcaaaagaacagagagaggaagctttattcgaatactccgggtcagagccatggaaacaacagtaagtggagtcatgtaacctttgagcatccagctacgtttgatactctagctatggaagagaataagaaggaagagatcaagagtgatctgatcaagtttagtaagagtaaagattattacaagaagatcggaaaagcgtggaagagagggtatcttttgtttggaccacccgggactgggaagtctacaatgatcgcagcgatggctaatttcttggagtatgatgtttatgatcttgagttgacaacggttaaggataatacacatctgagaaggttattgattgagacttcagcgaaatcgattattgtgattgaagatatcgattgttcgcttaatctaacggggcagagaaagaagaaggaggaggaagaggaagatggagacgataagaacacgattgagaagaagatgatgatgaagaatgaaggtgagaataaagagagtaaagttactttatcagggctactaaatttcattgatggtttatggtcagcttgtggtggtgagaggatcattgtattcactacaaactttgtggacaagttagatccggctttgattaggaaaggaagaatggataagcatatagagatgtcgtattgttgtttcgaagcgtttaaggtattggctaagaactatttggatgtggaagagagtgagatgtttgaggagataaagaggttgcttgaggttgaagaaatcaagatgacaccggcggatgttggggagaatctgttaccgaagtcagaaaaggaaggaggtgagacttgtttgaagagattgatcgaagcgttgaaggaagagaaggaggaagcgaagaagaaggtcgaggaagaggaggaagagaagcagaggaaaaaggaaaaggtgaaagaaatagaggcagagaaagagaagaagaaaaagattgaagaagagaattgagtttgaaggaaatttgttggattgtagtatctaactgaaataattgtagtctgattggttcatcttatgaatgttttgtgtttcatttagcg

SEQ ID NO: 2076 - protein, 1708 aa, Arabidopsis thaliana
ATCTTCTTCCCCCATAACACTCTTCTTCTCTCATCAAAATCTCTAACTCAAACCTTCCTTTGATCCCAAGAAATCTCTTCCAAAGCCCTAAGCCAAAAGCTTCAAGAGAAAAAATGGCGATGATGGGTCAGTTATGGACTAACACAGGCTCTGCTCTTGCAACACTAATGTTTGTATACACAATCTTCAAACAATTCTTCCCTCTCTTCGGACCCCAGTTGGAACCATTCCTTTATAGACTCTTCGGTCGCTTCTACCCTTACATCCAAATAACATTCCATGAATACAGCGGAGAGCATTTCAAGAGAAGCGAAGCCTACTTGGGGATCCAGAGCTATCTAAGCAAAGACTCTTCTGCTAGAGCAAAGAAACTCAAAGCCAACACAACTAAAGGAAGCAAATCTATTGTTCTTAGCATGGATGATAAGGAAGAGATCACTGACGATTTTGAGGGCATTAGGGTTTGGTGGCAGTCGAAGAAAGAGGGAGCTACTAGGCAATCTTTCTCGTTTTACCCTGAAGCTAATGAGAAGAGATATTACATGTTAAGGTTCCACAGACGTGACCGAGAAGTAATCATAGAGAGGTATCTTGAGCATGTTATGAGAGAAGGGAAGACGATAGAGCAAAAGAACAGAGAGAGGAAGCTTTATTCGAATACTCCGGGTCAGAGCCATGGAAACAACAGTAAGTGGAGTCATGTAACCTTTGAGCATCCAGCTACGTTTGATACTCTAGCTATGGAAGAGAATAAGAAGGAAGAGATCAAGAGTGATCTGATCAAGTTTAGTAAGAGTAAAGATTATTACAAGAAGATCGGAAAAGCGTGGAAGAGAGGGTATCTTTTGTTTGGACCACCCGGGACTGGGAAGTCTACAATGATCGCAGCGATGGCTAATTTCTTGGAGTATGATGTTTATGATCTTGAGTTGACAACGGTTAAGGATAATACACATCTGAGAAGGTTATTGATTGAGACTTCAGCGAAATCGATTATTGTGATTGAAGATATCGATTGTTCGCTTAATCTAACGGGGCAGAGAAAGAAGAAGGAGGAGGAAGAGGAAGATGGAGACGATAAGAACACGATTGAGAAGAAGATGATGATGAAGAATGAAGGTGAGAATAAAGAGAGTAAAGTTACTTTATCAGGGCTACTAAATTTCATTGATGGTTTATGGTCAGCTTGTGGTGGTGAGAGGATCATTGTATTCACTACAAACTTTGTGGACAAGTTAGATCCGGCTTTGATTAGGAAAGGAAGAATGGATAAGCATATAGAGATGTCGTATTGTTGTTTCGAAGCGTTTAAGGTATTGGCTAAGAACTATTTGGATGTGGAAGAGAGTGAGATGTTTGAGGAGATAAAGAGGTTGCTTGAGGTTGAAGAAATCAAGATGACACCGGCGGATGTTGGGGAGAATCTGTTACCGAAGTCAGAAAAGGAAGGAGGTGAGACTTGTTTGAAGAGATTGATCGAAGCGTTGAAGGAAGAGAAGGAGGAAGCGAAGAAGAAGGTCGAGGAAGAGGAGGAAGAGAAGCAGAGGAAAAAGGAAAAGGTGAAAGAAATAGAGGCAGAGAAAGAGAAGAAGAAAAAGATTGAAGAAGAGAATTGAGTTTGAAGGAAATTTGTTGGATTGTAGTATCTAACTGAAATAATTGTAGTCTGATTGGTTCATCTTATGAATGTTTTGTGTTTCATTTAGCG

SEQ ID NO: 2077 - DNA, 752 bp, Arabidopsis thaliana
  misc_feature (1)..(752): Ceres cDNA ID no. 13487050
  misc_feature (1)..(752): Ceres CLONE  ID no. 20036
  misc_feature (1)..(752): Also known as  Ceres CDNA ID no. 23358103
aaaaatcacaaatcttcaacttccgatactttcaatctctctaaactctcaatttcagtaatcgataaccgtagcaatggaatccaccggaaaagtgaagaaagctttcggaggaagaaaaccacctggtgccccaaaaaccaaatcggtttcgaaatcgatgaaagccggtcttcaattcccagtgggaagaatcactcgtttcctgaagaaaggacgatacgctcagagacttggtggtggtgctccggtttacatggccgccgttcttgaatacctcgccgcagaagttctggagcttgctggtaacgctgcgagagataacaagaaatcaaggataattccgaggcatcttcttctcgcgataaggaacgatgaagaattggggaaacttctgagtggtgtcacaatcgctcacggtggtgttttgcctaacatcaactctgttctattgcctaagaagtctgccactaaaccagctgaagaaaaggctaccaaatcaccagtcaagtctccaaagaaagcttaatctgctagagttttcgttgctagtttgtgtttgagctctggtgaatgtagaaatttgaagcttttggatcttagtttctatgtatttggtgatttagaatgttgttcaaaatccttttcctaatcataagaatttatgatctatctattatacgcttcgtctaatcttttggtccactcgtcgtaatgtcattagtgaatatttaataaacaactttgtcatc

SEQ ID NO: 2078 - protein, 752 aa, Arabidopsis thaliana
  misc_feature: PFam Name: Histone; PFam Description: Core histone H2A/H2B/H3/H4
  misc_feature: GI Number: 21554077; NR Description: histone H2A-like protein [Arabidopsis thaliana] >gi|26450843|dbj|BAC42529.1| putative histone H2A [Arabidopsis thaliana] >gi|9757908|dbj|BAB08355.1| histone H2A-like protein [Arabidopsis thaliana]
  misc_feature: GI Number: 47026912; NR Description: histone H2A [Hyacinthus
  misc_feature: GI Number: 47026919; NR Description: histone H2A [Hyacinthus
  misc_feature: GI Number: 27529852; NR Description: H2A histone [Nicotiana
  misc_feature: GI Number: 122003; NR Description: HISTONE H2A
AAAAATCACAAATCTTCAACTTCCGATACTTTCAATCTCTCTAAACTCTCAATTTCAGTAATCGATAACCGTAGCAATGGAATCCACCGGAAAAGTGAAGAAAGCTTTCGGAGGAAGAAAACCACCTGGTGCCCCAAAAACCAAATCGGTTTCGAAATCGATGAAAGCCGGTCTTCAATTCCCAGTGGGAAGAATCACTCGTTTCCTGAAGAAAGGACGATACGCTCAGAGACTTGGTGGTGGTGCTCCGGTTTACATGGCCGCCGTTCTTGAATACCTCGCCGCAGAAGTTCTGGAGCTTGCTGGTAACGCTGCGAGAGATAACAAGAAATCAAGGATAATTCCGAGGCATCTTCTTCTCGCGATAAGGAACGATGAAGAATTGGGGAAACTTCTGAGTGGTGTCACAATCGCTCACGGTGGTGTTTTGCCTAACATCAACTCTGTTCTATTGCCTAAGAAGTCTGCCACTAAACCAGCTGAAGAAAAGGCTACCAAATCACCAGTCAAGTCTCCAAAGAAAGCTTAATCTGCTAGAGTTTTCGTTGCTAGTTTGTGTTTGAGCTCTGGTGAATGTAGAAATTTGAAGCTTTTGGATCTTAGTTTCTATGTATTTGGTGATTTAGAATGTTGTTCAAAATCCTTTTCCTAATCATAAGAATTTATGATCTATCTATTATACGCTTCGTCTAATCTTTTGGTCCACTCGTCGTAATGTCATTAGTGAATATTTAATAAACAACTTTGTCATC

SEQ ID NO: 2079 - DNA, 1296 bp, Arabidopsis thaliana
  misc_feature (1)..(1296): Ceres cDNA ID no. 13487147
  misc_feature (1)..(1296): Also known as  Ceres CDNA ID no. 23358103
actgcatcttatctccactctcaaaatcatcttcttcacccaaaaacccctaaaagccttatcccttcttcttcccatggctgcttcagcttcgtctctcgctctctcttccttcaaccctaaatctcttcctttcggcgtctccagacctgcctccgtttccctcttatctccttccctctcctttaaactcaattccgactccgtttccttctccatcgccgccaaatggaactctcccgcttctcgcttcgcccgtaacgttgcgattacctcagagttcgaggtggaagaagatggtttcgctgacgtcgctccgccaaaagagcaatctttctctgctgaccttaaactcttcgttggtaaccttcctttcaacgttgacagtgctcagctcgctcagctctttgagagtgccggaaatgttgagatggttgaggtaatctatgacaaaattacaggaagaagcagaggttttggattcgtgactatgtcttcagtttctgaagttgaggcagctgctcagcagttcaatggctatgagttggatggtagacctttgagagtcaatgctggtcccccaccaccaaagagggaagatggtttctccagaggacctaggagcagctttggaagctcaggttctggatatggaggaggtggtggttctggtgctggttcaggaaaccgtgtttatgtgggtaacctctcttggggagttgatgacatggctcttgagagtttgttctcggagcaaggaaaggttgttgaggccagagtcatctacgacagggacagtggtcgatccaagggttttggatttgtgacatacgactcttctcaagaggtccaaaatgccatcaagtccttggatggtgctgatttggacggtagacaaattagagtctcggaagctgaggctaggcctccaaggcgccaatattgagcaccaatctatgacttcctattctcaaaaacgcatattctggagggcgcttcgaagtaaagagggtttgtgagatgatggcagtttcagacggtactaagctcttagcttcgcctatgtttgttgccttggatgcaagaaggtcgtaaaggaatggtctttttttttttgagaaacgtataattaagatagaaactggagagaccatgttcttgtctgtctgaatgctgccattgactgcttcgctttggttttgattcaatttttttttctctctatatcgtggtctcttcttcctaatgcttctctgtttatttgatcctctgctcaaatgaatatgaacacacttg

SEQ ID NO: 2080 - protein, 1296 aa, Arabidopsis thaliana
  misc_feature: PFam Name: Histone; PFam Description: Core histone H2A/H2B/H3/H4
  misc_feature: GI Number: 21554077; NR Description: histone H2A-like protein [Arabidopsis thaliana] >gi|26450843|dbj|BAC42529.1| putative histone H2A [Arabidopsis thaliana] >gi|9757908|dbj|BAB08355.1| histone H2A-like protein [Arabidopsis thaliana]
  misc_feature: GI Number: 47026912; NR Description: histone H2A [Hyacinthus
  misc_feature: GI Number: 47026919; NR Description: histone H2A [Hyacinthus
  misc_feature: GI Number: 27529852; NR Description: H2A histone [Nicotiana
  misc_feature: GI Number: 122003; NR Description: HISTONE H2A
ACTGCATCTTATCTCCACTCTCAAAATCATCTTCTTCACCCAAAAACCCCTAAAAGCCTTATCCCTTCTTCTTCCCATGGCTGCTTCAGCTTCGTCTCTCGCTCTCTCTTCCTTCAACCCTAAATCTCTTCCTTTCGGCGTCTCCAGACCTGCCTCCGTTTCCCTCTTATCTCCTTCCCTCTCCTTTAAACTCAATTCCGACTCCGTTTCCTTCTCCATCGCCGCCAAATGGAACTCTCCCGCTTCTCGCTTCGCCCGTAACGTTGCGATTACCTCAGAGTTCGAGGTGGAAGAAGATGGTTTCGCTGACGTCGCTCCGCCAAAAGAGCAATCTTTCTCTGCTGACCTTAAACTCTTCGTTGGTAACCTTCCTTTCAACGTTGACAGTGCTCAGCTCGCTCAGCTCTTTGAGAGTGCCGGAAATGTTGAGATGGTTGAGGTAATCTATGACAAAATTACAGGAAGAAGCAGAGGTTTTGGATTCGTGACTATGTCTTCAGTTTCTGAAGTTGAGGCAGCTGCTCAGCAGTTCAATGGCTATGAGTTGGATGGTAGACCTTTGAGAGTCAATGCTGGTCCCCCACCACCAAAGAGGGAAGATGGTTTCTCCAGAGGACCTAGGAGCAGCTTTGGAAGCTCAGGTTCTGGATATGGAGGAGGTGGTGGTTCTGGTGCTGGTTCAGGAAACCGTGTTTATGTGGGTAACCTCTCTTGGGGAGTTGATGACATGGCTCTTGAGAGTTTGTTCTCGGAGCAAGGAAAGGTTGTTGAGGCCAGAGTCATCTACGACAGGGACAGTGGTCGATCCAAGGGTTTTGGATTTGTGACATACGACTCTTCTCAAGAGGTCCAAAATGCCATCAAGTCCTTGGATGGTGCTGATTTGGACGGTAGACAAATTAGAGTCTCGGAAGCTGAGGCTAGGCCTCCAAGGCGCCAATATTGAGCACCAATCTATGACTTCCTATTCTCAAAAACGCATATTCTGGAGGGCGCTTCGAAGTAAAGAGGGTTTGTGAGATGATGGCAGTTTCAGACGGTACTAAGCTCTTAGCTTCGCCTATGTTTGTTGCCTTGGATGCAAGAAGGTCGTAAAGGAATGGTCTTTTTTTTTTTGAGAAACGTATAATTAAGATAGAAACTGGAGAGACCATGTTCTTGTCTGTCTGAATGCTGCCATTGACTGCTTCGCTTTGGTTTTGATTCAATTTTTTTTTCTCTCTATATCGTGGTCTCTTCTTCCTAATGCTTCTCTGTTTATTTGATCCTCTGCTCAAATGAATATGAACACACTTG

SEQ ID NO: 2081 - DNA, 931 bp, Arabidopsis thaliana
  misc_feature (1)..(931): Ceres cDNA ID no. 13487218
  misc_feature (1)..(931): Ceres CLONE  ID no. 110391
  misc_feature (1)..(931): Also known as  Ceres CDNA ID no. 23358584
aagcatcagattagcttttgtagggtttttcttttccggtttcatgtaccctcctaattcctctaagtccaccgctcatgacggcggcggcgatgccgacaccaatcaatatgactcagccgctggagctacccgtgatttctcctctcttggccctcaaacccaccatcatccgccaccgcagcggcagcagcagcatcagcagaatcccaacctcgtcggccattatttaccgggcgagccatcttccatcggattcgattccaacgcttcttcttcgtcttctttgttccgacacagaagctctccggctggattctacgaccaacatcttcccactgatcccaacggtttttctctaggacggccaaacggaggctacggcggaggaggagagcaagggccgtcgaggttgaagtcggagctgagattctctagtgggagtagtagccatcaagaacataattctctaccgcgaatctcggaggttgaagcggctgcagcggctagaaacggtgtcgcatcaagtagtatgagttttggaaataatcgtactaacaattgggacaactcgtcttctcatatcagtttcaccattgatcaacccggaaaacggtccaagaactccgactttttcaccttagaaactcagtatagcatgccgcaaacaactctggaaatggcgacaatggagaacttgatgaacatcccagaggactcggtgccttgtagggctagagccaagcgcggcttcgcgactcacccacgcagcattgctgaaagggagagaagaacgaggataagcgggaagctgaagaagctacaagaacttgtgcctaatatggacaagcaaacgagctacgcagatatgttggatttggctgttgagcatatcaaaggtcttcagcaccaagtagaggtgcgtccttag

SEQ ID NO: 2082 - protein, 931 aa, Arabidopsis thaliana
  misc_feature: PFam Name: HLH; PFam Description: Helix-loop-helix
  misc_feature: GI Number: 21554238; NR Description: Contains similarity to bHLH transcription factor GBOF-1 from Tulipa gesneriana gb|AF185269
  misc_feature: GI Number: 52421281; NR Description: At2g42280 [Arabidopsis thaliana] >gi|51536448|gb|AAU05462.1| At2g42280 [Arabidopsis thaliana] >gi|42569863|ref|NP_181757.2| basic helix-loop-helix
  misc_feature: GI Number: 50947455; NR Description: putative transcription factor RAU1 [Oryza sativa (japonica cultivar-group)] >gi|42408931|dbj|BAD10188.1| putative transcription factor RAU1
  misc_feature: GI Number: 34907702; NR Description: P0035F12.11 [Oryza sativa (japonica cultivar-group)] >gi|20161021|dbj|BAB89954.1| P0035F12.11 [Oryza sativa (japonica cultivar-group)] >gi|20161601|dbj|BAB90521.1| B1065G12.3 [Oryza sativa (japonica
  misc_feature: GI Number: 56784863; NR Description: putative helix-loop-helix protein 1A [Oryza sativa (japonica
AAGCATCAGATTAGCTTTTGTAGGGTTTTTCTTTTCCGGTTTCATGTACCCTCCTAATTCCTCTAAGTCCACCGCTCATGACGGCGGCGGCGATGCCGACACCAATCAATATGACTCAGCCGCTGGAGCTACCCGTGATTTCTCCTCTCTTGGCCCTCAAACCCACCATCATCCGCCACCGCAGCGGCAGCAGCAGCATCAGCAGAATCCCAACCTCGTCGGCCATTATTTACCGGGCGAGCCATCTTCCATCGGATTCGATTCCAACGCTTCTTCTTCGTCTTCTTTGTTCCGACACAGAAGCTCTCCGGCTGGATTCTACGACCAACATCTTCCCACTGATCCCAACGGTTTTTCTCTAGGACGGCCAAACGGAGGCTACGGCGGAGGAGGAGAGCAAGGGCCGTCGAGGTTGAAGTCGGAGCTGAGATTCTCTAGTGGGAGTAGTAGCCATCAAGAACATAATTCTCTACCGCGAATCTCGGAGGTTGAAGCGGCTGCAGCGGCTAGAAACGGTGTCGCATCAAGTAGTATGAGTTTTGGAAATAATCGTACTAACAATTGGGACAACTCGTCTTCTCATATCAGTTTCACCATTGATCAACCCGGAAAACGGTCCAAGAACTCCGACTTTTTCACCTTAGAAACTCAGTATAGCATGCCGCAAACAACTCTGGAAATGGCGACAATGGAGAACTTGATGAACATCCCAGAGGACTCGGTGCCTTGTAGGGCTAGAGCCAAGCGCGGCTTCGCGACTCACCCACGCAGCATTGCTGAAAGGGAGAGAAGAACGAGGATAAGCGGGAAGCTGAAGAAGCTACAAGAACTTGTGCCTAATATGGACAAGCAAACGAGCTACGCAGATATGTTGGATTTGGCTGTTGAGCATATCAAAGGTCTTCAGCACCAAGTAGAGGTGCGTCCTTAG

SEQ ID NO: 2083 - DNA, 914 bp, Arabidopsis thaliana
  misc_feature (1)..(914): Ceres cDNA ID no. 13487274
  misc_feature (1)..(914): Ceres CLONE  ID no. 1259
  misc_feature (1)..(914): Also known as  Ceres CDNA ID no. 23358735
aaatggcgtcgtcgaagcacgaagactatggcatcccttacacacctcttccatcatcacaaccatctcaatccgtaatccttctaactccttatcgccgtcaccgtcgtccttcacttctccgtaacctccgttgttctctcctcttcaccgccgtaatcctcctcctctccgccgccgtttacttactctacccttcagatccagacatcactgtctcacgaatcaatctcaaccacataagcgtcgttgattctcataaaatcgctttagatctctcgttttcgctcacaatcaaagttcgaaaccgagatttcttctcacttgattacgattcgcttgttgtttcgattgggtatagaggaagagagttaggtcttgttaagtctaaaggtggacatcttaaagctcgtgatagctcttatattgatgctacgcttgagcttgatggtcttgaggttgttcatgatgttatttatttgattggtgatttggctaaaggtgttattccttttgatactattgctcaagttcaaggtgatcttggtgttctcttgttcaatatcccaattcagggtaaagtgtcgtgtgaggtgtatgttaatgttaacaaccagaaaatttcacaccaagattgtcatcgtaagtgaagtgcaatcctgagctggatgagagatgaagaaaccagataacatacgttgacatgttttgagttctggagaaatgatttgtgagtttttgtatagataaaatactcttaatgttaaaactgaaagatagaatgagaaagatgaaccactactttctgtaattaaagttctttcttaattcctcagatgtgtacaagtgtttgcttttatgttgtagacatgaataaaccactcaataaaccatgtaattcgaagtcttcaaag

SEQ ID NO: 2084 - protein, 914 aa, Arabidopsis thaliana
  misc_feature: PFam Name: Hin1; PFam Description: Harpin-induced protein 1 (Hin1)
  misc_feature: GI Number: 21553792; NR Description: unknown [Arabidopsis thaliana]
AAATGGCGTCGTCGAAGCACGAAGACTATGGCATCCCTTACACACCTCTTCCATCATCACAACCATCTCAATCCGTAATCCTTCTAACTCCTTATCGCCGTCACCGTCGTCCTTCACTTCTCCGTAACCTCCGTTGTTCTCTCCTCTTCACCGCCGTAATCCTCCTCCTCTCCGCCGCCGTTTACTTACTCTACCCTTCAGATCCAGACATCACTGTCTCACGAATCAATCTCAACCACATAAGCGTCGTTGATTCTCATAAAATCGCTTTAGATCTCTCGTTTTCGCTCACAATCAAAGTTCGAAACCGAGATTTCTTCTCACTTGATTACGATTCGCTTGTTGTTTCGATTGGGTATAGAGGAAGAGAGTTAGGTCTTGTTAAGTCTAAAGGTGGACATCTTAAAGCTCGTGATAGCTCTTATATTGATGCTACGCTTGAGCTTGATGGTCTTGAGGTTGTTCATGATGTTATTTATTTGATTGGTGATTTGGCTAAAGGTGTTATTCCTTTTGATACTATTGCTCAAGTTCAAGGTGATCTTGGTGTTCTCTTGTTCAATATCCCAATTCAGGGTAAAGTGTCGTGTGAGGTGTATGTTAATGTTAACAACCAGAAAATTTCACACCAAGATTGTCATCGTAAGTGAAGTGCAATCCTGAGCTGGATGAGAGATGAAGAAACCAGATAACATACGTTGACATGTTTTGAGTTCTGGAGAAATGATTTGTGAGTTTTTGTATAGATAAAATACTCTTAATGTTAAAACTGAAAGATAGAATGAGAAAGATGAACCACTACTTTCTGTAATTAAAGTTCTTTCTTAATTCCTCAGATGTGTACAAGTGTTTGCTTTTATGTTGTAGACATGAATAAACCACTCAATAAACCATGTAATTCGAAGTCTTCAAAG

SEQ ID NO: 2085 - DNA, 1708 bp, Arabidopsis thaliana
  misc_feature (1)..(1708): Ceres cDNA ID no. 13487415
  misc_feature (1)..(1708): Ceres CLONE  ID no. 115260
  misc_feature (1)..(1708): Also known as  Ceres CDNA ID no. 23359192
gtaactggagagaaaaagctatcaaagttaaaagttatggcgagccatttttgcttgcttctgatcttcactttcttcactctagtgtttccgtcaaacggatcttcactgtcttcttccaagcttttacctcgtttccctcgctacactttccagaaccgagaagccagaatccagcagttccggggagatcgaaacgagtatcgatacgagactaagttcttctcacagcagctggaccacttcagcttcgccgatcttcccaaattctctcaacgctacctcatcaattccgatcactggcttggtgcttctgcgcttggacctatcttcctttactgcggcaacgaaggtgatattgaatggtttgctacaaactctggattcatttgggatatcgctcccaagttcggtgccttgcttgttttccccgagcataggtattatggagagtctatgccttatggaagcagggaagaagcttacaagaacgctaccactttatcatatctcactactgagcaagctcttgctgattttgctgtttttgtcactgatttgaaacgcaacttgtctgcggaagcttgcccagttgtgttgtttggtggatcatatggtggaatgttagcagcatggatgaggctcaagtatcctcacattgcaataggagctttagcttcctcagctccaattcttcagtttgaagatgttgtacctcctgagacgttctatgacattgcatcaaatgatttcaagcgtgagagtagcagctgcttcaataccattaaggactcgtgggatgcaataatagcagagggtcagaaggaaaatggccttctgcagttgacgaaaacttttcacttttgccgggtgttgaacagtactgatgacctttcagactggctggactctgcctatagttatttggcaatggtggattatccgtatcctgctgacttcatgatgcctttgcctggacatcccattagagaggtctgcagaaaaattgacggtgctggtagtaatgctagcatcctagatcgcatatatgcagggataagtgtgtactacaactatactggaaatgttgactgcttcaagttggatgatgaccctcatgggttggatggatggaattggcaggcatgcacggagatggtaatgcccatgtctagcaaccaagaaaacagcatgtttccaggttatggttttaattactcttcatacaaagaggaatgctggaatacattccgagttaatccaagacccaaatgggtcacaacagagttcggtggacatgatatagcgaccaccttgaagtcatttggaagtaacatcattttctcaaatggtctgttagatccttggagtggtggcagtgttctcaagaacttatctgataccattgttgctctcgtcacaaaagaaggtgcacatcacttggatctacgaccttcaacaccagaagacccgaaatggcttgtggaccagcgggaagccgagatacggttgattcaaggatggatcgaaacttatcgagtagaaaaagaagctaaggtttctctgttaaaacgttcttggtaagagaacaatgaaaagaatcgtctcagtgtgtaactcggaatctgcaaactttgtattgcgaacacatgctttgaataaatccatgtaactatgtaaactctcaatgatcactaatcttttctac

SEQ ID NO: 2086 - protein, 1708 aa, Arabidopsis thaliana
  misc_feature: PFam Name: Peptidase_S28; PFam Description: Serine
  misc_feature: GI Number: 18700101; NR Description: AT5g65760/MPA24_11
  misc_feature: GI Number: 22655366; NR Description: At2g24280/F27D4.19 [Arabidopsis thaliana] >gi|16648801|gb|AAL25591.1| At2g24280/F27D4.19 [Arabidopsis thaliana] >gi|30682358|ref|NP_850050.1| serine carboxypeptidase S28 family
  misc_feature: GI Number: 2827710; NR Description: lysosomal Pro-X carboxypeptidase - like protein [Arabidopsis thaliana] >gi|7487949|pir||T05893 lysosomal Pro-X carboxypeptidase homolog
  misc_feature: GI Number: 10177334; NR Description: lysosomal Pro-X
  misc_feature: GI Number: 51535425; NR Description: putative prolylcarboxypeptidase isoform 1 [Oryza sativa (japonica
GTAACTGGAGAGAAAAAGCTATCAAAGTTAAAAGTTATGGCGAGCCATTTTTGCTTGCTTCTGATCTTCACTTTCTTCACTCTAGTGTTTCCGTCAAACGGATCTTCACTGTCTTCTTCCAAGCTTTTACCTCGTTTCCCTCGCTACACTTTCCAGAACCGAGAAGCCAGAATCCAGCAGTTCCGGGGAGATCGAAACGAGTATCGATACGAGACTAAGTTCTTCTCACAGCAGCTGGACCACTTCAGCTTCGCCGATCTTCCCAAATTCTCTCAACGCTACCTCATCAATTCCGATCACTGGCTTGGTGCTTCTGCGCTTGGACCTATCTTCCTTTACTGCGGCAACGAAGGTGATATTGAATGGTTTGCTACAAACTCTGGATTCATTTGGGATATCGCTCCCAAGTTCGGTGCCTTGCTTGTTTTCCCCGAGCATAGGTATTATGGAGAGTCTATGCCTTATGGAAGCAGGGAAGAAGCTTACAAGAACGCTACCACTTTATCATATCTCACTACTGAGCAAGCTCTTGCTGATTTTGCTGTTTTTGTCACTGATTTGAAACGCAACTTGTCTGCGGAAGCTTGCCCAGTTGTGTTGTTTGGTGGATCATATGGTGGAATGTTAGCAGCATGGATGAGGCTCAAGTATCCTCACATTGCAATAGGAGCTTTAGCTTCCTCAGCTCCAATTCTTCAGTTTGAAGATGTTGTACCTCCTGAGACGTTCTATGACATTGCATCAAATGATTTCAAGCGTGAGAGTAGCAGCTGCTTCAATACCATTAAGGACTCGTGGGATGCAATAATAGCAGAGGGTCAGAAGGAAAATGGCCTTCTGCAGTTGACGAAAACTTTTCACTTTTGCCGGGTGTTGAACAGTACTGATGACCTTTCAGACTGGCTGGACTCTGCCTATAGTTATTTGGCAATGGTGGATTATCCGTATCCTGCTGACTTCATGATGCCTTTGCCTGGACATCCCATTAGAGAGGTCTGCAGAAAAATTGACGGTGCTGGTAGTAATGCTAGCATCCTAGATCGCATATATGCAGGGATAAGTGTGTACTACAACTATACTGGAAATGTTGACTGCTTCAAGTTGGATGATGACCCTCATGGGTTGGATGGATGGAATTGGCAGGCATGCACGGAGATGGTAATGCCCATGTCTAGCAACCAAGAAAACAGCATGTTTCCAGGTTATGGTTTTAATTACTCTTCATACAAAGAGGAATGCTGGAATACATTCCGAGTTAATCCAAGACCCAAATGGGTCACAACAGAGTTCGGTGGACATGATATAGCGACCACCTTGAAGTCATTTGGAAGTAACATCATTTTCTCAAATGGTCTGTTAGATCCTTGGAGTGGTGGCAGTGTTCTCAAGAACTTATCTGATACCATTGTTGCTCTCGTCACAAAAGAAGGTGCACATCACTTGGATCTACGACCTTCAACACCAGAAGACCCGAAATGGCTTGTGGACCAGCGGGAAGCCGAGATACGGTTGATTCAAGGATGGATCGAAACTTATCGAGTAGAAAAAGAAGCTAAGGTTTCTCTGTTAAAACGTTCTTGGTAAGAGAACAATGAAAAGAATCGTCTCAGTGTGTAACTCGGAATCTGCAAACTTTGTATTGCGAACACATGCTTTGAATAAATCCATGTAACTATGTAAACTCTCAATGATCACTAATCTTTTCTAC

SEQ ID NO: 2087 - DNA, 1596 bp, Arabidopsis thaliana
  misc_feature (1)..(1596): Ceres cDNA ID no. 13487502
  misc_feature (1)..(1596): Ceres CLONE  ID no. 20959
  misc_feature (1)..(1596): Also known as  Ceres CDNA ID no. 23359459
aatgaaagaaactgttcaacaacttctgatttctaaaatctttttaaaatctctccgccacttctagttggacttgacttctcaccatagtctgtcccgttgttaccgaccatctattatatagggaaagtctcttagctacagagacacaataaccatttggagaggtcatgaactctaagaatcgcataaacaatgtcggggaaggtgttgatatcgaaatccctgacactgctcatcagattagcagcgattcatggtttcaggcagcgttcgttctgacaacaagtataaacagcgcatacgtgttgggatattcaggaacagtcatggttcctttaggatggattggtggtgtggttggtcttattcttgctactgcaatctcactctatgcaaacactctcgtagccaagcttcatgagtttggtggcaaaagacacattcgctatagagaccttgcgggattcatttacggtagaaaggcttattgtcttacatgggtgttgcaatatgtcaatcttttcatgattaattgtggtttcatcatactagctggttccgccttaaaggctgtttatgtgctttttagggatgatcatgccatgaagttacctcattttatagctattgcgggtctgatttgtgcggtttttgctattggaattcctcatttgtcggctcttgggatatggcttgcggtttcgactatcctcagcctgatctatatcgttgtggcaatcgtgctatcggttaaagatggagttaaagcaccttcaagagattacgagatacaaggatcaccactaagcaaactttttaccatcactggagcagccgctacactagttttcgtattcaacacagggatgcttccagaaattcaggcaacagtaaagcaaccagtagtaaaaaacatgatgaaggctctatactttcaattcacggtgggtgttttaccgatgtttgcggttgtattcatcgggtattgggcttacggatcctcgacctcgccctatctactaaacaacgttaatggtccactttgggttaaagcccttgctaacatctccgctatccttcaatccgttatctcgttgcacatttttgcaagtccaacatatgagtacatggacaccaagtttgggatcaaaggaaacccattggcattaaagaacttgttgtttaggatcatggcaagaggcgggtacatagcagttagtacgcttctctcagcactcttgccgttccttggggacttcatgagcctcactggtgcagtgagcacattcccccttacattcattctagccaaccacatgtactataaggctaagaacaataagctcaatactttgcaaaagctatgccattggctcaacgttgtcttcttcagtttgatgtctgttgctgccgccattgcagctcttaggctcatcgcccttgactccaaaaacttccacgtttttgcagatttgtaattcataatatatactcatcgtatttattcttagttggatttcttatcaataaaattaattttcaataaaacaatgtatatagaactatggttactaggggatggagatattatgc

SEQ ID NO: 2088 - protein, 1596 aa, Arabidopsis thaliana
  misc_feature: PFam Name: Aa_trans; PFam Description: Transmembrane amino
  misc_feature: GI Number: 31376371; NR Description: At3g55740 [Arabidopsis thaliana] >gi|7263562|emb|CAB81599.1| proline transporter 2 [Arabidopsis thaliana] >gi|1769903|emb|CAA65053.1| proline transporter 2 [Arabidopsis thaliana] >gi|19698891|gb|AAL91181.1|
  misc_feature: GI Number: 21069018; NR Description: betaine/proline
  misc_feature: GI Number: 21069020; NR Description: betaine/proline
  misc_feature: GI Number: 21593453; NR Description: proline transporter 1
  misc_feature: GI Number: 42572697; NR Description: proline transporter 2
AATGAAAGAAACTGTTCAACAACTTCTGATTTCTAAAATCTTTTTAAAATCTCTCCGCCACTTCTAGTTGGACTTGACTTCTCACCATAGTCTGTCCCGTTGTTACCGACCATCTATTATATAGGGAAAGTCTCTTAGCTACAGAGACACAATAACCATTTGGAGAGGTCATGAACTCTAAGAATCGCATAAACAATGTCGGGGAAGGTGTTGATATCGAAATCCCTGACACTGCTCATCAGATTAGCAGCGATTCATGGTTTCAGGCAGCGTTCGTTCTGACAACAAGTATAAACAGCGCATACGTGTTGGGATATTCAGGAACAGTCATGGTTCCTTTAGGATGGATTGGTGGTGTGGTTGGTCTTATTCTTGCTACTGCAATCTCACTCTATGCAAACACTCTCGTAGCCAAGCTTCATGAGTTTGGTGGCAAAAGACACATTCGCTATAGAGACCTTGCGGGATTCATTTACGGTAGAAAGGCTTATTGTCTTACATGGGTGTTGCAATATGTCAATCTTTTCATGATTAATTGTGGTTTCATCATACTAGCTGGTTCCGCCTTAAAGGCTGTTTATGTGCTTTTTAGGGATGATCATGCCATGAAGTTACCTCATTTTATAGCTATTGCGGGTCTGATTTGTGCGGTTTTTGCTATTGGAATTCCTCATTTGTCGGCTCTTGGGATATGGCTTGCGGTTTCGACTATCCTCAGCCTGATCTATATCGTTGTGGCAATCGTGCTATCGGTTAAAGATGGAGTTAAAGCACCTTCAAGAGATTACGAGATACAAGGATCACCACTAAGCAAACTTTTTACCATCACTGGAGCAGCCGCTACACTAGTTTTCGTATTCAACACAGGGATGCTTCCAGAAATTCAGGCAACAGTAAAGCAACCAGTAGTAAAAAACATGATGAAGGCTCTATACTTTCAATTCACGGTGGGTGTTTTACCGATGTTTGCGGTTGTATTCATCGGGTATTGGGCTTACGGATCCTCGACCTCGCCCTATCTACTAAACAACGTTAATGGTCCACTTTGGGTTAAAGCCCTTGCTAACATCTCCGCTATCCTTCAATCCGTTATCTCGTTGCACATTTTTGCAAGTCCAACATATGAGTACATGGACACCAAGTTTGGGATCAAAGGAAACCCATTGGCATTAAAGAACTTGTTGTTTAGGATCATGGCAAGAGGCGGGTACATAGCAGTTAGTACGCTTCTCTCAGCACTCTTGCCGTTCCTTGGGGACTTCATGAGCCTCACTGGTGCAGTGAGCACATTCCCCCTTACATTCATTCTAGCCAACCACATGTACTATAAGGCTAAGAACAATAAGCTCAATACTTTGCAAAAGCTATGCCATTGGCTCAACGTTGTCTTCTTCAGTTTGATGTCTGTTGCTGCCGCCATTGCAGCTCTTAGGCTCATCGCCCTTGACTCCAAAAACTTCCACGTTTTTGCAGATTTGTAATTCATAATATATACTCATCGTATTTATTCTTAGTTGGATTTCTTATCAATAAAATTAATTTTCAATAAAACAATGTATATAGAACTATGGTTACTAGGGGATGGAGATATTATGC

SEQ ID NO: 2089 - DNA, 1494 bp, Arabidopsis thaliana
  misc_feature (1)..(1494): Ceres cDNA ID no. 13487724
  misc_feature (1)..(1494): Ceres CLONE  ID no. 36844
  misc_feature (1)..(1494): Also known as  Ceres CDNA ID no. 23359941
gtgaaaaattaattattgcccactttctctctctctctctctctgattgattcttgaaaagaaaatcaaagtctcaatagctttgttttgattctagttccattccacaattgcatctaattctcctaccgtagccttttcttctttatttgtcatcaacaactcctaaaattcatatgaaattagagaaatcgaaacgaaaagataatatttttcaagaaagagctacatatacaccttttgaccttgtaaagttggaaccctagaggcctttcaagcaaatcatcagggtaacaatttcttgatctttctttttagcgaatttccagtttttggtcaatcatggcaaacccttggtggacgaaccagagtggtttagcgggcatggtggaccattcggtctcctcaggccatcaccaaaaccatcaccaccaaagtcttcttaccaaaggagatcttggaatagccatgaatcagagccaagacaacgaccaagacgaagaagatgatcctagagaaggagccgttgaggtggtcaaccgtagaccaagaggtagaccaccaggatccaaaaacaaacccaaagctccaatctttgtgacaagagacagccccaacgcactccgtagccatgtcttggagatctccgacggcagtgacgtcgccgacacaatcgctcacttctcaagacgcaggcaacgcggcgtttgcgttctcagcgggacaggctcagtcgctaacgtcaccctccgccaagccgccgcaccaggaggtgtggtctctctccaaggcaggtttgaaatcttatctttaaccggtgctttcctccctggaccttccccacccgggtcaaccggtttaacggtttacttagccggggtccagggtcaggtcgttggaggtagcgttgtaggcccactcttagccatagggtcggtcatggtgattgctgctactttctctaacgctacttatgagagattgcccatggaagaagaggaagacggtggcggctcaagacagattcacggaggcggtgactcaccgcccagaatcggtagtaacctgcctgatctatcagggatggccgggccaggctacaatatgccgccgcatctgattccaaatggggctggtcagctagggcacgaaccatatacatgggtccacgcaagaccaccttactgactcagtgagccatttctatatataatggtctatataaataaatatatagatgaatataagcaagcaatttgaggtagtctattacaaagcttttgctctggttggaaaaataaataagtatcaaagctttgtttgttcttaatggaaatatagagcttgggaaggtagaaagagacgacattaagggactttcagattttcagtattactactccacgaaattattgaaataaataaacattgtactgtaaattagaatgtttgtctttttgtttttgtgtagtagtatttaactacaatatttgc

SEQ ID NO: 2090 - protein, 1494 aa, Arabidopsis thaliana
  misc_feature: GI Number: 21593180; NR Description: putative DNA-binding
  misc_feature: GI Number: 50915952; NR Description: DNA-binding protein-like [Oryza sativa (japonica cultivar-group)] >gi|48716263|dbj|BAD22878.1| DNA-binding protein-like [Oryza sativa (japonica cultivar-group)] >gi|48716505|dbj|BAD23110.1|
  misc_feature: GI Number: 50948561; NR Description: putative SAP1 protein [Oryza sativa (japonica cultivar-group)] >gi|42408442|dbj|BAD09624.1| putative SAP1 protein [Oryza sativa
  misc_feature: GI Number: 32815961; NR Description: At4g12050 [Arabidopsis thaliana] >gi|4586110|emb|CAB40946.1| putative DNA-binding protein [Arabidopsis thaliana] >gi|7267906|emb|CAB78248.1| putative DNA-binding protein [Arabidopsis thaliana]
  misc_feature: GI Number: 7269128; NR Description: putative DNA binding protein [Arabidopsis thaliana] >gi|2827558|emb|CAA16566.1| putative DNA binding protein [Arabidopsis thaliana] >gi|15235815|ref|NP_194012.1| DNA-binding protein-related
GTGAAAAATTAATTATTGCCCACTTTCTCTCTCTCTCTCTCTCTGATTGATTCTTGAAAAGAAAATCAAAGTCTCAATAGCTTTGTTTTGATTCTAGTTCCATTCCACAATTGCATCTAATTCTCCTACCGTAGCCTTTTCTTCTTTATTTGTCATCAACAACTCCTAAAATTCATATGAAATTAGAGAAATCGAAACGAAAAGATAATATTTTTCAAGAAAGAGCTACATATACACCTTTTGACCTTGTAAAGTTGGAACCCTAGAGGCCTTTCAAGCAAATCATCAGGGTAACAATTTCTTGATCTTTCTTTTTAGCGAATTTCCAGTTTTTGGTCAATCATGGCAAACCCTTGGTGGACGAACCAGAGTGGTTTAGCGGGCATGGTGGACCATTCGGTCTCCTCAGGCCATCACCAAAACCATCACCACCAAAGTCTTCTTACCAAAGGAGATCTTGGAATAGCCATGAATCAGAGCCAAGACAACGACCAAGACGAAGAAGATGATCCTAGAGAAGGAGCCGTTGAGGTGGTCAACCGTAGACCAAGAGGTAGACCACCAGGATCCAAAAACAAACCCAAAGCTCCAATCTTTGTGACAAGAGACAGCCCCAACGCACTCCGTAGCCATGTCTTGGAGATCTCCGACGGCAGTGACGTCGCCGACACAATCGCTCACTTCTCAAGACGCAGGCAACGCGGCGTTTGCGTTCTCAGCGGGACAGGCTCAGTCGCTAACGTCACCCTCCGCCAAGCCGCCGCACCAGGAGGTGTGGTCTCTCTCCAAGGCAGGTTTGAAATCTTATCTTTAACCGGTGCTTTCCTCCCTGGACCTTCCCCACCCGGGTCAACCGGTTTAACGGTTTACTTAGCCGGGGTCCAGGGTCAGGTCGTTGGAGGTAGCGTTGTAGGCCCACTCTTAGCCATAGGGTCGGTCATGGTGATTGCTGCTACTTTCTCTAACGCTACTTATGAGAGATTGCCCATGGAAGAAGAGGAAGACGGTGGCGGCTCAAGACAGATTCACGGAGGCGGTGACTCACCGCCCAGAATCGGTAGTAACCTGCCTGATCTATCAGGGATGGCCGGGCCAGGCTACAATATGCCGCCGCATCTGATTCCAAATGGGGCTGGTCAGCTAGGGCACGAACCATATACATGGGTCCACGCAAGACCACCTTACTGACTCAGTGAGCCATTTCTATATATAATGGTCTATATAAATAAATATATAGATGAATATAAGCAAGCAATTTGAGGTAGTCTATTACAAAGCTTTTGCTCTGGTTGGAAAAATAAATAAGTATCAAAGCTTTGTTTGTTCTTAATGGAAATATAGAGCTTGGGAAGGTAGAAAGAGACGACATTAAGGGACTTTCAGATTTTCAGTATTACTACTCCACGAAATTATTGAAATAAATAAACATTGTACTGTAAATTAGAATGTTTGTCTTTTTGTTTTTGTGTAGTAGTATTTAACTACAATATTTGC

SEQ ID NO: 2091 - DNA, 1187 bp, Arabidopsis thaliana
  misc_feature (1)..(1187): Ceres cDNA ID no. 13487935
  misc_feature (1)..(1187): Ceres CLONE  ID no. 38372
  misc_feature (1)..(1187): Also known as  Ceres CDNA ID no. 23360543
aaattcaagtagaaacaatggagaagccaaagttcaagactgtccaagaggtggttgcagctggcgaaggactgccggagagatatctccacgcacccaccggagacggcgaagttcaacctcttaacgcagcggtaccggagatggatattccggccatcgatctgaatcttctcctctcttcttctgaagctggtcaacaagagctgagtaaacttcactcggcactctctacatggggcgttgttcaggtgatgaatcatggaattacaaaagcgtttcttgacaagatttacaagctaaccaaggagttctttgcgcttccgaccgaagagaaacagaagtgcgcgagagagattgatagtatccaaggatatggtaacgacatgattctttgggatgatcaagttcttgattggatcgaccgtttgtatattactacttaccctgaagatcaaagacaacttaatttctggcctgaagtcccacttggattcagggaaactttacatgaatacacaatgaagcaacggatagtgattgagcaattttttaaggccatggctagatctttggaattagaagagaatagttttctagacatgtatggagaaagtgctacgttggatactagattcaacatgtatccaccatgtccgagcccggacaaggttattggtgttaaaccgcacgctgatggctcggctatcactcttctcttacccgacaaagatgtcggagggcttcagttccagaaagatgggaagtggtataaagctcctatagtccctgatacaattttgatcaatgttggtgatcaaatggagataatgagcaatgggatatacaagagcccggttcatagagtggtgactaacagagaaaaggaaagaatatctgtggcaactttttgcattccaggtgcagataaagagattcagcctgtgaatgagcttgtgtctgaggcaagaccaagattatataaaacagttaagaagtatgtggagctctacttcaagtactatcaacaaggccgaagacctattgaagctgcattgatctgatcacacttttcaagtctcatttattggtttcacaaatgaatctgtttctttcgttacttgagatcctttataagaataaaactgtttccttgtttgttggaatgtgaggctgcattgtgttgc

SEQ ID NO: 2092 - protein, 1187 aa, Arabidopsis thaliana
  misc_feature: PFam Name: 2OG-FeII_Oxy; PFam Description: 2OG-Fe(II)
  misc_feature: GI Number: 5430761; NR Description: Similar to ethylene-forming-enzyme-like dioxygenase [Arabidopsis thaliana] >gi|15222131|ref|NP_175364.1| oxidoreductase, 2OG-Fe(II) oxygenase
  misc_feature: GI Number: 10177262; NR Description: ethylene-forming-enzyme-like dioxygenase [Arabidopsis thaliana] >gi|15239524|ref|NP_200211.1| oxidoreductase, 2OG-Fe(II) oxygenase
  misc_feature: GI Number: 21537316; NR Description: ethylene-forming-enzyme-like dioxygenase-like [Arabidopsis thaliana] >gi|15241383|ref|NP_197555.1| oxidoreductase, 2OG-Fe(II)
  misc_feature: GI Number: 21593366; NR Description: ethylene-forming-enzyme-like dioxygenase-like protein [Arabidopsis
  misc_feature: GI Number: 28827734; NR Description: putative ethylene-forming dioxygenase [Arabidopsis thaliana] >gi|27754538|gb|AAO22716.1| putative ethylene-forming dioxygenase
AAATTCAAGTAGAAACAATGGAGAAGCCAAAGTTCAAGACTGTCCAAGAGGTGGTTGCAGCTGGCGAAGGACTGCCGGAGAGATATCTCCACGCACCCACCGGAGACGGCGAAGTTCAACCTCTTAACGCAGCGGTACCGGAGATGGATATTCCGGCCATCGATCTGAATCTTCTCCTCTCTTCTTCTGAAGCTGGTCAACAAGAGCTGAGTAAACTTCACTCGGCACTCTCTACATGGGGCGTTGTTCAGGTGATGAATCATGGAATTACAAAAGCGTTTCTTGACAAGATTTACAAGCTAACCAAGGAGTTCTTTGCGCTTCCGACCGAAGAGAAACAGAAGTGCGCGAGAGAGATTGATAGTATCCAAGGATATGGTAACGACATGATTCTTTGGGATGATCAAGTTCTTGATTGGATCGACCGTTTGTATATTACTACTTACCCTGAAGATCAAAGACAACTTAATTTCTGGCCTGAAGTCCCACTTGGATTCAGGGAAACTTTACATGAATACACAATGAAGCAACGGATAGTGATTGAGCAATTTTTTAAGGCCATGGCTAGATCTTTGGAATTAGAAGAGAATAGTTTTCTAGACATGTATGGAGAAAGTGCTACGTTGGATACTAGATTCAACATGTATCCACCATGTCCGAGCCCGGACAAGGTTATTGGTGTTAAACCGCACGCTGATGGCTCGGCTATCACTCTTCTCTTACCCGACAAAGATGTCGGAGGGCTTCAGTTCCAGAAAGATGGGAAGTGGTATAAAGCTCCTATAGTCCCTGATACAATTTTGATCAATGTTGGTGATCAAATGGAGATAATGAGCAATGGGATATACAAGAGCCCGGTTCATAGAGTGGTGACTAACAGAGAAAAGGAAAGAATATCTGTGGCAACTTTTTGCATTCCAGGTGCAGATAAAGAGATTCAGCCTGTGAATGAGCTTGTGTCTGAGGCAAGACCAAGATTATATAAAACAGTTAAGAAGTATGTGGAGCTCTACTTCAAGTACTATCAACAAGGCCGAAGACCTATTGAAGCTGCATTGATCTGATCACACTTTTCAAGTCTCATTTATTGGTTTCACAAATGAATCTGTTTCTTTCGTTACTTGAGATCCTTTATAAGAATAAAACTGTTTCCTTGTTTGTTGGAATGTGAGGCTGCATTGTGTTGC

SEQ ID NO: 2093 - DNA, 1492 bp, Arabidopsis thaliana
  misc_feature (1)..(1492): Ceres cDNA ID no. 13487939
  misc_feature (1)..(1492): Ceres CLONE  ID no. 38439
  misc_feature (1)..(1492): Also known as  Ceres CDNA ID no. 23360551
ccacgcgtccgccgctcttctccactcttcttctctgttctatcgcagacatttttgtttatatgcatacataataataatacactcttgtcaggatttttgattctctctttggttttctcggaaaaatgtctgcgatactccaaggagctggagctgcaacggctctctcgccgtttaattctatcgattccaacaaactcgttgctccttctcgctcttctctttcagtgaggagcaagagatacattgttgccggatctgatagtaaaagctttggttctagcctcgtagctcgtcgctctgagccgttgataccaaatgctgttacgacgaaggcggacactgctgcgagctctacttcatcaaagcctggacatgagctattacttttcgaggctcttcaagaaggtctagaagaagagatggacagagatccacatgtatgtgtcatgggtgaagatgtaggccattacggaggctcatacaaagtaactaaaggcctagctgataagtttggcgatctcagggttctggacactccaatctgtgaaaacgccttcaccggtatgggcattggagccgccatgacaggactaagacccgtcatcgaaggtatgaacatggggtttctactcttagccttcaaccaaatctccaacaactgtggtatgcttcactatacatccggtggtcaattcactatcccggttgttatccgtgggcctggaggtgtgggccggcagctcggagccgagcattcccagcgtctcgagtcttacttccagtcaatccctgggatccagatggtggcttgctcaacaccttacaacgctaaaggattgatgaaagcggcgataagaagtgagaatcctgtgattctgtttgaacacgttctgctctataacctcaaggagagtattccggatgaagaatacatatgtaatctggaagaagcagaaatggtcagacccggtgaacacatcacgatactgacgtattcaaggatgaggtaccatgtaatgcaggctgcaaagacgctggtgaacaaagggtatgatccagaggttatcgacataaggtcgttgaagccgtttgatctctacacaattggaaactcggtgaagaagacacaccgggttttgattgtggaggaatgtatgagaacgggaggaatcggagccagtttgacggctgcaataaacgagaactttcatgattacttagatgctccggtgatgtgtttgtcttctcaggatgtcccaactccttacgccggtacattggaagaatggacggttgttcagccagctcagatcgtcactgccgtcgaacaactttgccagtaattgctttttttacggtgattgtgttttacccttttttactttttgttactgtttgtcttcgatggaaaatgcttgtgaaatgaaaactctgaattttactcttatgatatgagcatttatattttctatagataataacttcc

SEQ ID NO: 2094 - protein, 1492 aa, Arabidopsis thaliana
  misc_feature: PFam Name: Transket_pyr; PFam Description: Transketolase,
  misc_feature: PFam Name: Transketolase_C; PFam Description: Transketolase,
  misc_feature: GI Number: 20334776; NR Description: At1g30120/T2H7_8 [Arabidopsis thaliana] >gi|13605515|gb|AAK32751.1| At1g30120/T2H7_8 [Arabidopsis thaliana] >gi|12321636|gb|AAG50862.1| pyruvate dehydrogenase E1 beta
  misc_feature: GI Number: 22416925; NR Description: beta subunit of pyruvate dehydrogenase E1 component [Chaetosphaeridium globosum] >gi|22711921|ref|NP_683783.1| pyruvate dehydrogenase E1 component
  misc_feature: GI Number: 21593379; NR Description: putative pyruvate
  misc_feature: GI Number: 3128205; NR Description: putative pyruvate dehydrogenase E1 beta subunit [Arabidopsis thaliana] >gi|5702375|gb|AAD47282.1| putative pyruvate dehydrogenase beta subunit [Arabidopsis thaliana] >gi|15226781|ref|NP_181006.1|
  misc_feature: GI Number: 2454184; NR Description: pyruvate dehydrogenase E1 beta subunit [Arabidopsis thaliana] >gi|21593321|gb|AAM65270.1| pyruvate dehydrogenase E1 beta subunit, putative [Arabidopsis
CCACGCGTCCGCCGCTCTTCTCCACTCTTCTTCTCTGTTCTATCGCAGACATTTTTGTTTATATGCATACATAATAATAATACACTCTTGTCAGGATTTTTGATTCTCTCTTTGGTTTTCTCGGAAAAATGTCTGCGATACTCCAAGGAGCTGGAGCTGCAACGGCTCTCTCGCCGTTTAATTCTATCGATTCCAACAAACTCGTTGCTCCTTCTCGCTCTTCTCTTTCAGTGAGGAGCAAGAGATACATTGTTGCCGGATCTGATAGTAAAAGCTTTGGTTCTAGCCTCGTAGCTCGTCGCTCTGAGCCGTTGATACCAAATGCTGTTACGACGAAGGCGGACACTGCTGCGAGCTCTACTTCATCAAAGCCTGGACATGAGCTATTACTTTTCGAGGCTCTTCAAGAAGGTCTAGAAGAAGAGATGGACAGAGATCCACATGTATGTGTCATGGGTGAAGATGTAGGCCATTACGGAGGCTCATACAAAGTAACTAAAGGCCTAGCTGATAAGTTTGGCGATCTCAGGGTTCTGGACACTCCAATCTGTGAAAACGCCTTCACCGGTATGGGCATTGGAGCCGCCATGACAGGACTAAGACCCGTCATCGAAGGTATGAACATGGGGTTTCTACTCTTAGCCTTCAACCAAATCTCCAACAACTGTGGTATGCTTCACTATACATCCGGTGGTCAATTCACTATCCCGGTTGTTATCCGTGGGCCTGGAGGTGTGGGCCGGCAGCTCGGAGCCGAGCATTCCCAGCGTCTCGAGTCTTACTTCCAGTCAATCCCTGGGATCCAGATGGTGGCTTGCTCAACACCTTACAACGCTAAAGGATTGATGAAAGCGGCGATAAGAAGTGAGAATCCTGTGATTCTGTTTGAACACGTTCTGCTCTATAACCTCAAGGAGAGTATTCCGGATGAAGAATACATATGTAATCTGGAAGAAGCAGAAATGGTCAGACCCGGTGAACACATCACGATACTGACGTATTCAAGGATGAGGTACCATGTAATGCAGGCTGCAAAGACGCTGGTGAACAAAGGGTATGATCCAGAGGTTATCGACATAAGGTCGTTGAAGCCGTTTGATCTCTACACAATTGGAAACTCGGTGAAGAAGACACACCGGGTTTTGATTGTGGAGGAATGTATGAGAACGGGAGGAATCGGAGCCAGTTTGACGGCTGCAATAAACGAGAACTTTCATGATTACTTAGATGCTCCGGTGATGTGTTTGTCTTCTCAGGATGTCCCAACTCCTTACGCCGGTACATTGGAAGAATGGACGGTTGTTCAGCCAGCTCAGATCGTCACTGCCGTCGAACAACTTTGCCAGTAATTGCTTTTTTTACGGTGATTGTGTTTTACCCTTTTTTACTTTTTGTTACTGTTTGTCTTCGATGGAAAATGCTTGTGAAATGAAAACTCTGAATTTTACTCTTATGATATGAGCATTTATATTTTCTATAGATAATAACTTCC

SEQ ID NO: 2095 - DNA, 1179 bp, Arabidopsis thaliana
  misc_feature (1)..(1179): Ceres cDNA ID no. 13487998
  misc_feature (1)..(1179): Ceres CLONE  ID no. 99738
  misc_feature (1)..(1179): Also known as  Ceres CDNA ID no. 23360727
atggatcagaaaagtgattcatttctctctgtttcatcgatttcattttcatattcttcttcaacagacaaagactttgatctgatatgcatgattagtcccatcgtacttctctacatcactctcctctccatcatcttctttgtagctgctttgattcaccttctggtcaaattcttacatagaccccaaactcgacttgacgacgcctatgatggcattacagagagttctactgctctgcaaggtcggtatcaaacacggtttaatctccatgacgcagaaattgaccaatcattcattgatgcattgcccttgttacattacaagaccatgattggtcttcgacacgacctctctgattgcgccgtttgtctcagagagttcacagccgaagacgagctccggctcttaccaaaatgcagccatgcattccatgtggagtgcatcgacacgtggctcctcacaaactcaacatgtcctctctgcagggacaacctcctcctccttggcctcactggcactgcttcgtcttccactattgtccttgtgcatgaatctgatggtgacaattcccaagactccgattcgtcgttcatgttaaccgatcttgatgatcttggagtgcaagaagtgatgaagatggtgaagtgtaagaaggttaggcaccgcggtcgcaaaggacaaaaggagaaacccaagtttcgagaaacttgtatgcaaagaaacctcgggatccttcgcaggattgtaccaggctgtgaagagatcgaagacgaggaagccttgtttctcaagtcaattcagcatctcttgcttctcaaatctcaggttaatttacttaaaaagctagctgatgtatgtggagtctaattaaaagaacgtaagttctcaagttgtttatgcattacattataagatcaagcgagagagacataagaaaacagaggaggggataaagtaaaattacacagagaaaaacgatgaacaaggcgatgaatttttttagtttttgttgtagaaagtgagagcgtaatttgtacttaaggaggaagaagagagagtgagcatgtgttggatcgttgtgacccatgtcttgtaacgattgtaatcgtcggccatgtctaacttgatagctcctctgttcgtcctcaggacaatgagataacaagtgtcctc

SEQ ID NO: 2096 - protein, 1179 aa, Arabidopsis thaliana
ATGGATCAGAAAAGTGATTCATTTCTCTCTGTTTCATCGATTTCATTTTCATATTCTTCTTCAACAGACAAAGACTTTGATCTGATATGCATGATTAGTCCCATCGTACTTCTCTACATCACTCTCCTCTCCATCATCTTCTTTGTAGCTGCTTTGATTCACCTTCTGGTCAAATTCTTACATAGACCCCAAACTCGACTTGACGACGCCTATGATGGCATTACAGAGAGTTCTACTGCTCTGCAAGGTCGGTATCAAACACGGTTTAATCTCCATGACGCAGAAATTGACCAATCATTCATTGATGCATTGCCCTTGTTACATTACAAGACCATGATTGGTCTTCGACACGACCTCTCTGATTGCGCCGTTTGTCTCAGAGAGTTCACAGCCGAAGACGAGCTCCGGCTCTTACCAAAATGCAGCCATGCATTCCATGTGGAGTGCATCGACACGTGGCTCCTCACAAACTCAACATGTCCTCTCTGCAGGGACAACCTCCTCCTCCTTGGCCTCACTGGCACTGCTTCGTCTTCCACTATTGTCCTTGTGCATGAATCTGATGGTGACAATTCCCAAGACTCCGATTCGTCGTTCATGTTAACCGATCTTGATGATCTTGGAGTGCAAGAAGTGATGAAGATGGTGAAGTGTAAGAAGGTTAGGCACCGCGGTCGCAAAGGACAAAAGGAGAAACCCAAGTTTCGAGAAACTTGTATGCAAAGAAACCTCGGGATCCTTCGCAGGATTGTACCAGGCTGTGAAGAGATCGAAGACGAGGAAGCCTTGTTTCTCAAGTCAATTCAGCATCTCTTGCTTCTCAAATCTCAGGTTAATTTACTTAAAAAGCTAGCTGATGTATGTGGAGTCTAATTAAAAGAACGTAAGTTCTCAAGTTGTTTATGCATTACATTATAAGATCAAGCGAGAGAGACATAAGAAAACAGAGGAGGGGATAAAGTAAAATTACACAGAGAAAAACGATGAACAAGGCGATGAATTTTTTTAGTTTTTGTTGTAGAAAGTGAGAGCGTAATTTGTACTTAAGGAGGAAGAAGAGAGAGTGAGCATGTGTTGGATCGTTGTGACCCATGTCTTGTAACGATTGTAATCGTCGGCCATGTCTAACTTGATAGCTCCTCTGTTCGTCCTCAGGACAATGAGATAACAAGTGTCCTC

SEQ ID NO: 2097 - DNA, 1413 bp, Arabidopsis thaliana
  misc_feature (1)..(1413): Ceres cDNA ID no. 13488037
  misc_feature (1)..(1413): Ceres CLONE  ID no. 122670
  misc_feature (1)..(1413): Also known as  Ceres CDNA ID no. 23360898
attttcctattcttgaaaacacacaacacatctcatttctccgctgtttcgtcggcaaattttcccatttttgattccgaagataatagatattatcaacagaggataaggataaaacccagaacaatcattataatttagtggtgaagttgaccaaatttataaactgatccaattttaaaatctaagagatatggagaacatggacgatttctcaccggagaatgttttagcaccaccaccaccacctcctccaatgaagaagtcaacggatctgtttatgcaaagaagcaatagctttgtttctaaagctacgagagattcatgggatcgtatgttcgacgaagctcatggagctgatgttttgattcatactgatgataatggtttgatttacgcacattctaatgtcatcggaatggcttcagatgtaatcagaggaatgatgaagcaacataagagaaaatctcatcgtaaatcgatttcaatcctcggtgttcctcaccacgctcttcgagttttcattcgattcttatactcttcttgctatgagaaacaagatatggaggattttgcaatacatctacttgtgttatcacatgtctacgttgtaccgcatttgaagcgagtctgcgaatcagaattcgaaagtagtttgctcaacaaagagaatgtgattgatgtgtttcagctagctcttctatgtgatgctcctcgtctcggtcttctctgtcatagaatgattctaaacaactttgaagaagtttctacttctgaaggatggcaaacaatgaaagagagccatcctagacttcaaaaagagcttttacgctctgtcgcttacgagcttaatagcttgaagcaaagaaacaggaaacagaaggagatacagacttatacacagctctatgaagcaatggaggcttttgttcatatatgtagagatggatgcagagaaataggtccaacaaagaccgaaaccccgcatatgtcatgcggatttcaagcgtgtaatggtttagagcagctattgaaacatttggcgggatgcaaactaagatcaatccctggtggttgtagccgttgcaagagaatgtggcagcttcttgagcttcattcgcgcatttgcgtagactcggaacaatgcaaagtccctctttgcagtagtttgaaagagaggatgaagacacagagcaggaaagatgagaaaagatggaaacttttggtgaggaatgttttgagcaccaagagaattggaggatctccattctttttgcaagcaattgatgttactttatgagttatgacattattatttgattgcttttagatgtagaaattacatatttatacatgtacataggttgcagattctttgtaaagatagattcaaaattttcaaacctaagatcc

SEQ ID NO: 2098 - protein, 1413 aa, Arabidopsis thaliana
  misc_feature: PFam Name: BTB; PFam Description: BTB/POZ domain
  misc_feature: PFam Name: zf-TAZ; PFam Description: TAZ zinc finger
  misc_feature: GI Number: 36955924; NR Description: BTB and TAZ domain protein 5 [Arabidopsis thaliana] >gi|18420081|ref|NP_568031.1| TAZ zinc finger family protein / BTB/POZ domain-containing protein
  misc_feature: GI Number: 21537174; NR Description: unknown [Arabidopsis thaliana]
  misc_feature: GI Number: 42573822; NR Description: TAZ zinc finger family
  misc_feature: GI Number: 57899800; NR Description: putative BTB and TAZ
  misc_feature: GI Number: 42561724; NR Description: TAZ zinc finger family
ATTTTCCTATTCTTGAAAACACACAACACATCTCATTTCTCCGCTGTTTCGTCGGCAAATTTTCCCATTTTTGATTCCGAAGATAATAGATATTATCAACAGAGGATAAGGATAAAACCCAGAACAATCATTATAATTTAGTGGTGAAGTTGACCAAATTTATAAACTGATCCAATTTTAAAATCTAAGAGATATGGAGAACATGGACGATTTCTCACCGGAGAATGTTTTAGCACCACCACCACCACCTCCTCCAATGAAGAAGTCAACGGATCTGTTTATGCAAAGAAGCAATAGCTTTGTTTCTAAAGCTACGAGAGATTCATGGGATCGTATGTTCGACGAAGCTCATGGAGCTGATGTTTTGATTCATACTGATGATAATGGTTTGATTTACGCACATTCTAATGTCATCGGAATGGCTTCAGATGTAATCAGAGGAATGATGAAGCAACATAAGAGAAAATCTCATCGTAAATCGATTTCAATCCTCGGTGTTCCTCACCACGCTCTTCGAGTTTTCATTCGATTCTTATACTCTTCTTGCTATGAGAAACAAGATATGGAGGATTTTGCAATACATCTACTTGTGTTATCACATGTCTACGTTGTACCGCATTTGAAGCGAGTCTGCGAATCAGAATTCGAAAGTAGTTTGCTCAACAAAGAGAATGTGATTGATGTGTTTCAGCTAGCTCTTCTATGTGATGCTCCTCGTCTCGGTCTTCTCTGTCATAGAATGATTCTAAACAACTTTGAAGAAGTTTCTACTTCTGAAGGATGGCAAACAATGAAAGAGAGCCATCCTAGACTTCAAAAAGAGCTTTTACGCTCTGTCGCTTACGAGCTTAATAGCTTGAAGCAAAGAAACAGGAAACAGAAGGAGATACAGACTTATACACAGCTCTATGAAGCAATGGAGGCTTTTGTTCATATATGTAGAGATGGATGCAGAGAAATAGGTCCAACAAAGACCGAAACCCCGCATATGTCATGCGGATTTCAAGCGTGTAATGGTTTAGAGCAGCTATTGAAACATTTGGCGGGATGCAAACTAAGATCAATCCCTGGTGGTTGTAGCCGTTGCAAGAGAATGTGGCAGCTTCTTGAGCTTCATTCGCGCATTTGCGTAGACTCGGAACAATGCAAAGTCCCTCTTTGCAGTAGTTTGAAAGAGAGGATGAAGACACAGAGCAGGAAAGATGAGAAAAGATGGAAACTTTTGGTGAGGAATGTTTTGAGCACCAAGAGAATTGGAGGATCTCCATTCTTTTTGCAAGCAATTGATGTTACTTTATGAGTTATGACATTATTATTTGATTGCTTTTAGATGTAGAAATTACATATTTATACATGTACATAGGTTGCAGATTCTTTGTAAAGATAGATTCAAAATTTTCAAACCTAAGATCC

SEQ ID NO: 2099 - DNA, 1595 bp, Arabidopsis thaliana
  misc_feature (1)..(1595): Ceres cDNA ID no. 13488227
  misc_feature (1)..(1595): Ceres CLONE  ID no. 36461
  misc_feature (1)..(1595): Also known as  Ceres CDNA ID no. 23361482
attatttgatttggaatcacaagaaagtggtggttctcctttatttatgtcaccagccccctccacggatccacaaccaatctccggcgaaaaaaacggcggcgatggtggtaggattccggtagaagagtggctgccgatcacagaatcaagaaaaggaaatgtttatacggcgacgtttcatcttctctgttcgggaattggtctccaagtgattcttcttcctgcagctttcgcagcactcggatgggtatggggaacgataatcttaacggtagggtttgtatggaagctctacacgacgtggcttcttgttcaactccacgaagcggttccgggaattcgtatcagcagatacgtgagactcgcaattgcttcttttggtgtgaagcttgggaaacttctcggaatattccctgtgatgtatctctcaggaggagcttgtacgattctggttataaccggagggaaatcaatacaacaactgttacaaattatgtctgacgacaatacagcgccacttacttcagtgcaatgcttcttggtttttagttgcattgcgatgatcatgtctcagtttccgaatctaaattctctctttggagtctcgttgatcggtgcttttatgggaattgcgtattgcaccgtgatatggattttacctgtagctagtgactcacaaaggactcaagtcagtgtctcgtacgctacaatggataaaagtttcgttcacattttcaacgctattggattgatagctctagtatatcgcgggaacaatctcgtccttgagatacagggtactcttccttccgattcaaagaacccttcatgtaagacaatgtggagagcagtgatgatctctcatgctctcgtcgcgatttgtatgtttccattaacgtttgctgtatattgggcatacggagacaagattccggcgacgggaggtcccgtgggcaactatctgaaactttacacacaagagcactcgaagcgagcagcctgtttcatacacctcacgtttatcttctcttgcttatgttcatatccgataaacttaatgccggcgtgtgacaacatagagatggtgtacataaccaagaagaaaaagcctgcatccatcattgtccggatgatgttgcgtgtgtttttgagcttggtttgtttcactatagccgttggattcccgttcttgccttatctagcggttcttattggagcaatagccttgcttgtgacgtttacgtatccatgtttcatgtggatctctatcaaaaagccccaaaggaaaagcccaatgtggttgtttaacgttttggtgggttgcctaggtgcttctctcagcgttttgcttctggttgcctcggctatgcgtttggctcaaaagggtttgcatgctaacttcttcagaccctaaagcatccttgcaatcgttagaatgtaattagaatttgtggcacacgtggtaaacttgggactactaacatgttcagttgaaatatttaaattttgtaattatgatattttaatgtatacttctctcaaaaaagagaaaatcgtcagttgatgacaacactattcaacttgttaattcc

SEQ ID NO: 2100 - protein, 1595 aa, Arabidopsis thaliana
  misc_feature: PFam Name: Aa_trans; PFam Description: Transmembrane amino
  misc_feature: GI Number: 21593132; NR Description: amino acid permease-like
  misc_feature: GI Number: 7270469; NR Description: amino acid permease-like protein [Arabidopsis thaliana] >gi|4455344|emb|CAB36725.1| amino acid permease-like protein [Arabidopsis thaliana] >gi|7484806|pir||T04965 amino acid transport protein homolog
  misc_feature: GI Number: 28393033; NR Description: putative amino acid permease [Arabidopsis thaliana] >gi|18418590|ref|NP_567977.1| amino
  misc_feature: GI Number: 452593; NR Description: ORF [Lilium longiflorum]
  misc_feature: GI Number: 21436363; NR Description: putative lysine and histidine specific transporter protein [Arabidopsis thaliana] >gi|17529318|gb|AAL38886.1| putative lysine and histidine specific
ATTATTTGATTTGGAATCACAAGAAAGTGGTGGTTCTCCTTTATTTATGTCACCAGCCCCCTCCACGGATCCACAACCAATCTCCGGCGAAAAAAACGGCGGCGATGGTGGTAGGATTCCGGTAGAAGAGTGGCTGCCGATCACAGAATCAAGAAAAGGAAATGTTTATACGGCGACGTTTCATCTTCTCTGTTCGGGAATTGGTCTCCAAGTGATTCTTCTTCCTGCAGCTTTCGCAGCACTCGGATGGGTATGGGGAACGATAATCTTAACGGTAGGGTTTGTATGGAAGCTCTACACGACGTGGCTTCTTGTTCAACTCCACGAAGCGGTTCCGGGAATTCGTATCAGCAGATACGTGAGACTCGCAATTGCTTCTTTTGGTGTGAAGCTTGGGAAACTTCTCGGAATATTCCCTGTGATGTATCTCTCAGGAGGAGCTTGTACGATTCTGGTTATAACCGGAGGGAAATCAATACAACAACTGTTACAAATTATGTCTGACGACAATACAGCGCCACTTACTTCAGTGCAATGCTTCTTGGTTTTTAGTTGCATTGCGATGATCATGTCTCAGTTTCCGAATCTAAATTCTCTCTTTGGAGTCTCGTTGATCGGTGCTTTTATGGGAATTGCGTATTGCACCGTGATATGGATTTTACCTGTAGCTAGTGACTCACAAAGGACTCAAGTCAGTGTCTCGTACGCTACAATGGATAAAAGTTTCGTTCACATTTTCAACGCTATTGGATTGATAGCTCTAGTATATCGCGGGAACAATCTCGTCCTTGAGATACAGGGTACTCTTCCTTCCGATTCAAAGAACCCTTCATGTAAGACAATGTGGAGAGCAGTGATGATCTCTCATGCTCTCGTCGCGATTTGTATGTTTCCATTAACGTTTGCTGTATATTGGGCATACGGAGACAAGATTCCGGCGACGGGAGGTCCCGTGGGCAACTATCTGAAACTTTACACACAAGAGCACTCGAAGCGAGCAGCCTGTTTCATACACCTCACGTTTATCTTCTCTTGCTTATGTTCATATCCGATAAACTTAATGCCGGCGTGTGACAACATAGAGATGGTGTACATAACCAAGAAGAAAAAGCCTGCATCCATCATTGTCCGGATGATGTTGCGTGTGTTTTTGAGCTTGGTTTGTTTCACTATAGCCGTTGGATTCCCGTTCTTGCCTTATCTAGCGGTTCTTATTGGAGCAATAGCCTTGCTTGTGACGTTTACGTATCCATGTTTCATGTGGATCTCTATCAAAAAGCCCCAAAGGAAAAGCCCAATGTGGTTGTTTAACGTTTTGGTGGGTTGCCTAGGTGCTTCTCTCAGCGTTTTGCTTCTGGTTGCCTCGGCTATGCGTTTGGCTCAAAAGGGTTTGCATGCTAACTTCTTCAGACCCTAAAGCATCCTTGCAATCGTTAGAATGTAATTAGAATTTGTGGCACACGTGGTAAACTTGGGACTACTAACATGTTCAGTTGAAATATTTAAATTTTGTAATTATGATATTTTAATGTATACTTCTCTCAAAAAAGAGAAAATCGTCAGTTGATGACAACACTATTCAACTTGTTAATTCC

SEQ ID NO: 2101 - DNA, 1880 bp, Arabidopsis thaliana
  misc_feature (1)..(1880): Ceres cDNA ID no. 13488331
  misc_feature (1)..(1880): Ceres CLONE  ID no. 37272
  misc_feature (1)..(1880): Also known as  Ceres CDNA ID no. 23361840
gtcaagtaaaaatatctaaatcctttttatctgagtgccttttacaaaattttggatgattatctaatgagcatccataaataagctcaaattttagttagctacttgaccatggttaactctaacaaggatgataaattgataatgatataacggttcggttcggttgcttttggaagaggacgaaccataaagaaagaagctcaaagcccacccattttcgtgattacaggctttttagcaaaaggaagcagcacgtgttctcaaattaaccatagttaactcttcaatataaccatggttaacatttaacctcttcttcttcttattaacttcatcactctctttgtcttctcactttctcttctccacagttcaactcaaccttccaaattccaatggcgacatcacgagctttcactctcttcgctttcacattatctctcctcaccgtagcttctaccgtctccggccataacattactcaaatcctctctgatacgccggaatattcctcattcaacaactacctttctcaaacaaaactcgccgacgaaatcaacagccgcactacaatcaccgtccttgttctcaacaatggcgcaatgtcttccctcgccggaaaacacccactctccgtcgtcaaaaatgctctcagcctcctcgtcctcctcgactactacgatcctttaaaactccatcagctctctaaaggcacaactctcaccaccacgctttaccaaaccaccggacacgctctcgggaacctaggattcgttaacgtcaccgatctcaaaggaggcaaagtcggctttggctccgccgctcctggctccaagctcgattcctcttacaccaaatccgttaaacaaatcccttacaacatctccgttctcgaaatcaacgctccgatcatcgctcccggaatcttaaccgcacctgctccttcttccgccggagttagcaacatcaccggacttctcgagaaagccggttgcaaaaccttcgcgaatttgctcgtatcgagcggtgttattaaaacattcgaatccaccgttgaaaaaggcttgacggtttttgcaccgtccgatgaagcttttaaagctagaggtgtaccagatctgacgaatctcacacaagctgaggtggtctcgctcctagagtatcacgccctcgctgaatacaaacccaaaggatcgttaaagactaacaaagacgctatctccactttagccactaacggcgccggtaaatacgatttaacgacgtcaacttccggtgacgaggttattctccataccggcgttggtccgtcgagactcgccgacacggtggtcgatgagacacctgttgttatattcactgtggataatgtgctccttcccgctgagcttttcggaaaatcttcatcgccggcgccggcaccggagccagtgagtgcaccgacaccgaccccggctaagtcaccgtctcctgtggaagcaccttctccaaccgcagcttctccgccagcaccaccggtggatgaatcttcaccggaaggagctccgtcagactcgccgacaagttcagagaacagtaatgcgaaaaacgcggcgtttcacgttaacgctcctgcgttgttcaccgcattggtcactattgccgccacatctctcttgttataaacaaaaccttaattacgaagactgccattgtcttccttcgacgagtttttatttctttgtgatgctgtttgttaaaaactgggaattagagtgttacggtttacgtttaatcttattagttaatttagaattggatgattgttattgttttgttttggtgtgttagtttgtagtagtgtcgaaatattgagatcttctaattgactagtttcc

SEQ ID NO: 2102 - protein, 1880 aa, Arabidopsis thaliana
  misc_feature: PFam Name: Fasciclin; PFam Description: Fasciclin domain
  misc_feature: PFam Name: Lipoprotein_5; PFam Description: Transferrin
  misc_feature: PFam Name: Trypan_PARP; PFam Description: Procyclic acidic
  misc_feature: GI Number: 14190409; NR Description: AT3g60900/T4C21_310
  misc_feature: GI Number: 21593224; NR Description: endosperm specific protein-like [Arabidopsis thaliana] >gi|7329700|emb|CAB82694.1| endosperm specific protein-like [Arabidopsis thaliana] >gi|38257776|sp|Q9LZX4|FA10_ARATH Fasciclin-like arabinogalactan
  misc_feature: GI Number: 21595125; NR Description: endosperm-specific
  misc_feature: GI Number: 10880493; NR Description: fasciclin-like
  misc_feature: GI Number: 34902266; NR Description: Putative endosperm specific protein [Oryza sativa (japonica cultivar-group)] >gi|20330756|gb|AAM19119.1| Putative endosperm specific protein
GTCAAGTAAAAATATCTAAATCCTTTTTATCTGAGTGCCTTTTACAAAATTTTGGATGATTATCTAATGAGCATCCATAAATAAGCTCAAATTTTAGTTAGCTACTTGACCATGGTTAACTCTAACAAGGATGATAAATTGATAATGATATAACGGTTCGGTTCGGTTGCTTTTGGAAGAGGACGAACCATAAAGAAAGAAGCTCAAAGCCCACCCATTTTCGTGATTACAGGCTTTTTAGCAAAAGGAAGCAGCACGTGTTCTCAAATTAACCATAGTTAACTCTTCAATATAACCATGGTTAACATTTAACCTCTTCTTCTTCTTATTAACTTCATCACTCTCTTTGTCTTCTCACTTTCTCTTCTCCACAGTTCAACTCAACCTTCCAAATTCCAATGGCGACATCACGAGCTTTCACTCTCTTCGCTTTCACATTATCTCTCCTCACCGTAGCTTCTACCGTCTCCGGCCATAACATTACTCAAATCCTCTCTGATACGCCGGAATATTCCTCATTCAACAACTACCTTTCTCAAACAAAACTCGCCGACGAAATCAACAGCCGCACTACAATCACCGTCCTTGTTCTCAACAATGGCGCAATGTCTTCCCTCGCCGGAAAACACCCACTCTCCGTCGTCAAAAATGCTCTCAGCCTCCTCGTCCTCCTCGACTACTACGATCCTTTAAAACTCCATCAGCTCTCTAAAGGCACAACTCTCACCACCACGCTTTACCAAACCACCGGACACGCTCTCGGGAACCTAGGATTCGTTAACGTCACCGATCTCAAAGGAGGCAAAGTCGGCTTTGGCTCCGCCGCTCCTGGCTCCAAGCTCGATTCCTCTTACACCAAATCCGTTAAACAAATCCCTTACAACATCTCCGTTCTCGAAATCAACGCTCCGATCATCGCTCCCGGAATCTTAACCGCACCTGCTCCTTCTTCCGCCGGAGTTAGCAACATCACCGGACTTCTCGAGAAAGCCGGTTGCAAAACCTTCGCGAATTTGCTCGTATCGAGCGGTGTTATTAAAACATTCGAATCCACCGTTGAAAAAGGCTTGACGGTTTTTGCACCGTCCGATGAAGCTTTTAAAGCTAGAGGTGTACCAGATCTGACGAATCTCACACAAGCTGAGGTGGTCTCGCTCCTAGAGTATCACGCCCTCGCTGAATACAAACCCAAAGGATCGTTAAAGACTAACAAAGACGCTATCTCCACTTTAGCCACTAACGGCGCCGGTAAATACGATTTAACGACGTCAACTTCCGGTGACGAGGTTATTCTCCATACCGGCGTTGGTCCGTCGAGACTCGCCGACACGGTGGTCGATGAGACACCTGTTGTTATATTCACTGTGGATAATGTGCTCCTTCCCGCTGAGCTTTTCGGAAAATCTTCATCGCCGGCGCCGGCACCGGAGCCAGTGAGTGCACCGACACCGACCCCGGCTAAGTCACCGTCTCCTGTGGAAGCACCTTCTCCAACCGCAGCTTCTCCGCCAGCACCACCGGTGGATGAATCTTCACCGGAAGGAGCTCCGTCAGACTCGCCGACAAGTTCAGAGAACAGTAATGCGAAAAACGCGGCGTTTCACGTTAACGCTCCTGCGTTGTTCACCGCATTGGTCACTATTGCCGCCACATCTCTCTTGTTATAAACAAAACCTTAATTACGAAGACTGCCATTGTCTTCCTTCGACGAGTTTTTATTTCTTTGTGATGCTGTTTGTTAAAAACTGGGAATTAGAGTGTTACGGTTTACGTTTAATCTTATTAGTTAATTTAGAATTGGATGATTGTTATTGTTTTGTTTTGGTGTGTTAGTTTGTAGTAGTGTCGAAATATTGAGATCTTCTAATTGACTAGTTTCC

SEQ ID NO: 2103 - DNA, 1134 bp, Arabidopsis thaliana
  misc_feature (1)..(1134): Ceres cDNA ID no. 13488413
  misc_feature (1)..(1134): Ceres CLONE  ID no. 119300
  misc_feature (1)..(1134): Also known as  Ceres CDNA ID no. 23362092
ctatctttcgagcattgaaatgataaaaaaaaaattagtggtgttttcaacatagatcatgacaggcaaaccctagattttacttcacctacttgaggttaaaaaacttaattgcaagtaggccagacatcggatcttctctcttaagggctaagcaaaacccatctctcctctttcttatatcttctttctcttccttctctcttctcttgtataaactccactgagctctgtttttgtttttaccgtagatcgtttcgagtctctttaatctttggcgggttccgtaaaaaaaaaaatggcctcttctagattccaatctgggttttgtcctatctcttcgtgtccctctcttgagaatttcatcgaaaggattaaagacgcatgtcgtttcaccctctccgctgttctagggacaattctctcggcggtcttgactttcttcttcgctttagtgggcacattgcttggagcacttactggagctttgataggccaagaaaccgaaagtgggtttatccgaggagcggcggttggagccatttcgggagctgttttctctatcgaagtctttgagtcatctcttgttctttggaaatctaatgagtcacgttttggatgtctcctctacttgattgatgtcattgttagtctgataagtggtagacttgtgcgggaacgaataggtccagcaatgctaagtgcggttcaaagtcagatgggagctgtggattcaactttcgaagagctctcgagtattttcgataccggtggctcaaaggggttaacaggagatttggttgataaaatacctaaaatcaaaatcactggcaaaaacaacttagatgcttctggcaacaaagactcatgttctgtttgtcttcaggattttcaacttggtgaaacggtgagaagcttgccacattgtcatcacatgtttcacttgccttgcatagacaattggctcttcaggcacggatcttgtccaatgtgtagacgcgatctgtaatctcttttcttaccatttgcacagcctcttccctctctctccttcttcttgtatggtcgtaaattcgtaatcatgtggttagagtctctatatatgtacaaagaaatgaaaaaaaaaaagttttg

SEQ ID NO: 2104 - protein, 1134 aa, Arabidopsis thaliana
  misc_feature: PFam Name: zf-C3HC4; PFam Description: Zinc finger, C3HC4
  misc_feature: GI Number: 27524902; NR Description: NEP1-interacting protein
  misc_feature: GI Number: 27524904; NR Description: NEP1-interacting protein 2 [Arabidopsis thaliana] >gi|30680091|ref|NP_179364.2| zinc finger
  misc_feature: GI Number: 18855037; NR Description: putative zinc finger
  misc_feature: GI Number: 50912679; NR Description: putative NEP1-interacting protein [Oryza sativa (japonica cultivar-group)] >gi|46390630|dbj|BAD16113.1| putative NEP1-interacting protein
  misc_feature: GI Number: 50906681; NR Description: ring-H2 zinc finger protein-like [Oryza sativa (japonica cultivar-group)] >gi|47497733|dbj|BAD19798.1| ring-H2 zinc finger protein-like
CTATCTTTCGAGCATTGAAATGATAAAAAAAAAATTAGTGGTGTTTTCAACATAGATCATGACAGGCAAACCCTAGATTTTACTTCACCTACTTGAGGTTAAAAAACTTAATTGCAAGTAGGCCAGACATCGGATCTTCTCTCTTAAGGGCTAAGCAAAACCCATCTCTCCTCTTTCTTATATCTTCTTTCTCTTCCTTCTCTCTTCTCTTGTATAAACTCCACTGAGCTCTGTTTTTGTTTTTACCGTAGATCGTTTCGAGTCTCTTTAATCTTTGGCGGGTTCCGTAAAAAAAAAAATGGCCTCTTCTAGATTCCAATCTGGGTTTTGTCCTATCTCTTCGTGTCCCTCTCTTGAGAATTTCATCGAAAGGATTAAAGACGCATGTCGTTTCACCCTCTCCGCTGTTCTAGGGACAATTCTCTCGGCGGTCTTGACTTTCTTCTTCGCTTTAGTGGGCACATTGCTTGGAGCACTTACTGGAGCTTTGATAGGCCAAGAAACCGAAAGTGGGTTTATCCGAGGAGCGGCGGTTGGAGCCATTTCGGGAGCTGTTTTCTCTATCGAAGTCTTTGAGTCATCTCTTGTTCTTTGGAAATCTAATGAGTCACGTTTTGGATGTCTCCTCTACTTGATTGATGTCATTGTTAGTCTGATAAGTGGTAGACTTGTGCGGGAACGAATAGGTCCAGCAATGCTAAGTGCGGTTCAAAGTCAGATGGGAGCTGTGGATTCAACTTTCGAAGAGCTCTCGAGTATTTTCGATACCGGTGGCTCAAAGGGGTTAACAGGAGATTTGGTTGATAAAATACCTAAAATCAAAATCACTGGCAAAAACAACTTAGATGCTTCTGGCAACAAAGACTCATGTTCTGTTTGTCTTCAGGATTTTCAACTTGGTGAAACGGTGAGAAGCTTGCCACATTGTCATCACATGTTTCACTTGCCTTGCATAGACAATTGGCTCTTCAGGCACGGATCTTGTCCAATGTGTAGACGCGATCTGTAATCTCTTTTCTTACCATTTGCACAGCCTCTTCCCTCTCTCTCCTTCTTCTTGTATGGTCGTAAATTCGTAATCATGTGGTTAGAGTCTCTATATATGTACAAAGAAATGAAAAAAAAAAAGTTTTG

SEQ ID NO: 2105 - DNA, 1116 bp, Arabidopsis thaliana
  misc_feature (1)..(1116): Ceres cDNA ID no. 13488504
  misc_feature (1)..(1116): Ceres CLONE  ID no. 12974
  misc_feature (1)..(1116): Also known as  Ceres CDNA ID no. 23362420
accaccttcgtgtttctctctctattacagaaaaaaagattcaaaaaccctagatttcacaaaatcgattggctgtcaaatttctctccggcgattttcctcgagtgaaattcggctcaaggtgattatagcgatcatcgaatcaaattgattgaagaggtacaaaggttagttactttgagctgaaagatgaacacgtcagaggtgagagtacctcgaggaaatcgacggaggaaagctgtgattgatctgaatgcggtacctgttgatcaagaagggacctctgcttctgttagaactcttacggtgcctattacaccgtctcagcctgctcctacgatgattgatgtcgatgctattgaggatgatgttattgaatcatccgctagtgcttttgctgaagctaaaagcaaatcaagaaatgcacgtcggagacctttgatggttgatgtagagtcaggaggtacgactagattccctgccaacataagcaacaaacgcagaaggattccttctagtgaatctgtcatcgactgtgagcatgcctctgtaaatgatgaagtcaacatgtcttcgagagtgtctagatcaaaggctccagctcctccaccagaagagccaaagtttacatgtccaatctgcatgtgtccctttacggaggagatgtcaaccaagtgcggtcacatcttctgcaagggatgtataaagatggcaatatctcgccagggcaaatgccctacttgtaggaaaaaggttactgcaaaagagctgattcgagttttccttccaaccactagatgagtggtccggcaacatcaccagccaccctgtctaatggtttatcagactatcctcctattcactttggaacattgaagggacttcgttgacttggtatttttgaatattttgctttgttggaagagaaatattcagtgatcaagaagccagaaggccctatcattcgatggatatcattggtaataactctttgtttttagttgttgttctatgtaatttaggtctctgcaaacctctcagtcgatactcttctctcttgatagatgataagatatatggaaaaaaaatttaatattgaatctttactaaaattct

SEQ ID NO: 2106 - protein, 1116 aa, Arabidopsis thaliana
  misc_feature: PFam Name: zf-C3HC4; PFam Description: Zinc finger, C3HC4
  misc_feature: GI Number: 21537318; NR Description: unknown [Arabidopsis thaliana]
  misc_feature: GI Number: 6642645; NR Description: putative RING zinc finger protein [Arabidopsis thaliana] >gi|15231414|ref|NP_187376.1| zinc finger (C3HC4-type RING finger) family protein [Arabidopsis
  misc_feature: GI Number: 50747306; NR Description: PREDICTED: similar to
  misc_feature: GI Number: 61097975; NR Description: similar to RING finger
  misc_feature: GI Number: 41617082; NR Description: TPA: HDC06237
ACCACCTTCGTGTTTCTCTCTCTATTACAGAAAAAAAGATTCAAAAACCCTAGATTTCACAAAATCGATTGGCTGTCAAATTTCTCTCCGGCGATTTTCCTCGAGTGAAATTCGGCTCAAGGTGATTATAGCGATCATCGAATCAAATTGATTGAAGAGGTACAAAGGTTAGTTACTTTGAGCTGAAAGATGAACACGTCAGAGGTGAGAGTACCTCGAGGAAATCGACGGAGGAAAGCTGTGATTGATCTGAATGCGGTACCTGTTGATCAAGAAGGGACCTCTGCTTCTGTTAGAACTCTTACGGTGCCTATTACACCGTCTCAGCCTGCTCCTACGATGATTGATGTCGATGCTATTGAGGATGATGTTATTGAATCATCCGCTAGTGCTTTTGCTGAAGCTAAAAGCAAATCAAGAAATGCACGTCGGAGACCTTTGATGGTTGATGTAGAGTCAGGAGGTACGACTAGATTCCCTGCCAACATAAGCAACAAACGCAGAAGGATTCCTTCTAGTGAATCTGTCATCGACTGTGAGCATGCCTCTGTAAATGATGAAGTCAACATGTCTTCGAGAGTGTCTAGATCAAAGGCTCCAGCTCCTCCACCAGAAGAGCCAAAGTTTACATGTCCAATCTGCATGTGTCCCTTTACGGAGGAGATGTCAACCAAGTGCGGTCACATCTTCTGCAAGGGATGTATAAAGATGGCAATATCTCGCCAGGGCAAATGCCCTACTTGTAGGAAAAAGGTTACTGCAAAAGAGCTGATTCGAGTTTTCCTTCCAACCACTAGATGAGTGGTCCGGCAACATCACCAGCCACCCTGTCTAATGGTTTATCAGACTATCCTCCTATTCACTTTGGAACATTGAAGGGACTTCGTTGACTTGGTATTTTTGAATATTTTGCTTTGTTGGAAGAGAAATATTCAGTGATCAAGAAGCCAGAAGGCCCTATCATTCGATGGATATCATTGGTAATAACTCTTTGTTTTTAGTTGTTGTTCTATGTAATTTAGGTCTCTGCAAACCTCTCAGTCGATACTCTTCTCTCTTGATAGATGATAAGATATATGGAAAAAAAATTTAATATTGAATCTTTACTAAAATTCT

SEQ ID NO: 2107 - DNA, 1821 bp, Arabidopsis thaliana
  misc_feature (1)..(1821): Ceres cDNA ID no. 13488703
  misc_feature (1)..(1821): Ceres CLONE  ID no. 28786
  misc_feature (1)..(1821): Also known as  Ceres CDNA ID no. 23363039
gtttcttctcggtttctccgtaagcattcagagttctgcaagtaagagaagaaggaagctatggatgtagagcaaaagaaaccgttaatcgaatcatcagatcgtaatctacctgatttcaaaaaatcagtgaagcttaaatatgtgaagcttggttaccattaccttatcactcatggaatgtaccttttcctctccccattagtacttgtaatcgctgcacagatttcaactttctctgtcaccgatcttcgtagcctctgggagcatcttcagtacaatcttatctcagtggttgtttgttctatgctgcttgttttcttaatgactatttacttcatgactcgaccacgtcctgtctacttggtgaacttctcgtgctttaaacccgatgagtcacgaaaatgcactaaaaagatctttatggatcgttctaaactcactggctctttcacagaggagaatcttgagttccagcgtaagattctacaacgttcggggctcggggaatcgacttacttacccgaggctgtacttaatgttccgcctaacccgtgtatgaaagaagctcgaaaagaggccgagactgttatgtttggagctattgatgagcttcttgcgaagacgaatgtgaacccgaaggatattgggatcttgattgttaactgtagtttgtttaacccgacaccttcgttatctgctatggttgttaatcactataagctccgcgggaatatacttagttacaacttgggaggaatgggttgcagtgctggtttgatttctattgatcttgctaaacatcttcttcactctattcccaacacttatgcaatggtgattagtatggagaacattacgttgaactggtatttcgggaatgaccggtcgaagcttgtttctaattgtctgtttagaatgggaggtgcagcgattcttctttcgaacaaaagatgggacagaagaagatcgaaatatgagcttgttgatacggttaggactcacaagggagctgatgataagtgttttggttgcataactcaagaagaggattccgcaagtaagattggtgttaccttgtcgaaagaacttatggctgttgcgggtgatgctctaaagacaaatattacgacgttaggaccactggttttaccgacatctgaacagcttctgttctttgcaacgttagtgggaagaaaactcttcaagatgaagatcaagccttacatcccagacttcaaactagcgtttgagcatttctgcatccacgcaggagggagagctgttcttgatgaattggagaagaacttgaaactcacagagtggcatatggagccctcgaggatgacactctaccgttttggtaacacgtccagttcttctttgtggtatgaattagcatatagtgaggccaaaggaaggatcaagaaaggtgatagaatttggcagatagcttttggttcggggttcaagtgcaacagctcggtttggagagcggtaaggtcggtaaaccctaagaaagagaagaacccatggatggatgaaattcatgagttcccagttgaagtccccaaggtctccacaatctagaaaccacttagtggcaaattttcagaagaggtttttgagttttcagcttttgatattttgtgtcttcccagtgaatttacctttttcttgatttgataatcagatacaccaaactggttaacaatatttttcttcttttttgcggaaaaacttgttgtagtcagtagcagaccgtcaatggtcggtccagcttgtgtttttggttgttgtgtctgcatatatatttccttt

SEQ ID NO: 2108 - protein, 1821 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 34902606; NR Description: Putative fatty acid elongase [Oryza sativa (japonica cultivar-group)] gi|22773252|gb|AAN06858.1| Putative fatty acid elongase [Oryza
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 12963438; NR Description: beta-ketoacyl-CoA
GTTTCTTCTCGGTTTCTCCGTAAGCATTCAGAGTTCTGCAAGTAAGAGAAGAAGGAAGCTATGGATGTAGAGCAAAAGAAACCGTTAATCGAATCATCAGATCGTAATCTACCTGATTTCAAAAAATCAGTGAAGCTTAAATATGTGAAGCTTGGTTACCATTACCTTATCACTCATGGAATGTACCTTTTCCTCTCCCCATTAGTACTTGTAATCGCTGCACAGATTTCAACTTTCTCTGTCACCGATCTTCGTAGCCTCTGGGAGCATCTTCAGTACAATCTTATCTCAGTGGTTGTTTGTTCTATGCTGCTTGTTTTCTTAATGACTATTTACTTCATGACTCGACCACGTCCTGTCTACTTGGTGAACTTCTCGTGCTTTAAACCCGATGAGTCACGAAAATGCACTAAAAAGATCTTTATGGATCGTTCTAAACTCACTGGCTCTTTCACAGAGGAGAATCTTGAGTTCCAGCGTAAGATTCTACAACGTTCGGGGCTCGGGGAATCGACTTACTTACCCGAGGCTGTACTTAATGTTCCGCCTAACCCGTGTATGAAAGAAGCTCGAAAAGAGGCCGAGACTGTTATGTTTGGAGCTATTGATGAGCTTCTTGCGAAGACGAATGTGAACCCGAAGGATATTGGGATCTTGATTGTTAACTGTAGTTTGTTTAACCCGACACCTTCGTTATCTGCTATGGTTGTTAATCACTATAAGCTCCGCGGGAATATACTTAGTTACAACTTGGGAGGAATGGGTTGCAGTGCTGGTTTGATTTCTATTGATCTTGCTAAACATCTTCTTCACTCTATTCCCAACACTTATGCAATGGTGATTAGTATGGAGAACATTACGTTGAACTGGTATTTCGGGAATGACCGGTCGAAGCTTGTTTCTAATTGTCTGTTTAGAATGGGAGGTGCAGCGATTCTTCTTTCGAACAAAAGATGGGACAGAAGAAGATCGAAATATGAGCTTGTTGATACGGTTAGGACTCACAAGGGAGCTGATGATAAGTGTTTTGGTTGCATAACTCAAGAAGAGGATTCCGCAAGTAAGATTGGTGTTACCTTGTCGAAAGAACTTATGGCTGTTGCGGGTGATGCTCTAAAGACAAATATTACGACGTTAGGACCACTGGTTTTACCGACATCTGAACAGCTTCTGTTCTTTGCAACGTTAGTGGGAAGAAAACTCTTCAAGATGAAGATCAAGCCTTACATCCCAGACTTCAAACTAGCGTTTGAGCATTTCTGCATCCACGCAGGAGGGAGAGCTGTTCTTGATGAATTGGAGAAGAACTTGAAACTCACAGAGTGGCATATGGAGCCCTCGAGGATGACACTCTACCGTTTTGGTAACACGTCCAGTTCTTCTTTGTGGTATGAATTAGCATATAGTGAGGCCAAAGGAAGGATCAAGAAAGGTGATAGAATTTGGCAGATAGCTTTTGGTTCGGGGTTCAAGTGCAACAGCTCGGTTTGGAGAGCGGTAAGGTCGGTAAACCCTAAGAAAGAGAAGAACCCATGGATGGATGAAATTCATGAGTTCCCAGTTGAAGTCCCCAAGGTCTCCACAATCTAGAAACCACTTAGTGGCAAATTTTCAGAAGAGGTTTTTGAGTTTTCAGCTTTTGATATTTTGTGTCTTCCCAGTGAATTTACCTTTTTCTTGATTTGATAATCAGATACACCAAACTGGTTAACAATATTTTTCTTCTTTTTTGCGGAAAAACTTGTTGTAGTCAGTAGCAGACCGTCAATGGTCGGTCCAGCTTGTGTTTTTGGTTGTTGTGTCTGCATATATATTTCCTTT

SEQ ID NO: 2109 - DNA, 1293 bp, Arabidopsis thaliana
  misc_feature (1)..(1293): Ceres cDNA ID no. 13488711
  misc_feature (1)..(1293): Ceres CLONE  ID no. 108746
  misc_feature (1)..(1293): Also known as  Ceres CDNA ID no. 23363059
ggaaccaattggttctgatttcagatttcgaatttttttaatttgaatccaaatggagaaagcagagaacgagaataagccatcggctgtatctgacgtcggagcatgggctatgaacgtaacgagctccgttgggatcatcatggctaataaacaactaatgtcatcatctggattaggcttcagcttcgcgacaactctcacgggatttcactttgctcttactgctctcgttggtatggtgtcgaatgcgactggtttatcagcatctaagcatgttcctctttgggagcttctttggttctcactcgttgctaatatctcaatcgctgctatgaattttagtcttatgttgaactctgttggcttctaccagatatcgaaattgagcatgattccagttgtttgtgtgatggaatgggttctacatagtaagcattactcgagagaagtgaaggcatctgtcatggttgttgttgtaggagttgggatttgtactgttactgatgtcaaagttaatgccaaaggtttcatttgtgcttgcactgccgttttctccacttctctccagcagatctcaataggttcactgcagaagaaatactcgatcggatcattcgagttgctgagtaagacagctccaatccaagccatttcactcctcatctttggtccatttgttgactatttcttgagtggcagattcatttcgacttacaagatgacttatagcgcaatgttatgcattcttctctcctgcgcattggcggttttctgcaacataagccaatatctctgcatcggaagattctctgctacctcattccaagttcttggccacatgaaaacagtctgtgtcttaacattaggatggcttatctttgattcggagatgacattcaagaacatagcagggatggtcttagccgtggtgggaatggtgatatacagttgggcagtcgagttagagaaacagagaaagtcgaaagtgataccgcatggtaaacacagtatgacagaagatgagattaaacttctcaaagaaggtatagaacatatggatttgaaagacatggagcttggaaataataaagcataaatatagctctattcaagagaaacgttttttggttatatttttggttactcatttcccccatcatgtactcttttcttttgccctttttttcgttctttgtctcaaagaacctttttagcctcttattgatgagctctcctctgcagagcacattcttttttctatagaaatatatgattcctctacttctttgc

SEQ ID NO: 2110 - protein, 1293 aa, Arabidopsis thaliana
  misc_feature: GI Number: 21536703; NR Description: unknown [Arabidopsis thaliana]
  misc_feature: GI Number: 51979016; NR Description: PREDICTED P0453G03.28 gene product [Oryza sativa (japonica cultivar-group)] >gi|51963502|ref|XP_506427.1| PREDICTED P0453G03.28 gene product [Oryza sativa (japonica cultivar-group)] (japonica
  misc_feature: GI Number: 50938707; NR Description: transporter-related-like
  misc_feature: GI Number: 50910467; NR Description: transmembrane protein-like [Oryza sativa (japonica cultivar-group)] >gi|47496808|dbj|BAD19452.1| transmembrane protein-like [Oryza sativa (japonica cultivar-group)] >gi|47497659|dbj|BAD19727.1|
  misc_feature: GI Number: 30313364; NR Description: putative transmembrane
GGAACCAATTGGTTCTGATTTCAGATTTCGAATTTTTTTAATTTGAATCCAAATGGAGAAAGCAGAGAACGAGAATAAGCCATCGGCTGTATCTGACGTCGGAGCATGGGCTATGAACGTAACGAGCTCCGTTGGGATCATCATGGCTAATAAACAACTAATGTCATCATCTGGATTAGGCTTCAGCTTCGCGACAACTCTCACGGGATTTCACTTTGCTCTTACTGCTCTCGTTGGTATGGTGTCGAATGCGACTGGTTTATCAGCATCTAAGCATGTTCCTCTTTGGGAGCTTCTTTGGTTCTCACTCGTTGCTAATATCTCAATCGCTGCTATGAATTTTAGTCTTATGTTGAACTCTGTTGGCTTCTACCAGATATCGAAATTGAGCATGATTCCAGTTGTTTGTGTGATGGAATGGGTTCTACATAGTAAGCATTACTCGAGAGAAGTGAAGGCATCTGTCATGGTTGTTGTTGTAGGAGTTGGGATTTGTACTGTTACTGATGTCAAAGTTAATGCCAAAGGTTTCATTTGTGCTTGCACTGCCGTTTTCTCCACTTCTCTCCAGCAGATCTCAATAGGTTCACTGCAGAAGAAATACTCGATCGGATCATTCGAGTTGCTGAGTAAGACAGCTCCAATCCAAGCCATTTCACTCCTCATCTTTGGTCCATTTGTTGACTATTTCTTGAGTGGCAGATTCATTTCGACTTACAAGATGACTTATAGCGCAATGTTATGCATTCTTCTCTCCTGCGCATTGGCGGTTTTCTGCAACATAAGCCAATATCTCTGCATCGGAAGATTCTCTGCTACCTCATTCCAAGTTCTTGGCCACATGAAAACAGTCTGTGTCTTAACATTAGGATGGCTTATCTTTGATTCGGAGATGACATTCAAGAACATAGCAGGGATGGTCTTAGCCGTGGTGGGAATGGTGATATACAGTTGGGCAGTCGAGTTAGAGAAACAGAGAAAGTCGAAAGTGATACCGCATGGTAAACACAGTATGACAGAAGATGAGATTAAACTTCTCAAAGAAGGTATAGAACATATGGATTTGAAAGACATGGAGCTTGGAAATAATAAAGCATAAATATAGCTCTATTCAAGAGAAACGTTTTTTGGTTATATTTTTGGTTACTCATTTCCCCCATCATGTACTCTTTTCTTTTGCCCTTTTTTTCGTTCTTTGTCTCAAAGAACCTTTTTAGCCTCTTATTGATGAGCTCTCCTCTGCAGAGCACATTCTTTTTTCTATAGAAATATATGATTCCTCTACTTCTTTGC

SEQ ID NO: 2111 - DNA, 1763 bp, Arabidopsis thaliana
  misc_feature (1)..(1763): Ceres cDNA ID no. 13488927
  misc_feature (1)..(1763): Ceres CLONE  ID no. 111543
  misc_feature (1)..(1763): Also known as  Ceres CDNA ID no. 23363752
aaaatttaaatcttcattgaatgctttttctgaagctttatctaataaatctcttcgttgatccttcctttccattaacgaggtagaaattccaaaacgcgtaataatcttgtcgtcattacaaattacaataaaaagaagacatttttatttagatttccctctgatcctctcttttagatttcgaatcgagaccagatctgcgtgaagatgatagagaagtgtataggagcgcatcggtttcggagattacagagattcatgcgtcaagggaaagtgacgattctttgtctcgttctcaccgtcatcgtcttacgtggcacaatcggagccggtaagtttggtacgccggagaaagatatcgaggagatccgtgagcatttcttctacacgcgtaaacgcggcgagcctcaccgtgtcctcgtcgaggtctcttccaaaacgacgtcgtccgaagacggaggaaatggtggtaacagctacgagaccttcgatatcaacaagctattcgttgatgaaggagacgaagagaaatctcgagaccggactaataaaccttattctcttggtcccaagatctctgattgggatgagcagagacgtgattggctcaaacaaaaccctagcttccctaatttcgtggcgccaaacaagcctagggttcttcttgtcacaggttcagctcctaaaccgtgtgagaatcctgtaggagaccattacctcttgaaatcgattaagaacaaaatcgattactgtagaatacacggaatcgagatcttctacaacatggcgttgctcgatgctgagatggctggattctgggctaagcttccgttgattaggaagttactcttgtcacatcctgagattgagtttctatggtggatggatagtgatgccatgttcacggacatggtgttcgagcttccatgggagaggtacaaagattacaacttggtgatgcatggttggaacgagatggtttatgaccagaagaattggattggtctcaacacgggaagtttcttgctcaggaactcacagtggtcgcttgatcttcttgacgcttgggctcctatgggcccaaaagggaagatccgagaagaagcgggtaaagtcttgacccgggaacttaaagaccgacccgctttcgaagctgacgatcaatcggcgatggtttatctgctggcgacggagagagagaaatggggaggcaaagtttatctagagagtggttattacttgcacggttattgggggattttggtagaccggtacgaggagatgattgagaatcataaaccgggttttggagaccatcggtggccattggttacgcatttcgtcgggtgtaaaccgtgcgggaaatttggagattatccggtggaacggtgtctacggcagatggatagagcgtttaatttcggagacaatcagatccttcaaatgtatggtttcacgcataaatcgcttgggagccggcgcgtgaaacccacgcgcaatcagacggataggccgctcgatgccaaggacgagtttgggctgcttcatccgccgttcaaagcggccaagcttagtacgacgacgacgtgagtgagtgagaggatatattgttttgtatcttttaattttgcgtttaggggacacacgtttatttgttttattcaattttatttgtttgtagtttacttaattgttttgatctcccattcatggtggagtcgtgtatggagtatttaatgatttattgtagacgttatttc

SEQ ID NO: 2112 - protein, 1763 aa, Arabidopsis thaliana
  misc_feature: PFam Name: Glyco_transf_34; PFam Description: galactosyl
  misc_feature: GI Number: 32441254; NR Description: At1g74380 [Arabidopsis thaliana] >gi|20260552|gb|AAM13174.1| putative alpha galactosyltransferase [Arabidopsis thaliana] >gi|46576332|sp|Q9CA75|GT5_ARATH Putative glycosyltransferase 5
  misc_feature: GI Number: 30387559; NR Description: At4g02500 [Arabidopsis thaliana] >gi|22655160|gb|AAM98170.1| putative glycosyltransferase [Arabidopsis thaliana] >gi|9716844|emb|CAC01674.1| putative golgi glycosyltransferase
  misc_feature: GI Number: 34098851; NR Description: At5g07720 [Arabidopsis thaliana] >gi|9759594|dbj|BAB11451.1| alpha galactosyltransferase protein [Arabidopsis thaliana] >gi|9716848|emb|CAC01676.1| putative golgi glycosyltransferase glycosyltransferase 3 (AtGT3)
  misc_feature: GI Number: 7362752; NR Description: alpha galactosyltransferase-like protein [Arabidopsis thaliana] >gi|25141201|gb|AAN73295.1| At3g62720/F26K9_150 [Arabidopsis thaliana] >gi|46577293|sp|Q9LZJ3|XT1_ARATH Xyloglucan
  misc_feature: GI Number: 55956974; NR Description:
AAAATTTAAATCTTCATTGAATGCTTTTTCTGAAGCTTTATCTAATAAATCTCTTCGTTGATCCTTCCTTTCCATTAACGAGGTAGAAATTCCAAAACGCGTAATAATCTTGTCGTCATTACAAATTACAATAAAAAGAAGACATTTTTATTTAGATTTCCCTCTGATCCTCTCTTTTAGATTTCGAATCGAGACCAGATCTGCGTGAAGATGATAGAGAAGTGTATAGGAGCGCATCGGTTTCGGAGATTACAGAGATTCATGCGTCAAGGGAAAGTGACGATTCTTTGTCTCGTTCTCACCGTCATCGTCTTACGTGGCACAATCGGAGCCGGTAAGTTTGGTACGCCGGAGAAAGATATCGAGGAGATCCGTGAGCATTTCTTCTACACGCGTAAACGCGGCGAGCCTCACCGTGTCCTCGTCGAGGTCTCTTCCAAAACGACGTCGTCCGAAGACGGAGGAAATGGTGGTAACAGCTACGAGACCTTCGATATCAACAAGCTATTCGTTGATGAAGGAGACGAAGAGAAATCTCGAGACCGGACTAATAAACCTTATTCTCTTGGTCCCAAGATCTCTGATTGGGATGAGCAGAGACGTGATTGGCTCAAACAAAACCCTAGCTTCCCTAATTTCGTGGCGCCAAACAAGCCTAGGGTTCTTCTTGTCACAGGTTCAGCTCCTAAACCGTGTGAGAATCCTGTAGGAGACCATTACCTCTTGAAATCGATTAAGAACAAAATCGATTACTGTAGAATACACGGAATCGAGATCTTCTACAACATGGCGTTGCTCGATGCTGAGATGGCTGGATTCTGGGCTAAGCTTCCGTTGATTAGGAAGTTACTCTTGTCACATCCTGAGATTGAGTTTCTATGGTGGATGGATAGTGATGCCATGTTCACGGACATGGTGTTCGAGCTTCCATGGGAGAGGTACAAAGATTACAACTTGGTGATGCATGGTTGGAACGAGATGGTTTATGACCAGAAGAATTGGATTGGTCTCAACACGGGAAGTTTCTTGCTCAGGAACTCACAGTGGTCGCTTGATCTTCTTGACGCTTGGGCTCCTATGGGCCCAAAAGGGAAGATCCGAGAAGAAGCGGGTAAAGTCTTGACCCGGGAACTTAAAGACCGACCCGCTTTCGAAGCTGACGATCAATCGGCGATGGTTTATCTGCTGGCGACGGAGAGAGAGAAATGGGGAGGCAAAGTTTATCTAGAGAGTGGTTATTACTTGCACGGTTATTGGGGGATTTTGGTAGACCGGTACGAGGAGATGATTGAGAATCATAAACCGGGTTTTGGAGACCATCGGTGGCCATTGGTTACGCATTTCGTCGGGTGTAAACCGTGCGGGAAATTTGGAGATTATCCGGTGGAACGGTGTCTACGGCAGATGGATAGAGCGTTTAATTTCGGAGACAATCAGATCCTTCAAATGTATGGTTTCACGCATAAATCGCTTGGGAGCCGGCGCGTGAAACCCACGCGCAATCAGACGGATAGGCCGCTCGATGCCAAGGACGAGTTTGGGCTGCTTCATCCGCCGTTCAAAGCGGCCAAGCTTAGTACGACGACGACGTGAGTGAGTGAGAGGATATATTGTTTTGTATCTTTTAATTTTGCGTTTAGGGGACACACGTTTATTTGTTTTATTCAATTTTATTTGTTTGTAGTTTACTTAATTGTTTTGATCTCCCATTCATGGTGGAGTCGTGTATGGAGTATTTAATGATTTATTGTAGACGTTATTTC

SEQ ID NO: 2113 - DNA, 1702 bp, Arabidopsis thaliana
  misc_feature (1)..(1702): Ceres cDNA ID no. 13489177
  misc_feature (1)..(1702): Ceres CLONE  ID no. 118286
  misc_feature (1)..(1702): Also known as  Ceres CDNA ID no. 23649363
gccggctgattctcctccttatctatggccgttaccggcggagttttcgttcggaaacgaaacgctctcggtggatcccaccgtgactctaatcgtagctggaaatggcggtggatctctgattattagagctgcgtttgataggtatatgggtataatctttaaacacgcttctggtagaggttctctattgtcgaggattagatttctgaaaatggttgagtatgatatcacttctttgaagatcgttgttcattctgattctgaggagcttcaattgggtgtggatgagagttatacattgatggtgtcgaagaagaacgagcaatcgattgttggagcagccacgatcgaggctaatacagtttatggtgcacttagaggattggagacatttagccagttgtgtgcctttgattatataaccaaatctgtgcaaatatataaagcaccatggtatattcaagataaacctagatttggataccgcggtctgctgatagatacatcaagacattatttaccaattgatgttattaagcaaataatcgaatccatgtcctttgccaaacttaatgtcctgcattggcacattgtagacgagcaatcatttcctcttgaaactcctacatatcctaatttgtggaaaggagcttattcgagatgggaacgttatacagttgaggatgcctctgagattgtcaggtttgccaaaatgagaggtattaatgtcatggctgaagtagatgtccctggccatgcggaatcgtggggaactggataccctgatctttggccgtctctgtcttgccgagagccccttgatgttactaaaaactttacattcgatgtgatttctggcattttagcagatatgagaaagatattcccatttgagcttttccacttgggtggtgatgaagttaatacagattgctggaaaaacacaactcatgttaaagaatggcttcagggtcgcaacttcacgactaaggacgcatataaatactttgtactccgagcgcaacagatagctatatcgaaaaattggacacctgtcaactgggaagaaaccttcagttcctttggaaaagatcttgatccgcggactgtgattcaaaactggctagtgtctgatatatgtcaaaaagcagtagcaaaaggattcaggtgcattttcagtaaccaaggatattggtacctcgaccatttagatgttccgtgggaagaggtttataacaccgagcctctaaatggaatcgaggatccttctctccaaaagcttgtcatcggaggagaagtttgcatgtggggtgaaacagctgatacatccgttgtccttcagaccatttggcctcgtgctgcagcagctgcagaacggatgtggagcaccagagaggccgtgtcaaaggggaacataacgttaaccgcattgccacgtctacactacttcagatgtctactgaataaccgtggcgttccagcggctccagtggataacttttacgcacgaagaccccccttgggacctggctcttgctatgctcagtgatccaaaacgtttcttctcattgtactatatgtaatgtctcgtctgaaatctggttgtcacgttgctttttctgttctaaattgtgtgcttctcaatttactcaaatcatgacaacatctgaaattacgatctaaaacacacgacgctctt

SEQ ID NO: 2114 - protein, 1702 aa, Arabidopsis thaliana
  misc_feature: PFam Name: Glyco_hydro_20; PFam Description: Glycosyl
  misc_feature: PFam Name: Glyco_hydro_20b; PFam Description: Glycosyl
  misc_feature: GI Number: 23463073; NR Description: At1g65600/F5I14_13 [Arabidopsis thaliana] >gi|22135811|gb|AAM91092.1| At1g65600/F5I14_13 [Arabidopsis thaliana] >gi|30697215|ref|NP_176737.2| glycosyl hydrolase family 20
  misc_feature: GI Number: 7019659; NR Description: beta-N-acetylhexosaminidase-like protein [Arabidopsis thaliana] >gi|11264425|pir||T47665 beta-N-acetylhexosaminidase-like protein -
  misc_feature: GI Number: 30694211; NR Description: glycosyl hydrolase
  misc_feature: GI Number: 24030299; NR Description: putative beta-N-acetylhexosaminidase [Arabidopsis thaliana] >gi|21537026|gb|AAM61367.1| beta-N-acetylhexosaminidase-like
  misc_feature: GI Number: 50511452; NR Description: putative beta-N-acetylhexosaminidase [Oryza sativa (japonica
GCCGGCTGATTCTCCTCCTTATCTATGGCCGTTACCGGCGGAGTTTTCGTTCGGAAACGAAACGCTCTCGGTGGATCCCACCGTGACTCTAATCGTAGCTGGAAATGGCGGTGGATCTCTGATTATTAGAGCTGCGTTTGATAGGTATATGGGTATAATCTTTAAACACGCTTCTGGTAGAGGTTCTCTATTGTCGAGGATTAGATTTCTGAAAATGGTTGAGTATGATATCACTTCTTTGAAGATCGTTGTTCATTCTGATTCTGAGGAGCTTCAATTGGGTGTGGATGAGAGTTATACATTGATGGTGTCGAAGAAGAACGAGCAATCGATTGTTGGAGCAGCCACGATCGAGGCTAATACAGTTTATGGTGCACTTAGAGGATTGGAGACATTTAGCCAGTTGTGTGCCTTTGATTATATAACCAAATCTGTGCAAATATATAAAGCACCATGGTATATTCAAGATAAACCTAGATTTGGATACCGCGGTCTGCTGATAGATACATCAAGACATTATTTACCAATTGATGTTATTAAGCAAATAATCGAATCCATGTCCTTTGCCAAACTTAATGTCCTGCATTGGCACATTGTAGACGAGCAATCATTTCCTCTTGAAACTCCTACATATCCTAATTTGTGGAAAGGAGCTTATTCGAGATGGGAACGTTATACAGTTGAGGATGCCTCTGAGATTGTCAGGTTTGCCAAAATGAGAGGTATTAATGTCATGGCTGAAGTAGATGTCCCTGGCCATGCGGAATCGTGGGGAACTGGATACCCTGATCTTTGGCCGTCTCTGTCTTGCCGAGAGCCCCTTGATGTTACTAAAAACTTTACATTCGATGTGATTTCTGGCATTTTAGCAGATATGAGAAAGATATTCCCATTTGAGCTTTTCCACTTGGGTGGTGATGAAGTTAATACAGATTGCTGGAAAAACACAACTCATGTTAAAGAATGGCTTCAGGGTCGCAACTTCACGACTAAGGACGCATATAAATACTTTGTACTCCGAGCGCAACAGATAGCTATATCGAAAAATTGGACACCTGTCAACTGGGAAGAAACCTTCAGTTCCTTTGGAAAAGATCTTGATCCGCGGACTGTGATTCAAAACTGGCTAGTGTCTGATATATGTCAAAAAGCAGTAGCAAAAGGATTCAGGTGCATTTTCAGTAACCAAGGATATTGGTACCTCGACCATTTAGATGTTCCGTGGGAAGAGGTTTATAACACCGAGCCTCTAAATGGAATCGAGGATCCTTCTCTCCAAAAGCTTGTCATCGGAGGAGAAGTTTGCATGTGGGGTGAAACAGCTGATACATCCGTTGTCCTTCAGACCATTTGGCCTCGTGCTGCAGCAGCTGCAGAACGGATGTGGAGCACCAGAGAGGCCGTGTCAAAGGGGAACATAACGTTAACCGCATTGCCACGTCTACACTACTTCAGATGTCTACTGAATAACCGTGGCGTTCCAGCGGCTCCAGTGGATAACTTTTACGCACGAAGACCCCCCTTGGGACCTGGCTCTTGCTATGCTCAGTGATCCAAAACGTTTCTTCTCATTGTACTATATGTAATGTCTCGTCTGAAATCTGGTTGTCACGTTGCTTTTTCTGTTCTAAATTGTGTGCTTCTCAATTTACTCAAATCATGACAACATCTGAAATTACGATCTAAAACACACGACGCTCTT

SEQ ID NO: 2115 - DNA, 1567 bp, Arabidopsis thaliana
  misc_feature (1)..(1567): Ceres cDNA ID no. 13489203
  misc_feature (1)..(1567): Ceres CLONE  ID no. 98046
  misc_feature (1)..(1567): Also known as  Ceres CDNA ID no. 23364587
tggcatcgcctgtttttataatttctcgtcttgtacaaaataaaagactctctctctcttaaaatttctctttcgattctctcgcatttcaaaatttcatttccttatatagactcttaaggccggcgatttctgtgagtccatagattttcgctactccgccgtcagtttttctcaactccggaggctgtgtttttgccaccgctttgattcgccggtaagttcacgtatggccagtaatactttgaaagagatgaatagtcttcatgtaactgagaagataagtgactgtaaagctagcttgaccaagccatgtgttggtaaaatgaatggaaaatctgaagatagaccattaccaaactctgcctccttggattccagtgattctaaagttgtagaagcagagaaacccgagccagagatagctattgtggaagttgaatatattgaatctgaaaacttggataatgtagacgatgctgatgcagttctgaagtctgttttagctggactagagtccaaggactggatttcactctgtgatgctcttaataacgttcgccgactttcgatattccacaaggaagaaatgatgcatatgcttgaaaaagtgataccacttgtcgtgaaatcactgaaaaatccaagaagtgcggtgtgtaaaacggcatgcatgacatctgcagatatcttcagtgcatataataatcatataacagatctgttggagcctctgcttactcaactactcctcaagtcttcccaagacaaacggtttgtttgcgaggcagcagagaaagctttaacagcaatgaccaaatatgtttccccaaccttgctgttaccaaagctgcaaccttgtctcaaaaacaggaatcctcggatccgtgccaaagcatcattatgcttttctcgaagtgttcctcgactgggcgttgaagggattaaagaatatggaatcgacaaattagttcaagcagccgcatctcagcttagcgatcagctccctgaatcccgtgaggctgcacggactgtcctactagaacttcagagcgtatatgaaaaagctcatcctctcatcaaccctgagacatcatcaccagaagaacagcaaatcccggaggtagagccaattacttgggaaactttctgcaagtcaaaactgtcggctcttagcgcacaagccgtgcttcgtgtcaccaatgttgtcactgttactgctcgggagggtttggttactacaggttcatcatcttcatcccagttataaacattttctactacaaattttttaaaaaccgtttgctacgagtcatacggtttacatggtattctccggcatggcggcatgatctaccaaattggcaaattatggaccgataaaaagagtgaacgttcgtgtatgaaaaatcttggcttctttctgggttattttctttttgtggattctcatctgtcttcactaccagtacttgtttctttttcttatgtgtatatattctataccaagatttggtaagatagtcatgagtcttttggttatatgcaaaattggtcggattctttg

SEQ ID NO: 2116 - protein, 1567 aa, Arabidopsis thaliana
  misc_feature: PFam Name: HEAT; PFam Description: HEAT repeat
  misc_feature: GI Number: 21537265; NR Description: unknown [Arabidopsis thaliana]
  misc_feature: GI Number: 51979208; NR Description: PREDICTED P0543C11.17-3 gene product [Oryza sativa (japonica cultivar-group)] >gi|51979206|ref|XP_507469.1| PREDICTED P0543C11.17-3 gene product [Oryza sativa (japonica cultivar-group)] [Oryza sativa
  misc_feature: GI Number: 51979707; NR Description: PREDICTED P0702C09.23 gene product [Oryza sativa (japonica cultivar-group)] >gi|51979705|ref|XP_507599.1| PREDICTED P0702C09.23 gene product [Oryza sativa (japonica cultivar-group)] [Oryza sativa (japonica
  misc_feature: GI Number: 50510481; NR Description: mKIAA0423 protein [Mus
  misc_feature: GI Number: 51766866; NR Description: LOAA0423 [Mus musculus]
TGGCATCGCCTGTTTTTATAATTTCTCGTCTTGTACAAAATAAAAGACTCTCTCTCTCTTAAAATTTCTCTTTCGATTCTCTCGCATTTCAAAATTTCATTTCCTTATATAGACTCTTAAGGCCGGCGATTTCTGTGAGTCCATAGATTTTCGCTACTCCGCCGTCAGTTTTTCTCAACTCCGGAGGCTGTGTTTTTGCCACCGCTTTGATTCGCCGGTAAGTTCACGTATGGCCAGTAATACTTTGAAAGAGATGAATAGTCTTCATGTAACTGAGAAGATAAGTGACTGTAAAGCTAGCTTGACCAAGCCATGTGTTGGTAAAATGAATGGAAAATCTGAAGATAGACCATTACCAAACTCTGCCTCCTTGGATTCCAGTGATTCTAAAGTTGTAGAAGCAGAGAAACCCGAGCCAGAGATAGCTATTGTGGAAGTTGAATATATTGAATCTGAAAACTTGGATAATGTAGACGATGCTGATGCAGTTCTGAAGTCTGTTTTAGCTGGACTAGAGTCCAAGGACTGGATTTCACTCTGTGATGCTCTTAATAACGTTCGCCGACTTTCGATATTCCACAAGGAAGAAATGATGCATATGCTTGAAAAAGTGATACCACTTGTCGTGAAATCACTGAAAAATCCAAGAAGTGCGGTGTGTAAAACGGCATGCATGACATCTGCAGATATCTTCAGTGCATATAATAATCATATAACAGATCTGTTGGAGCCTCTGCTTACTCAACTACTCCTCAAGTCTTCCCAAGACAAACGGTTTGTTTGCGAGGCAGCAGAGAAAGCTTTAACAGCAATGACCAAATATGTTTCCCCAACCTTGCTGTTACCAAAGCTGCAACCTTGTCTCAAAAACAGGAATCCTCGGATCCGTGCCAAAGCATCATTATGCTTTTCTCGAAGTGTTCCTCGACTGGGCGTTGAAGGGATTAAAGAATATGGAATCGACAAATTAGTTCAAGCAGCCGCATCTCAGCTTAGCGATCAGCTCCCTGAATCCCGTGAGGCTGCACGGACTGTCCTACTAGAACTTCAGAGCGTATATGAAAAAGCTCATCCTCTCATCAACCCTGAGACATCATCACCAGAAGAACAGCAAATCCCGGAGGTAGAGCCAATTACTTGGGAAACTTTCTGCAAGTCAAAACTGTCGGCTCTTAGCGCACAAGCCGTGCTTCGTGTCACCAATGTTGTCACTGTTACTGCTCGGGAGGGTTTGGTTACTACAGGTTCATCATCTTCATCCCAGTTATAAACATTTTCTACTACAAATTTTTTAAAAACCGTTTGCTACGAGTCATACGGTTTACATGGTATTCTCCGGCATGGCGGCATGATCTACCAAATTGGCAAATTATGGACCGATAAAAAGAGTGAACGTTCGTGTATGAAAAATCTTGGCTTCTTTCTGGGTTATTTTCTTTTTGTGGATTCTCATCTGTCTTCACTACCAGTACTTGTTTCTTTTTCTTATGTGTATATATTCTATACCAAGATTTGGTAAGATAGTCATGAGTCTTTTGGTTATATGCAAAATTGGTCGGATTCTTTG

SEQ ID NO: 2117 - DNA, 2142 bp, Arabidopsis thaliana
  misc_feature (1)..(2142): Ceres cDNA ID no. 13489235
  misc_feature (1)..(2142): Ceres CLONE  ID no. 111089
  misc_feature (1)..(2142): Also known as  Ceres CDNA ID no. 23364726
atctctcttcacatgcccatttgaatcgtatctcctctcatttcttcttttgttttgttggagttagataaaatcaaaggtctaataaaagtgtcaaaacccttatcgctataacctccactaccatcttaaacttctccttataactcacgcttctctgctttcttctctcagagtctaactgctcaaataagaaaatggttcatgtgtcatcatctcatggagccaaagatggctctgaagaagcctatgattacagaggaaacccaccagataagtctaaaaccggtggatggttaggcgccggtttaattttagggagcgagctatcagagagaatatgcgtgatgggcatatcaatgaatctagtgacgtaccttgttggagatttacacatctcatcagctaaatcagcgaccatagtcaccaacttcatgggaactcttaaccttctagggcttctcggtggttttttggctgacgctaaactcggtcgctacaagatggttgcaatctcagcttctgtcacagctctgggagtgttgcttttgacggtggctacaactatctcaagcatgagaccaccaatatgtgacgatttcaggagacttcatcatcagtgcatagaagcaaacggacaccagttggctcttctctatgttgctctctataccatagctctaggcggaggaggaatcaaatccaacgtctctggttttgggtctgaccagttcgatactagtgatcctaaagaagagaaacagatgattttcttcttcaacagattctatttctccatcagcgttggctctctcttcgccgtgattgctcttgtttacgttcaggacaacgtcgggagaggctggggttacgggatctctgccgcgactatggtggttgcagccattgttttactctgcggaacgaaacggtaccgtttcaagaaacctaaaggaagcccttttacaacaatatggagggttggtttcttggcttggaagaaaagaaaggagagttaccctgcgcatccaagtcttttgaacggttatgacaacaccacggttccacacacagagatgcttaagtgtttagacaaagccgcaatttccaagaacgagagctctcctagctcgaaggacttcgaagagaaggatccgtggatcgtttcgactgttacacaagtcgaagaagtgaaactcgtgatgaaattggtaccgatttgggcaacgaacattcttttctggacgatttactcccaaatgacgactttcacggtcgaacaagcgacgtttatggaccgaaaactcggatctttcactgttcctgcaggctcttactctgctttcctcatactcacaattctcctcttcacttcccttaacgagagagtctttgttcctttaacaagaaggctcacaaaaaagcctcaaggaatcacaagcctacagagaatcggagtagggctagtattctcaatggctgcaatggctgtagccgcggttatagagaacgctagacgcgaggcagcggttaacaacgataagaaaataagcgcgttttggttggttccacaatatttcttagtcggtgcgggtgaggcctttgcttacgttggacagcttgagttctttataagagaagcaccagagaggatgaaatcgatgagcaccggattgtttctaagcacgatatcgatgggattcttcgtgagtagcttgcttgtttcgcttgttgatagggttacagacaaaagctggcttagaagtaaccttaacaaagcgagattgaactacttctactggttacttgttgtcttgggagcattgaacttcttgatttttattgtgtttgccatgaaacatcagtataaagctgatgtgattactgttgttgtgactgatgatgattcagtggagaaggaagtgacgaagaaagagagctctgaatttgagcttaaggacattccttgaaaccagatttagaagaagaaaaaaaacctctggttttgttatttgctttgaagatttcattttgtctttgtatttttagtatattgtgtgtatgaaatagaaagattactatatggtttggattgtatttttttttgtaagatttttaaaaatttagttactatagtttttg

SEQ ID NO: 2118 - protein, 2142 aa, Arabidopsis thaliana
  misc_feature: PFam Name: PTR2; PFam Description: POT family
  misc_feature: PFam Name: MFS_1; PFam Description: Major Facilitator Superfamily
  misc_feature: GI Number: 31711732; NR Description: At1g12110 [Arabidopsis thaliana] >gi|544018|sp|Q05085|CHL1_ARATH Nitrate/chlorate transporter >gi|25082983|gb|AAN72027.1| putative NPK1-related protein kinase 2 [Arabidopsis thaliana] >gi|1076359|pir||A45772
  misc_feature: GI Number: 23506051; NR Description: At3g21670/MIL23_23 [Arabidopsis thaliana] >gi|11994403|dbj|BAB02362.1| nitrate transporter [Arabidopsis thaliana] >gi|13937209|gb|AAK50097.1| AT3g21670/MIL23_23 [Arabidopsis thaliana]
  misc_feature: GI Number: 602292; NR Description: RCH2 protein
  misc_feature: GI Number: 21536775; NR Description: nitrate transporter
  misc_feature: GI Number: 4490323; NR Description: nitrate transporter [Arabidopsis thaliana] >gi|25456097|pir||T52585 probable nitrate
  misc_feature: Utility: Useful for making plants tolerant to low nitrogen
  misc_feature: Utility: Useful for making plants with enhanced tolerance to
ATCTCTCTTCACATGCCCATTTGAATCGTATCTCCTCTCATTTCTTCTTTTGTTTTGTTGGAGTTAGATAAAATCAAAGGTCTAATAAAAGTGTCAAAACCCTTATCGCTATAACCTCCACTACCATCTTAAACTTCTCCTTATAACTCACGCTTCTCTGCTTTCTTCTCTCAGAGTCTAACTGCTCAAATAAGAAAATGGTTCATGTGTCATCATCTCATGGAGCCAAAGATGGCTCTGAAGAAGCCTATGATTACAGAGGAAACCCACCAGATAAGTCTAAAACCGGTGGATGGTTAGGCGCCGGTTTAATTTTAGGGAGCGAGCTATCAGAGAGAATATGCGTGATGGGCATATCAATGAATCTAGTGACGTACCTTGTTGGAGATTTACACATCTCATCAGCTAAATCAGCGACCATAGTCACCAACTTCATGGGAACTCTTAACCTTCTAGGGCTTCTCGGTGGTTTTTTGGCTGACGCTAAACTCGGTCGCTACAAGATGGTTGCAATCTCAGCTTCTGTCACAGCTCTGGGAGTGTTGCTTTTGACGGTGGCTACAACTATCTCAAGCATGAGACCACCAATATGTGACGATTTCAGGAGACTTCATCATCAGTGCATAGAAGCAAACGGACACCAGTTGGCTCTTCTCTATGTTGCTCTCTATACCATAGCTCTAGGCGGAGGAGGAATCAAATCCAACGTCTCTGGTTTTGGGTCTGACCAGTTCGATACTAGTGATCCTAAAGAAGAGAAACAGATGATTTTCTTCTTCAACAGATTCTATTTCTCCATCAGCGTTGGCTCTCTCTTCGCCGTGATTGCTCTTGTTTACGTTCAGGACAACGTCGGGAGAGGCTGGGGTTACGGGATCTCTGCCGCGACTATGGTGGTTGCAGCCATTGTTTTACTCTGCGGAACGAAACGGTACCGTTTCAAGAAACCTAAAGGAAGCCCTTTTACAACAATATGGAGGGTTGGTTTCTTGGCTTGGAAGAAAAGAAAGGAGAGTTACCCTGCGCATCCAAGTCTTTTGAACGGTTATGACAACACCACGGTTCCACACACAGAGATGCTTAAGTGTTTAGACAAAGCCGCAATTTCCAAGAACGAGAGCTCTCCTAGCTCGAAGGACTTCGAAGAGAAGGATCCGTGGATCGTTTCGACTGTTACACAAGTCGAAGAAGTGAAACTCGTGATGAAATTGGTACCGATTTGGGCAACGAACATTCTTTTCTGGACGATTTACTCCCAAATGACGACTTTCACGGTCGAACAAGCGACGTTTATGGACCGAAAACTCGGATCTTTCACTGTTCCTGCAGGCTCTTACTCTGCTTTCCTCATACTCACAATTCTCCTCTTCACTTCCCTTAACGAGAGAGTCTTTGTTCCTTTAACAAGAAGGCTCACAAAAAAGCCTCAAGGAATCACAAGCCTACAGAGAATCGGAGTAGGGCTAGTATTCTCAATGGCTGCAATGGCTGTAGCCGCGGTTATAGAGAACGCTAGACGCGAGGCAGCGGTTAACAACGATAAGAAAATAAGCGCGTTTTGGTTGGTTCCACAATATTTCTTAGTCGGTGCGGGTGAGGCCTTTGCTTACGTTGGACAGCTTGAGTTCTTTATAAGAGAAGCACCAGAGAGGATGAAATCGATGAGCACCGGATTGTTTCTAAGCACGATATCGATGGGATTCTTCGTGAGTAGCTTGCTTGTTTCGCTTGTTGATAGGGTTACAGACAAAAGCTGGCTTAGAAGTAACCTTAACAAAGCGAGATTGAACTACTTCTACTGGTTACTTGTTGTCTTGGGAGCATTGAACTTCTTGATTTTTATTGTGTTTGCCATGAAACATCAGTATAAAGCTGATGTGATTACTGTTGTTGTGACTGATGATGATTCAGTGGAGAAGGAAGTGACGAAGAAAGAGAGCTCTGAATTTGAGCTTAAGGACATTCCTTGAAACCAGATTTAGAAGAAGAAAAAAAACCTCTGGTTTTGTTATTTGCTTTGAAGATTTCATTTTGTCTTTGTATTTTTAGTATATTGTGTGTATGAAATAGAAAGATTACTATATGGTTTGGATTGTATTTTTTTTTGTAAGATTTTTAAAAATTTAGTTACTATAGTTTTTG

SEQ ID NO: 2119 - DNA, 1831 bp, Arabidopsis thaliana
  misc_feature (1)..(1831): Ceres cDNA ID no. 13489239
  misc_feature (1)..(1831): Ceres CLONE  ID no. 100412
  misc_feature (1)..(1831): Also known as  Ceres CDNA ID no. 23364736
tgaggccattctcttttctcctctctctctctctcacacaacacaaacaactcttgagagagagaaacaaatctttcacttgacacttctctccaaatcctcatctcattcttcatcctaaacatttgctcattctcacgatgagccataaccaaaaccaacctcaccggccagtcccggtccatgtcacaaacgccgagccaaaccctaacccaaacaacctcccaaactttctattatccgtccgtctcaaatacgtaaaactcggttaccactacctaatctccaacgctctctacatcctcctccttcctctcctcgccgcaacaatcgctaacctctcttctttcaccatcaacgacctctctctcctctacaacacactccgtttccatttcctctccgccacactcgccaccgcactcttaatctctctctccaccgcttacttcaccacccgtccccgccgtgtcttcctcctcgacttctcgtgttacaaaccagacccttcactgatctgcactcgtgaaacattcatggacagatctcaacgtgtaggcatcttcacagaagacaacttagctttccaacaaaagatcctcgaaagatccggtctaggtcagaaaacttacttccctgaagctcttcttcgtgttcctcctaatccttgtatggaagaagcgagaaaagaggcagaaacagttatgttcggagctattgacgcggttcttgagaagaccggtgtgaaacctaaagatattggaatccttgtggtgaattgtagcttgtttaatccaacaccgtcactttctgctatgattgtgaataagtataagcttagaggcaacattttgagctataatcttggtggaatgggatgtagtgctggccttatctccattgatctcgctaaacagatgcttcaggtgcaaccaaactcatacgcactagtggtgagcacagagaacataaccctaaactggtacttaggcaacgaccgatcaatgcttctatctaactgtatcttccgtatgggcggagccgcggtacttctctcgaaccgctcctctgatcgcagccgttcaaaatatcagctcatccataccgtccgtacccacaaaggagctgatgacaacgcatttggctgtgtttaccaacgagaagacaacaacgcagaagaaaccggcaaaatcggagtgtccctctctaaaaacctaatggcgatagctggagaagctctcaagacaaacatcacaactctcggaccactagttctaccaatgtccgaacaacttctctttttcgcgactcttgtggcccgaaaagtcttcaaagtcaagaaaataaagccttacattcctgatttcaagctagctttcgagcatttctgtatccacgcgggaggtagagccgtgctcgacgagattgagaagaacttggatttatccgaatggcacatggagccatcgaggatgacgttgaaccggtttggtaacacttcgagtagctcactttggtatgagcttgcgtatagtgaagctaaaggaaggattaagagaggagataggacttggcagattgcttttggatcgggttttaagtgtaatagtgcagtttggaaagctttgagaacgattgatccaatggacgagaagactaatccatggattgatgagattgatgactttcctgttcaagttcctaggatcactcccattacatcgtcgtagtgttttaaattcttttggagaactaatttgttatgttttattaaatgtaataacttacgtgatttgatatttttttattatcttaatatatatgattgccg

SEQ ID NO: 2120 - protein, 1831 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 34902606; NR Description: Putative fatty acid elongase [Oryza sativa (japonica cultivar-group)] gi|22773252|gb|AAN06858.1| Putative fatty acid elongase [Oryza
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
TGAGGCCATTCTCTTTTCTCCTCTCTCTCTCTCTCACACAACACAAACAACTCTTGAGAGAGAGAAACAAATCTTTCACTTGACACTTCTCTCCAAATCCTCATCTCATTCTTCATCCTAAACATTTGCTCATTCTCACGATGAGCCATAACCAAAACCAACCTCACCGGCCAGTCCCGGTCCATGTCACAAACGCCGAGCCAAACCCTAACCCAAACAACCTCCCAAACTTTCTATTATCCGTCCGTCTCAAATACGTAAAACTCGGTTACCACTACCTAATCTCCAACGCTCTCTACATCCTCCTCCTTCCTCTCCTCGCCGCAACAATCGCTAACCTCTCTTCTTTCACCATCAACGACCTCTCTCTCCTCTACAACACACTCCGTTTCCATTTCCTCTCCGCCACACTCGCCACCGCACTCTTAATCTCTCTCTCCACCGCTTACTTCACCACCCGTCCCCGCCGTGTCTTCCTCCTCGACTTCTCGTGTTACAAACCAGACCCTTCACTGATCTGCACTCGTGAAACATTCATGGACAGATCTCAACGTGTAGGCATCTTCACAGAAGACAACTTAGCTTTCCAACAAAAGATCCTCGAAAGATCCGGTCTAGGTCAGAAAACTTACTTCCCTGAAGCTCTTCTTCGTGTTCCTCCTAATCCTTGTATGGAAGAAGCGAGAAAAGAGGCAGAAACAGTTATGTTCGGAGCTATTGACGCGGTTCTTGAGAAGACCGGTGTGAAACCTAAAGATATTGGAATCCTTGTGGTGAATTGTAGCTTGTTTAATCCAACACCGTCACTTTCTGCTATGATTGTGAATAAGTATAAGCTTAGAGGCAACATTTTGAGCTATAATCTTGGTGGAATGGGATGTAGTGCTGGCCTTATCTCCATTGATCTCGCTAAACAGATGCTTCAGGTGCAACCAAACTCATACGCACTAGTGGTGAGCACAGAGAACATAACCCTAAACTGGTACTTAGGCAACGACCGATCAATGCTTCTATCTAACTGTATCTTCCGTATGGGCGGAGCCGCGGTACTTCTCTCGAACCGCTCCTCTGATCGCAGCCGTTCAAAATATCAGCTCATCCATACCGTCCGTACCCACAAAGGAGCTGATGACAACGCATTTGGCTGTGTTTACCAACGAGAAGACAACAACGCAGAAGAAACCGGCAAAATCGGAGTGTCCCTCTCTAAAAACCTAATGGCGATAGCTGGAGAAGCTCTCAAGACAAACATCACAACTCTCGGACCACTAGTTCTACCAATGTCCGAACAACTTCTCTTTTTCGCGACTCTTGTGGCCCGAAAAGTCTTCAAAGTCAAGAAAATAAAGCCTTACATTCCTGATTTCAAGCTAGCTTTCGAGCATTTCTGTATCCACGCGGGAGGTAGAGCCGTGCTCGACGAGATTGAGAAGAACTTGGATTTATCCGAATGGCACATGGAGCCATCGAGGATGACGTTGAACCGGTTTGGTAACACTTCGAGTAGCTCACTTTGGTATGAGCTTGCGTATAGTGAAGCTAAAGGAAGGATTAAGAGAGGAGATAGGACTTGGCAGATTGCTTTTGGATCGGGTTTTAAGTGTAATAGTGCAGTTTGGAAAGCTTTGAGAACGATTGATCCAATGGACGAGAAGACTAATCCATGGATTGATGAGATTGATGACTTTCCTGTTCAAGTTCCTAGGATCACTCCCATTACATCGTCGTAGTGTTTTAAATTCTTTTGGAGAACTAATTTGTTATGTTTTATTAAATGTAATAACTTACGTGATTTGATATTTTTTTATTATCTTAATATATATGATTGCCG

SEQ ID NO: 2121 - DNA, 1175 bp, Arabidopsis thaliana
  misc_feature (1)..(1175): Ceres cDNA ID no. 13489378
  misc_feature (1)..(1175): Ceres CLONE  ID no. 97747
  misc_feature (1)..(1175): Also known as  Ceres CDNA ID no. 23365206
atcaattcaataaggaggaggaatagagagctaaagaaaaagaaaaaagactacatttctacaaggacgttggttcttttagtcgtcgtcggtcgtcgaagaaagatcttctccttctttcttcgccgtacgatcgtcgtctaatgggagaatcatcaaatccaatggctacaagttcttcttcctcctcctcctcaattcctccttcgtctccaacaccctctccgacgtccacaaccactccgccacgtcaacatcctctcctccagccaccatcttcaaaaaagaagaaaaacagaacaaacgttttcagagtcttacgcaccgtgtttcgatctttcccaatctttacaacaccatccgtagcatgcaaaatcccggttatacatcccggtttaggcttaccggatccacatcacaacacgtcaagaatcaccggaacgttattcggataccgtaaaggccgagtaagtctttccattcaagaaaaccctaaatgtttaccttctttagtcgtggagctcgccatgcaaaccacaacgcttcaaaaagagctaagcacgggaatggtgagaatagctctcgagactgagaaacagcctcgagctgataataacaattctaaaaccgagaagaagacagatattttggaagaaccgttatggacaatgtattgtaaaggagagaaaacgggttacggtgtgaaacgagaagcgaccgaagaagatcttaacgtgatggagttgttacgtccggtgtctatgggcgccggagttttgccgggaaactcggagtcggaaggacccgacggcgaaatggcgtatatgagagcttattttgagagagttattgggtctaaagattcagagactttttatatgttgagtcctgaagggaataatggacccgaacttagctttttctttgtgagagtttgacttattttgttatggttcaaattaatgtaacgtgtatgtaaatgaccggaaacggcggtggtcgtcgacgttatatactattgtttaggataattgtaagaattttttgttgttctttcgttgttaatctctcgatctttataaaaagattgaattgtaagtgtgtgtatatacacacttcttcgtcctgaaaggaaatgtatgtgatgacattggataggaggaggtttaattgac

SEQ ID NO: 2122 - protein, 1175 aa, Arabidopsis thaliana
  misc_feature: GI Number: 21618123; NR Description: unknown [Arabidopsis thaliana]
  misc_feature: GI Number: 34909066; NR Description: P0702B09.30 [Oryza sativa (japonica cultivar-group)] >gi|13872994|dbj|BAB44099.1|
  misc_feature: GI Number: 34911646; NR Description: P0039G05.26 [Oryza sativa (japonica cultivar-group)] >gi|20161546|dbj|BAB90468.1| P0510C12.13 [Oryza sativa (japonica cultivar-group)] >gi|20805135|dbj|BAB92806.1| P0039G05.26 [Oryza sativa (japonica
  misc_feature: GI Number: 21592736; NR Description: unknown [Arabidopsis thaliana]
  misc_feature: GI Number: 21593000; NR Description: unknown [Arabidopsis thaliana]
ATCAATTCAATAAGGAGGAGGAATAGAGAGCTAAAGAAAAAGAAAAAAGACTACATTTCTACAAGGACGTTGGTTCTTTTAGTCGTCGTCGGTCGTCGAAGAAAGATCTTCTCCTTCTTTCTTCGCCGTACGATCGTCGTCTAATGGGAGAATCATCAAATCCAATGGCTACAAGTTCTTCTTCCTCCTCCTCCTCAATTCCTCCTTCGTCTCCAACACCCTCTCCGACGTCCACAACCACTCCGCCACGTCAACATCCTCTCCTCCAGCCACCATCTTCAAAAAAGAAGAAAAACAGAACAAACGTTTTCAGAGTCTTACGCACCGTGTTTCGATCTTTCCCAATCTTTACAACACCATCCGTAGCATGCAAAATCCCGGTTATACATCCCGGTTTAGGCTTACCGGATCCACATCACAACACGTCAAGAATCACCGGAACGTTATTCGGATACCGTAAAGGCCGAGTAAGTCTTTCCATTCAAGAAAACCCTAAATGTTTACCTTCTTTAGTCGTGGAGCTCGCCATGCAAACCACAACGCTTCAAAAAGAGCTAAGCACGGGAATGGTGAGAATAGCTCTCGAGACTGAGAAACAGCCTCGAGCTGATAATAACAATTCTAAAACCGAGAAGAAGACAGATATTTTGGAAGAACCGTTATGGACAATGTATTGTAAAGGAGAGAAAACGGGTTACGGTGTGAAACGAGAAGCGACCGAAGAAGATCTTAACGTGATGGAGTTGTTACGTCCGGTGTCTATGGGCGCCGGAGTTTTGCCGGGAAACTCGGAGTCGGAAGGACCCGACGGCGAAATGGCGTATATGAGAGCTTATTTTGAGAGAGTTATTGGGTCTAAAGATTCAGAGACTTTTTATATGTTGAGTCCTGAAGGGAATAATGGACCCGAACTTAGCTTTTTCTTTGTGAGAGTTTGACTTATTTTGTTATGGTTCAAATTAATGTAACGTGTATGTAAATGACCGGAAACGGCGGTGGTCGTCGACGTTATATACTATTGTTTAGGATAATTGTAAGAATTTTTTGTTGTTCTTTCGTTGTTAATCTCTCGATCTTTATAAAAAGATTGAATTGTAAGTGTGTGTATATACACACTTCTTCGTCCTGAAAGGAAATGTATGTGATGACATTGGATAGGAGGAGGTTTAATTGAC

SEQ ID NO: 2123 - DNA, 1370 bp, Arabidopsis thaliana
  misc_feature (1)..(1370): Ceres cDNA ID no. 13489595
  misc_feature (1)..(1370): Ceres CLONE  ID no. 113469
  misc_feature (1)..(1370): Also known as  Ceres CDNA ID no. 23365947
cttcccctttccttccgaaattagggcttccgtgtttcgcagtgctctccttcaatccccagcttgacaatgcctcgctatgatgatcgctatgggaacactcgtctctacgttggccgattatcatcgagaactaggacccgagaccttgaacgtctttttagcagatacggaaggtctctgggattttgcctaacctggaggtgtttgatgagtgggtggacttggtggaaattctcgccaagtgtttaggggacagggcgccttggcgattctgtttgtagaattttttaatgtgttttgatggaaatggagactcagtctcaaaaatggtgtttagaagtaccttaaagtaatgatggccttacttttctgccaacaatttcttccgcagagtgcgatatgtggatatgaagcgagattatgctttcgttgaatttggtgatccccgtgatgctgatgatgcaagacattacctggacggacgagactttgatggaagtcgcatcactgtggagttttcacgaggggcacctcgtggttctcgggattttgatagcagaggcccaccacctggagctggtcgctgttttaactgtggtgtagatggtcattgggctcgtgactgcacagcaggggactggaagaacaagtgttaccgttgtggagagagaggacacattgagagaaactgcaaaaacagccccaagaagcttaggcgcagtggaagctactccaggtcacctgtaagatcccgttctcctcgtcgtagaagaagcccaagccggagtcttagccgtagccgaagctacagccgatcacgatccccggtgagaagaagagagaggagtgtggaggagagatcacgcagtccaaagcggatggatgactctctatcgccaagagccagagatcgtagtccggttcttgatgatgaaggcagcccaaagatcatagacgggagcccaccaccatcaccaaagcttcaaaaggaagtcggatctgaccgtgacggtggtagcccccaagacaatggcagaaactctgttgtcagtcctgttgtaggagccggtggtgacagttcgaaagaggaccggagccctgttgatgatgattacgagccaaaccgcacttcccctagaggaagtgagtctccttaactttgatggctcatggccacggcttgcaggcattgtagcatgtatactattggatcgactgttcctttctcttttaagtgtgtttgctttagaaccttttaagtttcatgttaccaagagttttttcatttgagacataatgttgttgcgtttcttttggacaagttttcgaagattgttataaggatttataaaagtttcaatctgagg

SEQ ID NO: 2124 - protein, 1370 aa, Arabidopsis thaliana
  misc_feature: PFam Name: RRM_1; PFam Description: RNA recognition motif.
  misc_feature: PFam Name: zf-CCHC; PFam Description: Zinc knuckle
  misc_feature: GI Number: 42571091; NR Description: splicing factor RSZ33
  misc_feature: GI Number: 9843663; NR Description: splicing factor RSZ33
  misc_feature: GI Number: 9795142; NR Description: splicing factor-like protein [Arabidopsis thaliana] >gi|30693839|ref|NP_190918.3| zinc
  misc_feature: GI Number: 11346381; NR Description: splicing factor-like
  misc_feature: GI Number: 24111329; NR Description: At3g53500/F4P12_200 [Arabidopsis thaliana] >gi|20465265|gb|AAM19952.1| AT3g53500/F4P12_200 [Arabidopsis thaliana] >gi|30693836|ref|NP_851015.1| zinc knuckle (CCHC-type) family
CTTCCCCTTTCCTTCCGAAATTAGGGCTTCCGTGTTTCGCAGTGCTCTCCTTCAATCCCCAGCTTGACAATGCCTCGCTATGATGATCGCTATGGGAACACTCGTCTCTACGTTGGCCGATTATCATCGAGAACTAGGACCCGAGACCTTGAACGTCTTTTTAGCAGATACGGAAGGTCTCTGGGATTTTGCCTAACCTGGAGGTGTTTGATGAGTGGGTGGACTTGGTGGAAATTCTCGCCAAGTGTTTAGGGGACAGGGCGCCTTGGCGATTCTGTTTGTAGAATTTTTTAATGTGTTTTGATGGAAATGGAGACTCAGTCTCAAAAATGGTGTTTAGAAGTACCTTAAAGTAATGATGGCCTTACTTTTCTGCCAACAATTTCTTCCGCAGAGTGCGATATGTGGATATGAAGCGAGATTATGCTTTCGTTGAATTTGGTGATCCCCGTGATGCTGATGATGCAAGACATTACCTGGACGGACGAGACTTTGATGGAAGTCGCATCACTGTGGAGTTTTCACGAGGGGCACCTCGTGGTTCTCGGGATTTTGATAGCAGAGGCCCACCACCTGGAGCTGGTCGCTGTTTTAACTGTGGTGTAGATGGTCATTGGGCTCGTGACTGCACAGCAGGGGACTGGAAGAACAAGTGTTACCGTTGTGGAGAGAGAGGACACATTGAGAGAAACTGCAAAAACAGCCCCAAGAAGCTTAGGCGCAGTGGAAGCTACTCCAGGTCACCTGTAAGATCCCGTTCTCCTCGTCGTAGAAGAAGCCCAAGCCGGAGTCTTAGCCGTAGCCGAAGCTACAGCCGATCACGATCCCCGGTGAGAAGAAGAGAGAGGAGTGTGGAGGAGAGATCACGCAGTCCAAAGCGGATGGATGACTCTCTATCGCCAAGAGCCAGAGATCGTAGTCCGGTTCTTGATGATGAAGGCAGCCCAAAGATCATAGACGGGAGCCCACCACCATCACCAAAGCTTCAAAAGGAAGTCGGATCTGACCGTGACGGTGGTAGCCCCCAAGACAATGGCAGAAACTCTGTTGTCAGTCCTGTTGTAGGAGCCGGTGGTGACAGTTCGAAAGAGGACCGGAGCCCTGTTGATGATGATTACGAGCCAAACCGCACTTCCCCTAGAGGAAGTGAGTCTCCTTAACTTTGATGGCTCATGGCCACGGCTTGCAGGCATTGTAGCATGTATACTATTGGATCGACTGTTCCTTTCTCTTTTAAGTGTGTTTGCTTTAGAACCTTTTAAGTTTCATGTTACCAAGAGTTTTTTCATTTGAGACATAATGTTGTTGCGTTTCTTTTGGACAAGTTTTCGAAGATTGTTATAAGGATTTATAAAAGTTTCAATCTGAGG

SEQ ID NO: 2125 - DNA, 2079 bp, Arabidopsis thaliana
  misc_feature (1)..(2079): Ceres cDNA ID no. 13489597
  misc_feature (1)..(2079): Ceres CLONE  ID no. 118038
  misc_feature (1)..(2079): Also known as  Ceres CDNA ID no. 23365953
atcacattctctccttattcaacttaaatactacacggccaaaaacatttaacaaacgccactcagatcctgagtctttggatcaatggctatttcaaatgttatttctgtcttattattattgcttgtactaatcaatttaagcaatcaaaatatcaaaggaattgatgcatttcatcagatttacgaagaattgcaatctgaatcagtcgagtcagtgaatcatcttcacagacctagttttcactttcaacctccaaagcattggattaacgatccaaatggtccagtatactacaaaggtctctaccatctcttctaccaatataacaccaaaggtgcggtttggggtaatattatatgggcccattcggtttctaaagacttggttaactgggaggctcttgaaccggctcttagtccttcaaaatggttcgacatcggaggtacatggtccggttcaataacaatcgtaccgggaaaagtaccgattatcctctataccggtgttaaccagaacgaaactcagttgcaaaactatgcaatcccagaggaccgatcagacccatacctaaggaaatggattaaaccggacgataacccgattgcaatcccagactatacaatgaacggttcagcattccgtgacccgacaaccgcttggttctccaaagacgggcattggagaaccgtggtagggtcaaaaagaaagcgtagaggaattgcttacatctacagaagccgagatttcaagcattgggtcaaagctaagcacccggttcactctaaacagtcaaccggtatgtgggaatgtcctgatttcttcccggtttccttaaccgatttccgaaacggtttggacttggattacgtcggtccaaacaccaagcatgtgttgaaggttagcttggacattacccggtacgagtattacacgcttggtaaatacgatcttaagaaggaccggtacataccggacggtaatactcccgatggttgggagggtttaagattcgattacggtaatttctacgcttccaagacattctttgactacaaaaagaacagaagaatcttatggggttgggctaatgaatctgacaccgttgaagatgatattttgaagggttgggctggtcttcaggtgattccaagaacggtgctccttgattcaagcaagaagcaacttgtgttttggcctgttgaagagatagagtcattaagaggtaactacgtccgaatgaacaatcatgacatcaagatgggtcaacgcatagaagtcaaaggaatcactcctgctcaagccgatgtggaagtaacgttctatgttggaagtctagagaaagctgagatattcgatccgagtttcacgtggaaaccattggaattgtgtaacattaaaggctcgaatgtgagaggcggtgtaggaccttttggtctgatcacattagcgactcctgatttggaagagtacactcctgtcttctttagagtcttcaacgacactaaaactcataagcctaaagttctcatgtgctccgatgctagaccgtcgtcgttaaagcaagacacgggtttactcgcaaaagataggatgtataaaccatcgtttgctggttttgtggatgttgatatggctgatggaaggatctctctaaggagtttgattgatcattcagtagtagagagctttggagcattaggtaaaacggtgataacatcaagagtgtatccagtgaaagcagtaaaagagaatgcacatttgtatgtctttaacaatggaacacaaactgtgaccatagagagtctcaatgcttggaatatggatcgtcctctgcaaatgaatgatggagctctttaatttagctcttctctctatagtttagctataccgtcttctctctttctcactttttcttatattttcatcttcagtatagtaactgagagatactgtgaaattaggaagaaaaatgtgggagtttctgtgtttacgaacaatttggttgtgatgtccatactttatgtatcgactgttgtatctttctgtctttagtctctcaataaaaataagtttag

SEQ ID NO: 2126 - protein, 2079 aa, Arabidopsis thaliana
  misc_feature: PFam Name: Glyco_hydro_32; PFam Description: Glycosyl
  misc_feature: GI Number: 4886267; NR Description: beta-fructofuranosidase [Arabidopsis thaliana] >gi|7435478|pir||T08439
  misc_feature: GI Number: 18324; NR Description: beta-fructofuranosidase [Daucus carota] >gi|2129916|pir||S61503 beta-fructofuranosidase (EC
  misc_feature: GI Number: 551259; NR Description: beta-fructofuranosidase; beta-fructosidase [Nicotiana tabacum] >gi|1076619|pir||S49308
  misc_feature: GI Number: 30693668; NR Description: beta-fructosidase,
  misc_feature: GI Number: 50844557; NR Description: cell-wall invertase 2
ATCACATTCTCTCCTTATTCAACTTAAATACTACACGGCCAAAAACATTTAACAAACGCCACTCAGATCCTGAGTCTTTGGATCAATGGCTATTTCAAATGTTATTTCTGTCTTATTATTATTGCTTGTACTAATCAATTTAAGCAATCAAAATATCAAAGGAATTGATGCATTTCATCAGATTTACGAAGAATTGCAATCTGAATCAGTCGAGTCAGTGAATCATCTTCACAGACCTAGTTTTCACTTTCAACCTCCAAAGCATTGGATTAACGATCCAAATGGTCCAGTATACTACAAAGGTCTCTACCATCTCTTCTACCAATATAACACCAAAGGTGCGGTTTGGGGTAATATTATATGGGCCCATTCGGTTTCTAAAGACTTGGTTAACTGGGAGGCTCTTGAACCGGCTCTTAGTCCTTCAAAATGGTTCGACATCGGAGGTACATGGTCCGGTTCAATAACAATCGTACCGGGAAAAGTACCGATTATCCTCTATACCGGTGTTAACCAGAACGAAACTCAGTTGCAAAACTATGCAATCCCAGAGGACCGATCAGACCCATACCTAAGGAAATGGATTAAACCGGACGATAACCCGATTGCAATCCCAGACTATACAATGAACGGTTCAGCATTCCGTGACCCGACAACCGCTTGGTTCTCCAAAGACGGGCATTGGAGAACCGTGGTAGGGTCAAAAAGAAAGCGTAGAGGAATTGCTTACATCTACAGAAGCCGAGATTTCAAGCATTGGGTCAAAGCTAAGCACCCGGTTCACTCTAAACAGTCAACCGGTATGTGGGAATGTCCTGATTTCTTCCCGGTTTCCTTAACCGATTTCCGAAACGGTTTGGACTTGGATTACGTCGGTCCAAACACCAAGCATGTGTTGAAGGTTAGCTTGGACATTACCCGGTACGAGTATTACACGCTTGGTAAATACGATCTTAAGAAGGACCGGTACATACCGGACGGTAATACTCCCGATGGTTGGGAGGGTTTAAGATTCGATTACGGTAATTTCTACGCTTCCAAGACATTCTTTGACTACAAAAAGAACAGAAGAATCTTATGGGGTTGGGCTAATGAATCTGACACCGTTGAAGATGATATTTTGAAGGGTTGGGCTGGTCTTCAGGTGATTCCAAGAACGGTGCTCCTTGATTCAAGCAAGAAGCAACTTGTGTTTTGGCCTGTTGAAGAGATAGAGTCATTAAGAGGTAACTACGTCCGAATGAACAATCATGACATCAAGATGGGTCAACGCATAGAAGTCAAAGGAATCACTCCTGCTCAAGCCGATGTGGAAGTAACGTTCTATGTTGGAAGTCTAGAGAAAGCTGAGATATTCGATCCGAGTTTCACGTGGAAACCATTGGAATTGTGTAACATTAAAGGCTCGAATGTGAGAGGCGGTGTAGGACCTTTTGGTCTGATCACATTAGCGACTCCTGATTTGGAAGAGTACACTCCTGTCTTCTTTAGAGTCTTCAACGACACTAAAACTCATAAGCCTAAAGTTCTCATGTGCTCCGATGCTAGACCGTCGTCGTTAAAGCAAGACACGGGTTTACTCGCAAAAGATAGGATGTATAAACCATCGTTTGCTGGTTTTGTGGATGTTGATATGGCTGATGGAAGGATCTCTCTAAGGAGTTTGATTGATCATTCAGTAGTAGAGAGCTTTGGAGCATTAGGTAAAACGGTGATAACATCAAGAGTGTATCCAGTGAAAGCAGTAAAAGAGAATGCACATTTGTATGTCTTTAACAATGGAACACAAACTGTGACCATAGAGAGTCTCAATGCTTGGAATATGGATCGTCCTCTGCAAATGAATGATGGAGCTCTTTAATTTAGCTCTTCTCTCTATAGTTTAGCTATACCGTCTTCTCTCTTTCTCACTTTTTCTTATATTTTCATCTTCAGTATAGTAACTGAGAGATACTGTGAAATTAGGAAGAAAAATGTGGGAGTTTCTGTGTTTACGAACAATTTGGTTGTGATGTCCATACTTTATGTATCGACTGTTGTATCTTTCTGTCTTTAGTCTCTCAATAAAAATAAGTTTAG

SEQ ID NO: 2127 - DNA, 803 bp, Arabidopsis thaliana
  misc_feature (1)..(803): Ceres cDNA ID no. 13489702
  misc_feature (1)..(803): Ceres CLONE  ID no. 5767
  misc_feature (1)..(803): Also known as  Ceres CDNA ID no. 23366255
gcaaatcgtaaaccgccacaaaaccgaaaaaaacactaattgtgctttccctttagatccatttgtattttcttttggagcttttgaacaatggagtcatcacaagcaacgacgaagccaacgagaggagcaggaggaaggaaaggtggagataggaagaagagtgttagtaaatctgttaaagctggtcttcaatttcccgttggtcgtatcgctcgttacttgaagaaaggtcgttacgctctccgatacggttccggtgctccggtttacctcgccgccgttctcgaatacctagccgccgaggtacttgagctagctgggaacgcagcgagagataataagaagaacaggataaaccctaggcatctatgtttagcgataaggaacgatgaagaattggggagattgcttcatggagttactattgcaagtggtggtgttcttccaaacattaatccagttcttcttcctaagaaatcaacagcttcttcttctcaagctgagaaagcttctgctaccaaatctcctaagaaggcttgataaagaatagtatcgatgttgctttttggttatattcggatcttagatgaagaagaagaagaagaagaaacaacttttttttttttttttttagtttttagaggatttgtgtaggtatctgaaatcttcttctctttgttttggtttgtcttatgtaaaaaccatgggaagatgattatgtttcttacgcaatttgtaatggaaaataagtaatttctgggattagtaacatcatcatctgtctaattaatttctgggtc

SEQ ID NO: 2128 - protein, 803 aa, Arabidopsis thaliana
  misc_feature: PFam Name: Histone; PFam Description: Core histone H2A/H2B/H3/H4
  misc_feature: GI Number: 18700220; NR Description: AT5g27670/F15A18_130 [Arabidopsis thaliana] >gi|14326516|gb|AAK60303.1| AT5g27670/F15A18_130 [Arabidopsis thaliana] >gi|15241016|ref|NP_198119.1| histone H2A, putative [Arabidopsis
  misc_feature: GI Number: 5777792; NR Description: histone H2A [Brassica napus]
  misc_feature: GI Number: 27529852; NR Description: H2A histone [Nicotiana
  misc_feature: GI Number: 122003; NR Description: HISTONE H2A
  misc_feature: GI Number: 122006; NR Description: HISTONE H2A
GCAAATCGTAAACCGCCACAAAACCGAAAAAAACACTAATTGTGCTTTCCCTTTAGATCCATTTGTATTTTCTTTTGGAGCTTTTGAACAATGGAGTCATCACAAGCAACGACGAAGCCAACGAGAGGAGCAGGAGGAAGGAAAGGTGGAGATAGGAAGAAGAGTGTTAGTAAATCTGTTAAAGCTGGTCTTCAATTTCCCGTTGGTCGTATCGCTCGTTACTTGAAGAAAGGTCGTTACGCTCTCCGATACGGTTCCGGTGCTCCGGTTTACCTCGCCGCCGTTCTCGAATACCTAGCCGCCGAGGTACTTGAGCTAGCTGGGAACGCAGCGAGAGATAATAAGAAGAACAGGATAAACCCTAGGCATCTATGTTTAGCGATAAGGAACGATGAAGAATTGGGGAGATTGCTTCATGGAGTTACTATTGCAAGTGGTGGTGTTCTTCCAAACATTAATCCAGTTCTTCTTCCTAAGAAATCAACAGCTTCTTCTTCTCAAGCTGAGAAAGCTTCTGCTACCAAATCTCCTAAGAAGGCTTGATAAAGAATAGTATCGATGTTGCTTTTTGGTTATATTCGGATCTTAGATGAAGAAGAAGAAGAAGAAGAAACAACTTTTTTTTTTTTTTTTTTAGTTTTTAGAGGATTTGTGTAGGTATCTGAAATCTTCTTCTCTTTGTTTTGGTTTGTCTTATGTAAAAACCATGGGAAGATGATTATGTTTCTTACGCAATTTGTAATGGAAAATAAGTAATTTCTGGGATTAGTAACATCATCATCTGTCTAATTAATTTCTGGGTC

SEQ ID NO: 2129 - DNA, 1610 bp, Arabidopsis thaliana
  misc_feature (1)..(1610): Ceres cDNA ID no. 13490287
  misc_feature (1)..(1610): Ceres CLONE  ID no. 6957
  misc_feature (1)..(1610): Also known as  Ceres CDNA ID no. 23368334
agaagattcttaaatctcatttctgcggcgtaggtgaagtcttagcgataagctttgtttcttcttcttcttcttctttacccatggatttttaacgaacaagagaagagaagaaccaagttttcttcgaaaggattgaactttgtttctttctcttcagctacaacaaccaaaaaatgatcaagctttgcttcatgacttctcatggttattcaatccctggccttggtcttcctcaagacctctgcaacaccgaaatcatcaagcagaatagccggtctcatctggtgaatcccggagcaagacaagagatcatacctgcaagctccttcaatctgaatacagaactcttggaaccatggaaaccggtttcttcatttagccaattcgtggagattgattcagccatgatgaaacctctgctcatggatgttcatgagacggcaccagaatctctgattttgagctttggaatcgctgataagtttgcaagacaagaaaaggtgatggagtttcttctgtctcagtcagaggagttcaaggaaaaaggattcgatatgtcgctgttaaatgaattgatggagtttgagtctatgaaatccagttctcagctacgaccgtatgatacttcctctgttctttacttgaatcaagaattagggaaaccggttttggatctcgttagggatatgatggagaatccagagttctctgtgcgatcgaatggtcatgttctgttctcttcaagtagcaatcctgagttgaatgatctactttctattgcttccgagttcaatttgtcaaggaattcaacaacaaaatggagacagctctcaccgcttatcccacactttcagaggtttgaaagtgacgtatttacaccggctaagctgaaagcagttacagtgctagcacctttgaagagtcctgagaaaagcaggctcaagtcaccaaggaaacacaacacgaagcgaaaagctaaagagagggacctatacaaaagaaatcatctccacgcttacgagagccttctctctttaatgataggcaatgatcatcgacacaaacacacaacagtactctctttacagaaatcatgtggagagctctcagagcttctgactcagttctctatcactgctgctggaactggaatcgctgtgctcttttctgtcgtatgtagccttgcttcaaggcgtgtacccttttgcgcaaataagttcttcgacactgggcttggtttgagtttggtaatactgtcatgggctgtgaatagactcagggaggtgattgttcatgtcaataggaaagcgaacaagccatgttcaagtttgaaagatgacgaaatcataaacagtgtggagagaagtatgaaggaggtttactacagagctgcaacggtaatcgcggtgtttgcgcttaggtttgcatgttgaaaaatcggggtgagaggtaaaaatcttgatttactactccatggaaagcttctaaaaggtcgtttgtaaatgactaaaacttgtttagtagctgtaaatgtgaaagatgatattatgtggtagaacctaagattaagaggtgaagaattttgaagagaataaatgttttgcaag

SEQ ID NO: 2130 - protein, 1610 aa, Arabidopsis thaliana
  misc_feature: GI Number: 23308297; NR Description: At4g02920/T4I9_20 [Arabidopsis thaliana] >gi|15450579|gb|AAK96561.1|
  misc_feature: GI Number: 21594458; NR Description: unknown [Arabidopsis thaliana]
AGAAGATTCTTAAATCTCATTTCTGCGGCGTAGGTGAAGTCTTAGCGATAAGCTTTGTTTCTTCTTCTTCTTCTTCTTTACCCATGGATTTTTAACGAACAAGAGAAGAGAAGAACCAAGTTTTCTTCGAAAGGATTGAACTTTGTTTCTTTCTCTTCAGCTACAACAACCAAAAAATGATCAAGCTTTGCTTCATGACTTCTCATGGTTATTCAATCCCTGGCCTTGGTCTTCCTCAAGACCTCTGCAACACCGAAATCATCAAGCAGAATAGCCGGTCTCATCTGGTGAATCCCGGAGCAAGACAAGAGATCATACCTGCAAGCTCCTTCAATCTGAATACAGAACTCTTGGAACCATGGAAACCGGTTTCTTCATTTAGCCAATTCGTGGAGATTGATTCAGCCATGATGAAACCTCTGCTCATGGATGTTCATGAGACGGCACCAGAATCTCTGATTTTGAGCTTTGGAATCGCTGATAAGTTTGCAAGACAAGAAAAGGTGATGGAGTTTCTTCTGTCTCAGTCAGAGGAGTTCAAGGAAAAAGGATTCGATATGTCGCTGTTAAATGAATTGATGGAGTTTGAGTCTATGAAATCCAGTTCTCAGCTACGACCGTATGATACTTCCTCTGTTCTTTACTTGAATCAAGAATTAGGGAAACCGGTTTTGGATCTCGTTAGGGATATGATGGAGAATCCAGAGTTCTCTGTGCGATCGAATGGTCATGTTCTGTTCTCTTCAAGTAGCAATCCTGAGTTGAATGATCTACTTTCTATTGCTTCCGAGTTCAATTTGTCAAGGAATTCAACAACAAAATGGAGACAGCTCTCACCGCTTATCCCACACTTTCAGAGGTTTGAAAGTGACGTATTTACACCGGCTAAGCTGAAAGCAGTTACAGTGCTAGCACCTTTGAAGAGTCCTGAGAAAAGCAGGCTCAAGTCACCAAGGAAACACAACACGAAGCGAAAAGCTAAAGAGAGGGACCTATACAAAAGAAATCATCTCCACGCTTACGAGAGCCTTCTCTCTTTAATGATAGGCAATGATCATCGACACAAACACACAACAGTACTCTCTTTACAGAAATCATGTGGAGAGCTCTCAGAGCTTCTGACTCAGTTCTCTATCACTGCTGCTGGAACTGGAATCGCTGTGCTCTTTTCTGTCGTATGTAGCCTTGCTTCAAGGCGTGTACCCTTTTGCGCAAATAAGTTCTTCGACACTGGGCTTGGTTTGAGTTTGGTAATACTGTCATGGGCTGTGAATAGACTCAGGGAGGTGATTGTTCATGTCAATAGGAAAGCGAACAAGCCATGTTCAAGTTTGAAAGATGACGAAATCATAAACAGTGTGGAGAGAAGTATGAAGGAGGTTTACTACAGAGCTGCAACGGTAATCGCGGTGTTTGCGCTTAGGTTTGCATGTTGAAAAATCGGGGTGAGAGGTAAAAATCTTGATTTACTACTCCATGGAAAGCTTCTAAAAGGTCGTTTGTAAATGACTAAAACTTGTTTAGTAGCTGTAAATGTGAAAGATGATATTATGTGGTAGAACCTAAGATTAAGAGGTGAAGAATTTTGAAGAGAATAAATGTTTTGCAAG

SEQ ID NO: 2131 - DNA, 1660 bp, Arabidopsis thaliana
  misc_feature (1)..(1660): Ceres cDNA ID no. 13490313
  misc_feature (1)..(1660): Ceres CLONE  ID no. 11266
  misc_feature (1)..(1660): Also known as  Ceres CDNA ID no. 23368376
ttttttgtctttgcaacatcaccaccatacatacatacaacttacatacatacacgtcttccacaggactcaaactccacagcatgggattctcacggtcgctcaaccgcaccgtgggcgtcttcgtcttcttcatcctcgacattgttgatttcctgctttgctttacctacaagactcttgatttcttcttcgagtccgagtggaaaccctgctactgctgtccgccgcccgaggccaaaccaatctcggctggagggaacagaggcggtaagatgatagtgtcggaaagatcaggagactactcgaaggtggtctcactcacaaggacaaagatctatctggatgagatctccgacacactctactctcgcccttcactcctcaccaagctcactaagctggtgaagtgcttcaagaaagatgttgttaaatgctgtgatgagtccaagaagagatcaccgtcaactaaaaagacattactcactgtcaactccacggtggtcgagaagttgcaaagaacaccaagatggtctgattgccattgcactttctgcacttcttggctttcctcttccaaccaatctctctttgtcaatgtccaacagcccacagacaacaaggcacaagagaacgtagtgttcattcatgggttcttatcatcatccacgttttggacggagactctgttcccaaacttctcagactcagccaaatcgaattacaggtttctcgcagtggacctgttgggttatgggaaaagtccaaagccgaacgattcattgtatacattaaaagagcatttagagatgatagagagatcggtgatttctcagttcagactcaagacattccatttagtggctcactccctaggctgcattttggctcttgcgctcgcggttaaacacccaggagccatcaagtcactcactctattggctcctccatattattcggtgccaaaaggtgtgcaagggacgcaatatgtgatgagaagactggcccccaaggaagtgtggcctccgatggccttcggagcctcagtggctagctggtacgagcacattagccgcacagtcagtctagtgctttgcaagaatcatcacttgttggaatttctcaccaggctactcaccagaaacaggatgcgaacgtacttgatagaagggttcttgtgtcacacacataacgcgtcatggcacacactacacaacatcattttcggatcggggagcaaagtagaggcttatttggaccatgtccgtgacaacgtggactgtgaggtcgcagtcttccacggcggtagggacgagctgatccccgtggagtgcagctacggcgtcaagaggaaagtgccacgtgcaaggatccacgtcgtccccgacaaagaccacatcaccattgttgttgggaggcagaaggagttcgctcgtgagcttgagctcatttggcgcagatccactactcctcaacttcattcaataaattaacccttctttattttaagctaagtatatatatattaataccaaccactattattcaaaccatcattttatacccattcacttttgcatatttcggtgactcctatgtagaaaaaaaaacagaacatgtttcttttgtggttgccatttcattatgatttcgaattttg

SEQ ID NO: 2132 - protein, 1660 aa, Arabidopsis thaliana
  misc_feature: PFam Name: Abhydrolase_1; PFam Description: alpha/beta
  misc_feature: GI Number: 6633825; NR Description: F1N19.24 [Arabidopsis thaliana]
  misc_feature: GI Number: 11498471; NR Description: carboxylesterase (est-1) [Archaeoglobus fulgidus DSM 4304] >gi|2649734|gb|AAB90371.1| carboxylesterase (est-1) [Archaeoglobus fulgidus DSM 4304] >gi|7433050|pir||A69358 carboxylesterase (est-1) homolog -
TTTTTTGTCTTTGCAACATCACCACCATACATACATACAACTTACATACATACACGTCTTCCACAGGACTCAAACTCCACAGCATGGGATTCTCACGGTCGCTCAACCGCACCGTGGGCGTCTTCGTCTTCTTCATCCTCGACATTGTTGATTTCCTGCTTTGCTTTACCTACAAGACTCTTGATTTCTTCTTCGAGTCCGAGTGGAAACCCTGCTACTGCTGTCCGCCGCCCGAGGCCAAACCAATCTCGGCTGGAGGGAACAGAGGCGGTAAGATGATAGTGTCGGAAAGATCAGGAGACTACTCGAAGGTGGTCTCACTCACAAGGACAAAGATCTATCTGGATGAGATCTCCGACACACTCTACTCTCGCCCTTCACTCCTCACCAAGCTCACTAAGCTGGTGAAGTGCTTCAAGAAAGATGTTGTTAAATGCTGTGATGAGTCCAAGAAGAGATCACCGTCAACTAAAAAGACATTACTCACTGTCAACTCCACGGTGGTCGAGAAGTTGCAAAGAACACCAAGATGGTCTGATTGCCATTGCACTTTCTGCACTTCTTGGCTTTCCTCTTCCAACCAATCTCTCTTTGTCAATGTCCAACAGCCCACAGACAACAAGGCACAAGAGAACGTAGTGTTCATTCATGGGTTCTTATCATCATCCACGTTTTGGACGGAGACTCTGTTCCCAAACTTCTCAGACTCAGCCAAATCGAATTACAGGTTTCTCGCAGTGGACCTGTTGGGTTATGGGAAAAGTCCAAAGCCGAACGATTCATTGTATACATTAAAAGAGCATTTAGAGATGATAGAGAGATCGGTGATTTCTCAGTTCAGACTCAAGACATTCCATTTAGTGGCTCACTCCCTAGGCTGCATTTTGGCTCTTGCGCTCGCGGTTAAACACCCAGGAGCCATCAAGTCACTCACTCTATTGGCTCCTCCATATTATTCGGTGCCAAAAGGTGTGCAAGGGACGCAATATGTGATGAGAAGACTGGCCCCCAAGGAAGTGTGGCCTCCGATGGCCTTCGGAGCCTCAGTGGCTAGCTGGTACGAGCACATTAGCCGCACAGTCAGTCTAGTGCTTTGCAAGAATCATCACTTGTTGGAATTTCTCACCAGGCTACTCACCAGAAACAGGATGCGAACGTACTTGATAGAAGGGTTCTTGTGTCACACACATAACGCGTCATGGCACACACTACACAACATCATTTTCGGATCGGGGAGCAAAGTAGAGGCTTATTTGGACCATGTCCGTGACAACGTGGACTGTGAGGTCGCAGTCTTCCACGGCGGTAGGGACGAGCTGATCCCCGTGGAGTGCAGCTACGGCGTCAAGAGGAAAGTGCCACGTGCAAGGATCCACGTCGTCCCCGACAAAGACCACATCACCATTGTTGTTGGGAGGCAGAAGGAGTTCGCTCGTGAGCTTGAGCTCATTTGGCGCAGATCCACTACTCCTCAACTTCATTCAATAAATTAACCCTTCTTTATTTTAAGCTAAGTATATATATATTAATACCAACCACTATTATTCAAACCATCATTTTATACCCATTCACTTTTGCATATTTCGGTGACTCCTATGTAGAAAAAAAAACAGAACATGTTTCTTTTGTGGTTGCCATTTCATTATGATTTCGAATTTTG

SEQ ID NO: 2133 - DNA, 1126 bp, Arabidopsis thaliana
  misc_feature (1)..(1126): Ceres cDNA ID no. 13490348
  misc_feature (1)..(1126): Ceres CLONE  ID no. 16548
  misc_feature (1)..(1126): Also known as  Ceres CDNA ID no. 23368540
gctaaaaccctctctccccttcttcttacttcacttcactcgtgctttctccaatggagtcactcctgcacgcgtcttcgtctctggtgtctctgagacccagaatcgacggtagagattcgttcatcaacccgtcacgcgtgtgccttaatcctagtctcggccgcagaggatctaaacctcttccgttggtcgcggcggcgaagaagaagaaaagcaagaaagatgacaatcataacttttcagctagacctgacgaagccactggtccttttcctgaatccattcttctcaaagagaagaagattgatgaagaaggtgatcttcttcccgagtttgctgatgctgaagaaaaggagctatatcagtttctggatcttcagcttcagagtgacttgaatgaagaaaggatgaggcactatgaggtggtttacttgattcatgaaaaacatgctgaggaggttgaaagcattaaccagaaagtacaagattacctgaaggagaagaaggggaaagtttggaggtttagtgattggggaatgcgtagactggcttacaaaatacagaaggcagagaatgcgcactatatactgatgaactttgagatagaggcaaaatacttgaacgaattcaagggattgttagatagtgatgagagggtgattaggcatcttgtgatgaaacgtgatgaggccataaccgaagactgtcctccacctcctgagtttcactctgtccgcgcaggtgatgaatattatgacgatgatgaagaggaagagattgaagaagatgaagatgaaggtgagggtgaagatgaagaagatgctgataatatagagtacgaagtagatgatgatggtaatgtcgttatggtgttgtacggagatgaagaagaaggagaagaagaagaagatggagctagtgaacaagaagaaggacaggacaagtcaactaatggtagaagagaaacccggagaacagttaacgtaggaggttaggactgtctgtaattcttttgtttttgggtcatgttttggataatagggtcacacatcaaatcgaagttgtttgttgtactcataatagcatcctaagaagtatatgagaaactaaactattcccttgg

SEQ ID NO: 2134 - protein, 1126 aa, Arabidopsis thaliana
  misc_feature: PFam Name: Ribosomal_S6; PFam Description: Ribosomal protein S6
  misc_feature: PFam Name: Chromadorea_ALT; PFam Description: Chromadorea
  misc_feature: PFam Name: Nop14; PFam Description: Nop14-like family
  misc_feature: PFam Name: Daxx; PFam Description: Daxx Family
  misc_feature: PFam Name: Mpp10; PFam Description: Mpp10 protein
  misc_feature: GI Number: 21553777; NR Description: unknown [Arabidopsis thaliana]
  misc_feature: GI Number: 49076654; NR Description: PA4935 [synthetic construct]
  misc_feature: GI Number: 15600128; NR Description: 30S ribosomal protein S6 [Pseudomonas aeruginosa PA01] >gi|9951214|gb|AAG08320.1| 30S ribosomal protein S6 [Pseudomonas aeruginosa PAO1] >gi|13959534|sp|Q9HUM9|RS6_PSEAE 30S ribosomal protein S6
  misc_feature: GI Number: 48861101; NR Description: COG0360: Ribosomal
  misc_feature: GI Number: 29654191; NR Description: ribosomal protein S6 [Coxiella burnetii RSA 493] >gi|29541457|gb|AAO90397.1| ribosomal
GCTAAAACCCTCTCTCCCCTTCTTCTTACTTCACTTCACTCGTGCTTTCTCCAATGGAGTCACTCCTGCACGCGTCTTCGTCTCTGGTGTCTCTGAGACCCAGAATCGACGGTAGAGATTCGTTCATCAACCCGTCACGCGTGTGCCTTAATCCTAGTCTCGGCCGCAGAGGATCTAAACCTCTTCCGTTGGTCGCGGCGGCGAAGAAGAAGAAAAGCAAGAAAGATGACAATCATAACTTTTCAGCTAGACCTGACGAAGCCACTGGTCCTTTTCCTGAATCCATTCTTCTCAAAGAGAAGAAGATTGATGAAGAAGGTGATCTTCTTCCCGAGTTTGCTGATGCTGAAGAAAAGGAGCTATATCAGTTTCTGGATCTTCAGCTTCAGAGTGACTTGAATGAAGAAAGGATGAGGCACTATGAGGTGGTTTACTTGATTCATGAAAAACATGCTGAGGAGGTTGAAAGCATTAACCAGAAAGTACAAGATTACCTGAAGGAGAAGAAGGGGAAAGTTTGGAGGTTTAGTGATTGGGGAATGCGTAGACTGGCTTACAAAATACAGAAGGCAGAGAATGCGCACTATATACTGATGAACTTTGAGATAGAGGCAAAATACTTGAACGAATTCAAGGGATTGTTAGATAGTGATGAGAGGGTGATTAGGCATCTTGTGATGAAACGTGATGAGGCCATAACCGAAGACTGTCCTCCACCTCCTGAGTTTCACTCTGTCCGCGCAGGTGATGAATATTATGACGATGATGAAGAGGAAGAGATTGAAGAAGATGAAGATGAAGGTGAGGGTGAAGATGAAGAAGATGCTGATAATATAGAGTACGAAGTAGATGATGATGGTAATGTCGTTATGGTGTTGTACGGAGATGAAGAAGAAGGAGAAGAAGAAGAAGATGGAGCTAGTGAACAAGAAGAAGGACAGGACAAGTCAACTAATGGTAGAAGAGAAACCCGGAGAACAGTTAACGTAGGAGGTTAGGACTGTCTGTAATTCTTTTGTTTTTGGGTCATGTTTTGGATAATAGGGTCACACATCAAATCGAAGTTGTTTGTTGTACTCATAATAGCATCCTAAGAAGTATATGAGAAACTAAACTATTCCCTTGG

SEQ ID NO: 2135 - DNA, 1708 bp, Arabidopsis thaliana
  misc_feature (1)..(1708): Ceres cDNA ID no. 13490417
  misc_feature (1)..(1708): Also known as  Ceres CDNA ID no. 23368540
actcgccactttcctcgagaaaacgaaaaaaaaagatggtaggaagaagaaaagctttactcttttctctctgtttcttcttcctctctcttccttccttctcttcccttccatccttccaaaccctattccccaattctcattcccttccttgtgcttctcccgtctcattccaacccgactccgactccgagtcactgctagaatccgaatttgaatccggatccgactccgagtcttcttcttccattactctaaacctcgaccacatcgatgctctctcctccaacaaaacacccgacgagctattcagctcccgtctccaacgtgactcccggcgcgtgaaatctatcgccacactcgccgctcaaatccccggaagaaacgtgactcacgcgccacgacccggtggattcagcagctcagtcgtctctggtctctctcaaggaagcggtgaatacttcacgcgcctcggtgtcggcactccggcgagatatgtttacatggtgctcgacaccggcagcgacatcgtctggctacaatgcgctccttgtcggagatgctactctcaatccgacccgatattcgacccgagaaaatccaagacctatgccacaatcccctgttcttcacctcactgccgccgattagactccgccggatgcaacacccgtcgtaagacttgtctctaccaagtctcttacggagatggttctttcaccgtcggcgatttctccaccgaaacgctaactttccggcgaaatcgcgttaaaggcgttgctctcggatgtggccacgacaacgaaggtctcttcgtcggagccgccggtttattaggactcggtaaaggtaaattatcgttccccggtcaaaccggtcaccggtttaatcagaaattctcttactgtttagtcgacagatccgcttcttcgaaaccttcctcggtcgtcttcggaaacgccgccgtatcacgaatcgcgagattcacgccacttttgtcaaacccaaaactcgacactttctactacgtcgggcttctgggaattagcgtcggagggacacgtgtccccggcgtaacggcttctctttttaaacttgaccagatcggtaacggtggagttattatcgattcgggtacgtctgtgacccggttgatccgaccagcttatattgctatgagagacgcgttccgggtcggagctaagacattgaaaagagctccggatttctcactcttcgacacgtgtttcgatctctccaatatgaacgaggttaaagtaccgacggtggttttacatttccgtggagctgacgtatcacttccggcgacgaattacctgatccctgtggataccaacggcaagttctgttttgcgtttgccggtacgatgggcggactatccataattgggaatatccagcaacagggtttccgggttgtatacgacttagcgagttcccgggtcgggtttgctccaggaggatgcgcttaataattagatctgaccggagccggtacggataatgtacttttgttttctcaatttaatgcttagacttgttttttttttttttataaatcggacaagtgaatctttaagcggtggagttgaatacgtgttgataaaatcttcacgtgttgtcggctgtattattagtatcgtctttattttacatctcggaccaaagagagcgtgtatgattttct

SEQ ID NO: 2136 - protein, 1708 aa, Arabidopsis thaliana
  misc_feature: PFam Name: Ribosomal_S6; PFam Description: Ribosomal protein S6
  misc_feature: PFam Name: Chromadorea_ALT; PFam Description: Chromadorea
  misc_feature: PFam Name: Nop14; PFam Description: Nop14-like family
  misc_feature: PFam Name: Daxx; PFam Description: Daxx Family
  misc_feature: PFam Name: Mpp10; PFam Description: Mpp10 protein
  misc_feature: GI Number: 21553777; NR Description: unknown [Arabidopsis thaliana]
  misc_feature: GI Number: 49076654; NR Description: PA4935 [synthetic construct]
  misc_feature: GI Number: 15600128; NR Description: 30S ribosomal protein S6 [Pseudomonas aeruginosa PA01] >gi|9951214|gb|AAG08320.1| 30S ribosomal protein S6 [Pseudomonas aeruginosa PAO1] >gi|13959534|sp|Q9HUM9|RS6_PSEAE 30S ribosomal protein S6
  misc_feature: GI Number: 48861101; NR Description: COG0360: Ribosomal
  misc_feature: GI Number: 29654191; NR Description: ribosomal protein S6 [Coxiella burnetii RSA 493] >gi|29541457|gb|AAO90397.1| ribosomal
ACTCGCCACTTTCCTCGAGAAAACGAAAAAAAAAGATGGTAGGAAGAAGAAAAGCTTTACTCTTTTCTCTCTGTTTCTTCTTCCTCTCTCTTCCTTCCTTCTCTTCCCTTCCATCCTTCCAAACCCTATTCCCCAATTCTCATTCCCTTCCTTGTGCTTCTCCCGTCTCATTCCAACCCGACTCCGACTCCGAGTCACTGCTAGAATCCGAATTTGAATCCGGATCCGACTCCGAGTCTTCTTCTTCCATTACTCTAAACCTCGACCACATCGATGCTCTCTCCTCCAACAAAACACCCGACGAGCTATTCAGCTCCCGTCTCCAACGTGACTCCCGGCGCGTGAAATCTATCGCCACACTCGCCGCTCAAATCCCCGGAAGAAACGTGACTCACGCGCCACGACCCGGTGGATTCAGCAGCTCAGTCGTCTCTGGTCTCTCTCAAGGAAGCGGTGAATACTTCACGCGCCTCGGTGTCGGCACTCCGGCGAGATATGTTTACATGGTGCTCGACACCGGCAGCGACATCGTCTGGCTACAATGCGCTCCTTGTCGGAGATGCTACTCTCAATCCGACCCGATATTCGACCCGAGAAAATCCAAGACCTATGCCACAATCCCCTGTTCTTCACCTCACTGCCGCCGATTAGACTCCGCCGGATGCAACACCCGTCGTAAGACTTGTCTCTACCAAGTCTCTTACGGAGATGGTTCTTTCACCGTCGGCGATTTCTCCACCGAAACGCTAACTTTCCGGCGAAATCGCGTTAAAGGCGTTGCTCTCGGATGTGGCCACGACAACGAAGGTCTCTTCGTCGGAGCCGCCGGTTTATTAGGACTCGGTAAAGGTAAATTATCGTTCCCCGGTCAAACCGGTCACCGGTTTAATCAGAAATTCTCTTACTGTTTAGTCGACAGATCCGCTTCTTCGAAACCTTCCTCGGTCGTCTTCGGAAACGCCGCCGTATCACGAATCGCGAGATTCACGCCACTTTTGTCAAACCCAAAACTCGACACTTTCTACTACGTCGGGCTTCTGGGAATTAGCGTCGGAGGGACACGTGTCCCCGGCGTAACGGCTTCTCTTTTTAAACTTGACCAGATCGGTAACGGTGGAGTTATTATCGATTCGGGTACGTCTGTGACCCGGTTGATCCGACCAGCTTATATTGCTATGAGAGACGCGTTCCGGGTCGGAGCTAAGACATTGAAAAGAGCTCCGGATTTCTCACTCTTCGACACGTGTTTCGATCTCTCCAATATGAACGAGGTTAAAGTACCGACGGTGGTTTTACATTTCCGTGGAGCTGACGTATCACTTCCGGCGACGAATTACCTGATCCCTGTGGATACCAACGGCAAGTTCTGTTTTGCGTTTGCCGGTACGATGGGCGGACTATCCATAATTGGGAATATCCAGCAACAGGGTTTCCGGGTTGTATACGACTTAGCGAGTTCCCGGGTCGGGTTTGCTCCAGGAGGATGCGCTTAATAATTAGATCTGACCGGAGCCGGTACGGATAATGTACTTTTGTTTTCTCAATTTAATGCTTAGACTTGTTTTTTTTTTTTTTATAAATCGGACAAGTGAATCTTTAAGCGGTGGAGTTGAATACGTGTTGATAAAATCTTCACGTGTTGTCGGCTGTATTATTAGTATCGTCTTTATTTTACATCTCGGACCAAAGAGAGCGTGTATGATTTTCT

SEQ ID NO: 2137 - DNA, 1335 bp, Arabidopsis thaliana
  misc_feature (1)..(1335): Ceres cDNA ID no. 13490502
  misc_feature (1)..(1335): Ceres CLONE  ID no. 24749
  misc_feature (1)..(1335): Also known as  Ceres CDNA ID no. 23369058
acatcttccttgtttcttctctctctctctctcccctcaaacttaaattcacattttaatacttgttacttcaactataataataataataatctttcttcattatatattttcctctcctctcagatcttctctctcaccatcttctcttgagatcaagattgagtattcttgtctcaagaatcgatactcgagagctcttatggaccaaaatggtcataacgacgaagcagaaacagtttcatgcggcaacggcaactgcaaaagcaagatcgtgcctggagatgatcacggtggagatgagagtagtggtaccaagagaaggaagaagagaaaaacgcaacaaaagacaatgaaacgacgtgaattaatgtcgtattgtgagctaccggagtacatgaaagacaacgaatacatattgaattattacagagctgattggtccattagagatgctttcttcagcgtatttagtttccacaatgagtccctcaatgtttggacacatttgattggttttatcttctttgtggcactaaccgtcgccaatattattcatcacgacggattcttccccgtggatgcaaagagtccagggaatgtaacaagatggcccttcttcgttttcttaggaggctcaatgttctgcctactcgcaagcagcatttgtcacctcttctgttgccactcaaaagagcttaatgtcttccttctccgaatagactatgccggtatcaccgccatgatcatcacttccttcttcccaccaatcttctacatcttccagtgcactcctcggtggtacttcatctacctcgcaggcatcacatccatgggaatcttcacaatcatcacacttttcaccccatcactttccgctcccaagtaccgagctttccgcgctttgctctttgcctccatggggctgtttgggattgtcccagctgcccacgcgctagtggtcaattggggaaacccgcaaaggaacgtgacgctcgtgtacgagttgcttatggcagtgttctatcttgttggaacaggattctacgtagggagagtgccagaaaggcttaaaccgggatggtttgatcgtgtgggacatagtcatcagatcttccatgtgttcgttttgttgggtgctttgtctcactatgcagctgctctcttgttcttggactggcgtgaccacgttggttgttaaaccatatatttgtaattcttttaaatataatattattaatttgttgtatcgtggtgaacaaaattgtaataacccatttgttttaaattgaattgtaattcaacttgtgttaattgttatgtttgttgaatacg

SEQ ID NO: 2138 - protein, 1335 aa, Arabidopsis thaliana
  misc_feature: PFam Name: HlyIII; PFam Description: Haemolysin-III related
  misc_feature: GI Number: 51535508; NR Description: putative adiponectin receptor 1 [Oryza sativa (japonica cultivar-group)] >gi|51535474|dbj|BAD37371.1| putative adiponectin receptor 1 [Oryza
  misc_feature: GI Number: 27696972; NR Description: Adipor1-prov protein
  misc_feature: GI Number: 50761224; NR Description: PREDICTED: similar to
  misc_feature: GI Number: 4929559; NR Description: CGI-45 protein [Homo sapiens]
  misc_feature: GI Number: 46485456; NR Description: adiponectin receptor 1 [Rattus norvegicus] >gi|38197440|gb|AAH61838.1| Adiponectin
ACATCTTCCTTGTTTCTTCTCTCTCTCTCTCTCCCCTCAAACTTAAATTCACATTTTAATACTTGTTACTTCAACTATAATAATAATAATAATCTTTCTTCATTATATATTTTCCTCTCCTCTCAGATCTTCTCTCTCACCATCTTCTCTTGAGATCAAGATTGAGTATTCTTGTCTCAAGAATCGATACTCGAGAGCTCTTATGGACCAAAATGGTCATAACGACGAAGCAGAAACAGTTTCATGCGGCAACGGCAACTGCAAAAGCAAGATCGTGCCTGGAGATGATCACGGTGGAGATGAGAGTAGTGGTACCAAGAGAAGGAAGAAGAGAAAAACGCAACAAAAGACAATGAAACGACGTGAATTAATGTCGTATTGTGAGCTACCGGAGTACATGAAAGACAACGAATACATATTGAATTATTACAGAGCTGATTGGTCCATTAGAGATGCTTTCTTCAGCGTATTTAGTTTCCACAATGAGTCCCTCAATGTTTGGACACATTTGATTGGTTTTATCTTCTTTGTGGCACTAACCGTCGCCAATATTATTCATCACGACGGATTCTTCCCCGTGGATGCAAAGAGTCCAGGGAATGTAACAAGATGGCCCTTCTTCGTTTTCTTAGGAGGCTCAATGTTCTGCCTACTCGCAAGCAGCATTTGTCACCTCTTCTGTTGCCACTCAAAAGAGCTTAATGTCTTCCTTCTCCGAATAGACTATGCCGGTATCACCGCCATGATCATCACTTCCTTCTTCCCACCAATCTTCTACATCTTCCAGTGCACTCCTCGGTGGTACTTCATCTACCTCGCAGGCATCACATCCATGGGAATCTTCACAATCATCACACTTTTCACCCCATCACTTTCCGCTCCCAAGTACCGAGCTTTCCGCGCTTTGCTCTTTGCCTCCATGGGGCTGTTTGGGATTGTCCCAGCTGCCCACGCGCTAGTGGTCAATTGGGGAAACCCGCAAAGGAACGTGACGCTCGTGTACGAGTTGCTTATGGCAGTGTTCTATCTTGTTGGAACAGGATTCTACGTAGGGAGAGTGCCAGAAAGGCTTAAACCGGGATGGTTTGATCGTGTGGGACATAGTCATCAGATCTTCCATGTGTTCGTTTTGTTGGGTGCTTTGTCTCACTATGCAGCTGCTCTCTTGTTCTTGGACTGGCGTGACCACGTTGGTTGTTAAACCATATATTTGTAATTCTTTTAAATATAATATTATTAATTTGTTGTATCGTGGTGAACAAAATTGTAATAACCCATTTGTTTTAAATTGAATTGTAATTCAACTTGTGTTAATTGTTATGTTTGTTGAATACG

SEQ ID NO: 2139 - DNA, 1305 bp, Arabidopsis thaliana
  misc_feature (1)..(1305): Ceres cDNA ID no. 13490738
  misc_feature (1)..(1305): Ceres CLONE  ID no. 37170
  misc_feature (1)..(1305): Also known as  Ceres CDNA ID no. 23369809
actcaatccaaactcaacccacaacgctacacattaaaaaataaaaaacctatggcaaccatttccttctctcacaaccaccaatcctccgacaaccgccgtggtggatcccatcaccaccgtcacggccccgtcgtggaagagatcgaaggactcatcaaagttttcaacgacggctgcgtcgaaagacctcccatagttcccatcgtctcaccaaccattcacccatcttctaaagccacagcctttgacatcaaactatccaacgacacatggacacgtgtctacatccccgatgccgcagcagcctcgccgtccgttactctccctctcctcgtttacttccacggcggtggtttctgcgttggctccgccgcttggagttgctaccatgacttcttgaccagccttgccgttaaagcccgttgcgtcatcgtttccgtaaactaccgtttagcccctgaacaccgtctcccggcggcgtacgacgacggcgttaatgtcgtctcgtggctagtcaagcaacaaatatctaccggtggtggatatccttcttggttgagtaaatgtaacctctcaaacgttttcttggccggagatagcgccggagccaacatagcttaccaagtcgccgtaagaatcatggccagtggcaaatacgcaaacactctacacctcaagggcattattctcatccaccctttcttcggcggcgaatcaagaacgtcttcggagaaacaacaacatcacaccaagtcatcggcgcttactctttcagcttccgacgcatattggcgtctagctctgccacgtggagcgagtagagaccatccatggtgtaaccctctgatgagctcggcgggagcgaagttaccgacgacgatggtgttcatggcggagtttgatatactaaaagaacgaaacttggagatgtgtaaagtgatgagaagccatgggaagagagttgaaggtatagttcatggaggtgttggtcacgcttttcatattctcgacaactcgtcggtgtcacgtgatcgaatccacgacatgatgtgtcgtcttcacaacttcatacatccatcataataattccctaaagaccttttttctgaaacctttaattgatttaaaatgttgttcttgaaaaataataagagataaaaacttgaaatgttgtgtttttattgtggattaaagtaagctttgctttgtagtgttttttcagtgaaggtgaatagtataaattatgtaatacaatagatggacttgtacttttaagttaagttatgtatccaatgcttgaat

SEQ ID NO: 2140 - protein, 1305 aa, Arabidopsis thaliana
  misc_feature: PFam Name: Abhydrolase_3; PFam Description: alpha/beta
  misc_feature: PFam Name: COesterase; PFam Description: Carboxylesterase
  misc_feature: GI Number: 21593215; NR Description: unknown [Arabidopsis thaliana]
  misc_feature: GI Number: 50261891; NR Description: AT1G68620 [Arabidopsis
  misc_feature: GI Number: 5487873; NR Description: PrMC3 [Pinus radiata]
  misc_feature: GI Number: 26023941; NR Description: putative serine
  misc_feature: GI Number: 50919067; NR Description: putative esterase [Oryza sativa (japonica cultivar-group)] >gi|27819508|gb|AAO24912.1|
ACTCAATCCAAACTCAACCCACAACGCTACACATTAAAAAATAAAAAACCTATGGCAACCATTTCCTTCTCTCACAACCACCAATCCTCCGACAACCGCCGTGGTGGATCCCATCACCACCGTCACGGCCCCGTCGTGGAAGAGATCGAAGGACTCATCAAAGTTTTCAACGACGGCTGCGTCGAAAGACCTCCCATAGTTCCCATCGTCTCACCAACCATTCACCCATCTTCTAAAGCCACAGCCTTTGACATCAAACTATCCAACGACACATGGACACGTGTCTACATCCCCGATGCCGCAGCAGCCTCGCCGTCCGTTACTCTCCCTCTCCTCGTTTACTTCCACGGCGGTGGTTTCTGCGTTGGCTCCGCCGCTTGGAGTTGCTACCATGACTTCTTGACCAGCCTTGCCGTTAAAGCCCGTTGCGTCATCGTTTCCGTAAACTACCGTTTAGCCCCTGAACACCGTCTCCCGGCGGCGTACGACGACGGCGTTAATGTCGTCTCGTGGCTAGTCAAGCAACAAATATCTACCGGTGGTGGATATCCTTCTTGGTTGAGTAAATGTAACCTCTCAAACGTTTTCTTGGCCGGAGATAGCGCCGGAGCCAACATAGCTTACCAAGTCGCCGTAAGAATCATGGCCAGTGGCAAATACGCAAACACTCTACACCTCAAGGGCATTATTCTCATCCACCCTTTCTTCGGCGGCGAATCAAGAACGTCTTCGGAGAAACAACAACATCACACCAAGTCATCGGCGCTTACTCTTTCAGCTTCCGACGCATATTGGCGTCTAGCTCTGCCACGTGGAGCGAGTAGAGACCATCCATGGTGTAACCCTCTGATGAGCTCGGCGGGAGCGAAGTTACCGACGACGATGGTGTTCATGGCGGAGTTTGATATACTAAAAGAACGAAACTTGGAGATGTGTAAAGTGATGAGAAGCCATGGGAAGAGAGTTGAAGGTATAGTTCATGGAGGTGTTGGTCACGCTTTTCATATTCTCGACAACTCGTCGGTGTCACGTGATCGAATCCACGACATGATGTGTCGTCTTCACAACTTCATACATCCATCATAATAATTCCCTAAAGACCTTTTTTCTGAAACCTTTAATTGATTTAAAATGTTGTTCTTGAAAAATAATAAGAGATAAAAACTTGAAATGTTGTGTTTTTATTGTGGATTAAAGTAAGCTTTGCTTTGTAGTGTTTTTTCAGTGAAGGTGAATAGTATAAATTATGTAATACAATAGATGGACTTGTACTTTTAAGTTAAGTTATGTATCCAATGCTTGAAT

SEQ ID NO: 2141 - DNA, 1565 bp, Arabidopsis thaliana
  misc_feature (1)..(1565): Ceres cDNA ID no. 13490743
  misc_feature (1)..(1565): Ceres CLONE  ID no. 38062
  misc_feature (1)..(1565): Also known as  Ceres CDNA ID no. 23369818
aatttaattcgatttcgacaatttcatttaattcttcgatttctccgcttgtcactgtttcgtatcgccattttctgtttgcatacacttgtatatatttatattaacagtccaaaattcttcgaaattgtcccgagctttgagcatataaaaaatgtcttcgataatccatggagctggagctgctacgacgacgttatcgacgtttaattccgtcgattccaagaaactcttcgttgctccttctcgcacaaatctttcagtgaggagccagagatatatagtggctggatctgatgcgagtaagaagagctttggttctggacttagagttcgtcactctcagaaattgattccaaatgctgttgcgacgaaggaggcggatacgtctgcgagcactggacatgaactattgcttttcgaggctcttcaggaaggtctggaagaagagatggacagagatccacatgtatgtgttatgggtgaagatgttggccattacggaggttcctacaaggtaaccaaaggccttgctgataaatttggtgacctcagggttctcgacactcctatttgtgaaaatgcattcaccggtatgggcattggagctgccatgactggtctaagacccgttattgaaggtatgaacatgggtttcctcctcctcgccttcaaccaaatctccaacaactgtggaatgcttcactacacatccggtggtcagtttacgatcccggttgtcatccgtggacctggtggagtgggacgccagcttggtgctgagcattcacagaggttagaatcttactttcagtccatccctgggatccagatggttgcttgctcaactccttacaacgccaaagggttgatgaaagccgcaataagaagcgagaaccctgtgattctgttcgaacacgtgctgctttacaatctcaaggagaaaatcccggatgaagattacatctgtaaccttgaagaagctgagatggtcagacctggcgagcacattaccatcctcacttactcgcgaatgaggtaccatgtgatgcaggcagcaaaaactctggtgaacaaagggtatgaccccgaggttatcgacatcaggtcactgaaaccgttcgaccttcacacaattggaaactcggtgaagaaaacacatcgggttttgatcgtggaggagtgtatgagaaccggtgggattggggcaagtcttacagctgccatcaacgagaactttcatgactacttagatgctccggtgatgtgtttatcttctcaagacgttcctacaccttacgctggtacactggaggagtggaccgtggttcaaccggctcagatcgtgaccgctgtcgagcagctttgccagtaaattcatatttatccgatgaaccattatttatcatttacctctccatttcctttctctgtagcttagttcttaaagaatttgtctaagatggtttgtttttgttaaagtttgtctcctttgttgtgtcttttaatatggtttgtaactcagaatgtttgtttgttaattttatctcccactttcttttaag

SEQ ID NO: 2142 - protein, 1565 aa, Arabidopsis thaliana
  misc_feature: PFam Name: Transket_pyr; PFam Description: Transketolase,
  misc_feature: PFam Name: Transketolase_C; PFam Description: Transketolase,
  misc_feature: GI Number: 20334776; NR Description: At1g30120/T2H7_8 [Arabidopsis thaliana] >gi|13605515|gb|AAK32751.1| At1g30120/T2H7_8 [Arabidopsis thaliana] >gi|12321636|gb|AAG50862.1| pyruvate dehydrogenase E1 beta
  misc_feature: GI Number: 22416925; NR Description: beta subunit of pyruvate dehydrogenase E1 component [Chaetosphaeridium globosum] >gi|22711921|ref|NP_683783.1| pyruvate dehydrogenase E1 component
  misc_feature: GI Number: 21593379; NR Description: putative pyruvate
  misc_feature: GI Number: 3128205; NR Description: putative pyruvate dehydrogenase E1 beta subunit [Arabidopsis thaliana] >gi|5702375|gb|AAD47282.1| putative pyruvate dehydrogenase beta subunit [Arabidopsis thaliana] >gi|15226781|ref|NP_181006.1|
  misc_feature: GI Number: 2454184; NR Description: pyruvate dehydrogenase E1 beta subunit [Arabidopsis thaliana] >gi|21593321|gb|AAM65270.1| pyruvate dehydrogenase E1 beta subunit, putative [Arabidopsis
AATTTAATTCGATTTCGACAATTTCATTTAATTCTTCGATTTCTCCGCTTGTCACTGTTTCGTATCGCCATTTTCTGTTTGCATACACTTGTATATATTTATATTAACAGTCCAAAATTCTTCGAAATTGTCCCGAGCTTTGAGCATATAAAAAATGTCTTCGATAATCCATGGAGCTGGAGCTGCTACGACGACGTTATCGACGTTTAATTCCGTCGATTCCAAGAAACTCTTCGTTGCTCCTTCTCGCACAAATCTTTCAGTGAGGAGCCAGAGATATATAGTGGCTGGATCTGATGCGAGTAAGAAGAGCTTTGGTTCTGGACTTAGAGTTCGTCACTCTCAGAAATTGATTCCAAATGCTGTTGCGACGAAGGAGGCGGATACGTCTGCGAGCACTGGACATGAACTATTGCTTTTCGAGGCTCTTCAGGAAGGTCTGGAAGAAGAGATGGACAGAGATCCACATGTATGTGTTATGGGTGAAGATGTTGGCCATTACGGAGGTTCCTACAAGGTAACCAAAGGCCTTGCTGATAAATTTGGTGACCTCAGGGTTCTCGACACTCCTATTTGTGAAAATGCATTCACCGGTATGGGCATTGGAGCTGCCATGACTGGTCTAAGACCCGTTATTGAAGGTATGAACATGGGTTTCCTCCTCCTCGCCTTCAACCAAATCTCCAACAACTGTGGAATGCTTCACTACACATCCGGTGGTCAGTTTACGATCCCGGTTGTCATCCGTGGACCTGGTGGAGTGGGACGCCAGCTTGGTGCTGAGCATTCACAGAGGTTAGAATCTTACTTTCAGTCCATCCCTGGGATCCAGATGGTTGCTTGCTCAACTCCTTACAACGCCAAAGGGTTGATGAAAGCCGCAATAAGAAGCGAGAACCCTGTGATTCTGTTCGAACACGTGCTGCTTTACAATCTCAAGGAGAAAATCCCGGATGAAGATTACATCTGTAACCTTGAAGAAGCTGAGATGGTCAGACCTGGCGAGCACATTACCATCCTCACTTACTCGCGAATGAGGTACCATGTGATGCAGGCAGCAAAAACTCTGGTGAACAAAGGGTATGACCCCGAGGTTATCGACATCAGGTCACTGAAACCGTTCGACCTTCACACAATTGGAAACTCGGTGAAGAAAACACATCGGGTTTTGATCGTGGAGGAGTGTATGAGAACCGGTGGGATTGGGGCAAGTCTTACAGCTGCCATCAACGAGAACTTTCATGACTACTTAGATGCTCCGGTGATGTGTTTATCTTCTCAAGACGTTCCTACACCTTACGCTGGTACACTGGAGGAGTGGACCGTGGTTCAACCGGCTCAGATCGTGACCGCTGTCGAGCAGCTTTGCCAGTAAATTCATATTTATCCGATGAACCATTATTTATCATTTACCTCTCCATTTCCTTTCTCTGTAGCTTAGTTCTTAAAGAATTTGTCTAAGATGGTTTGTTTTTGTTAAAGTTTGTCTCCTTTGTTGTGTCTTTTAATATGGTTTGTAACTCAGAATGTTTGTTTGTTAATTTTATCTCCCACTTTCTTTTAAG

SEQ ID NO: 2143 - DNA, 1991 bp, Arabidopsis thaliana
  misc_feature (1)..(1991): Ceres cDNA ID no. 13490832
  misc_feature (1)..(1991): Ceres CLONE  ID no. 21721
  misc_feature (1)..(1991): Also known as  Ceres CDNA ID no. 23370111
gttgtcgccgtcgtcgtttctctcatttctgctctgttgtgctatcgtagcgtcgcgctcctttaaacgcgacggacgcagccttctctgttcatcgtttcgccggaagttttcttcagcggagatttattttcagctggttagtagttttgagtgactactgaggtaacaatggttgtagaaactatcgagaggtcttgtgagggttcaaagagaagacatgtgaacggtggagatatcgctgttccttgttcgggagaagagtgtagcaatggagatataaatgtagctcctggagtttcagcgaaaagagctagggtttctagagaaatgacgtttgaagatatttacggtgctgatgcattactcaatgatgacgatgatgaggatgatgattgtgattgggaacctgtgcaggcgcctatggagtttgtaaaatggtgttgtgtcaattgcactatgtcgaaccctggtgatatggtccactgttgtatatgcggtgagcacaaggaatctggcattttgaggcatggatatttagcgtctcccttttttaaagacactggtctcattgaagtcgaggagaaatatggaggaagctcatctgcaaccagctcgacagctgttgggttcgacgagagaatgttgctacactcagaatttgaagtgaaggcacaaccacatccagagagacctgatcgtcttcgagctatagctgctagtcttgccacagctggtgtttttcctggaagatgcttgcctatcaatgcaagggaaatcacgaaacaagaactccagatggtccacacttcagagcatgttgatgctgttgatactacaagccagcttctctatagctacttcacctctgacacatatgctaatgagtattcagcacgtgctgctagacttgcagcaggtttgtgcactgatctagctacagatattttcactggccgtgtaaaaaatggttttgctttggttagacctcccggtcatcatgctggcgtcaggcatgctatggggttttgccttcacaataatgcagccgttgctgcattagtagcacaagcagcaggggcaaagaaggtgctgattgtggactgggatgtccatcatggcaacgggacccaagagatattcgaacaaaacaaatctgtattgtacatatccttgcacagacatgagggaggaatcttctatcccggtactggagctgctgatgaggttggttctaatggtggggaaggttattgtgtaaatgttccatggagttgcggtggagttggggataaagactatatctttgcgtttcaacatgtggttctccccatagcttctgcattttctccagattttgtcatcatatctgcgggatttgatgcggctagaggagacccactaggatgctgtgatgtgactccggctggctattctcgaatgacacagatgttgggtgatctgtgtggtgggaaaatgctagttattctcgagggcggctacaatcttcgctccatatctgcttctgcaacagcagtgatcaaggtgcttctgggtgaaaatccggagaacgagttgcccatcgccaccacgccttcagtagccggcctgcaaactgttcttgatgtactgaatatccaactggagttctggccatcacttgctatcagctactccaaattactctcagagttggaagcacgtctgatcgaaaacaaaaaaaatcagatgaaaaggaaggttgttcgggttccgacatggtggaaatggggacgaaagaagcttttgtacaactttctctcggctcgtatgatttcaagatcaaagtgattttagaaagcattcttcctaatccgtcgtaggaattgtctacacttacttgtaaccctaactgatctgggggaatttattgcaattagggagctctgaacaatctttatcacttacatttggtagggttttatagaaagaacccttttaacctgcttacc

SEQ ID NO: 2144 - protein, 1991 aa, Arabidopsis thaliana
  misc_feature: PFam Name: Hist_deacetyl; PFam Description: Histone
  misc_feature: GI Number: 22135463; NR Description: histone deacetylase
  misc_feature: GI Number: 22135467; NR Description: histone deacetylase HDA110 isoform 3 [Zea mays] >gi|22135465|gb|AAM93213.1| histone
  misc_feature: GI Number: 22135469; NR Description: histone deacetylase
  misc_feature: GI Number: 18401915; NR Description: histone deacetylase
  misc_feature: GI Number: 30684970; NR Description: histone deacetylase
GTTGTCGCCGTCGTCGTTTCTCTCATTTCTGCTCTGTTGTGCTATCGTAGCGTCGCGCTCCTTTAAACGCGACGGACGCAGCCTTCTCTGTTCATCGTTTCGCCGGAAGTTTTCTTCAGCGGAGATTTATTTTCAGCTGGTTAGTAGTTTTGAGTGACTACTGAGGTAACAATGGTTGTAGAAACTATCGAGAGGTCTTGTGAGGGTTCAAAGAGAAGACATGTGAACGGTGGAGATATCGCTGTTCCTTGTTCGGGAGAAGAGTGTAGCAATGGAGATATAAATGTAGCTCCTGGAGTTTCAGCGAAAAGAGCTAGGGTTTCTAGAGAAATGACGTTTGAAGATATTTACGGTGCTGATGCATTACTCAATGATGACGATGATGAGGATGATGATTGTGATTGGGAACCTGTGCAGGCGCCTATGGAGTTTGTAAAATGGTGTTGTGTCAATTGCACTATGTCGAACCCTGGTGATATGGTCCACTGTTGTATATGCGGTGAGCACAAGGAATCTGGCATTTTGAGGCATGGATATTTAGCGTCTCCCTTTTTTAAAGACACTGGTCTCATTGAAGTCGAGGAGAAATATGGAGGAAGCTCATCTGCAACCAGCTCGACAGCTGTTGGGTTCGACGAGAGAATGTTGCTACACTCAGAATTTGAAGTGAAGGCACAACCACATCCAGAGAGACCTGATCGTCTTCGAGCTATAGCTGCTAGTCTTGCCACAGCTGGTGTTTTTCCTGGAAGATGCTTGCCTATCAATGCAAGGGAAATCACGAAACAAGAACTCCAGATGGTCCACACTTCAGAGCATGTTGATGCTGTTGATACTACAAGCCAGCTTCTCTATAGCTACTTCACCTCTGACACATATGCTAATGAGTATTCAGCACGTGCTGCTAGACTTGCAGCAGGTTTGTGCACTGATCTAGCTACAGATATTTTCACTGGCCGTGTAAAAAATGGTTTTGCTTTGGTTAGACCTCCCGGTCATCATGCTGGCGTCAGGCATGCTATGGGGTTTTGCCTTCACAATAATGCAGCCGTTGCTGCATTAGTAGCACAAGCAGCAGGGGCAAAGAAGGTGCTGATTGTGGACTGGGATGTCCATCATGGCAACGGGACCCAAGAGATATTCGAACAAAACAAATCTGTATTGTACATATCCTTGCACAGACATGAGGGAGGAATCTTCTATCCCGGTACTGGAGCTGCTGATGAGGTTGGTTCTAATGGTGGGGAAGGTTATTGTGTAAATGTTCCATGGAGTTGCGGTGGAGTTGGGGATAAAGACTATATCTTTGCGTTTCAACATGTGGTTCTCCCCATAGCTTCTGCATTTTCTCCAGATTTTGTCATCATATCTGCGGGATTTGATGCGGCTAGAGGAGACCCACTAGGATGCTGTGATGTGACTCCGGCTGGCTATTCTCGAATGACACAGATGTTGGGTGATCTGTGTGGTGGGAAAATGCTAGTTATTCTCGAGGGCGGCTACAATCTTCGCTCCATATCTGCTTCTGCAACAGCAGTGATCAAGGTGCTTCTGGGTGAAAATCCGGAGAACGAGTTGCCCATCGCCACCACGCCTTCAGTAGCCGGCCTGCAAACTGTTCTTGATGTACTGAATATCCAACTGGAGTTCTGGCCATCACTTGCTATCAGCTACTCCAAATTACTCTCAGAGTTGGAAGCACGTCTGATCGAAAACAAAAAAAATCAGATGAAAAGGAAGGTTGTTCGGGTTCCGACATGGTGGAAATGGGGACGAAAGAAGCTTTTGTACAACTTTCTCTCGGCTCGTATGATTTCAAGATCAAAGTGATTTTAGAAAGCATTCTTCCTAATCCGTCGTAGGAATTGTCTACACTTACTTGTAACCCTAACTGATCTGGGGGAATTTATTGCAATTAGGGAGCTCTGAACAATCTTTATCACTTACATTTGGTAGGGTTTTATAGAAAGAACCCTTTTAACCTGCTTACC

SEQ ID NO: 2145 - DNA, 1394 bp, Arabidopsis thaliana
  misc_feature (1)..(1394): Ceres cDNA ID no. 13491017
  misc_feature (1)..(1394): Ceres CLONE  ID no. 253173
  misc_feature (1)..(1394): Also known as  Ceres CDNA ID no. 23370749
atattttcatataaataaacctctcaacctccacactttctcacccatcacacaatcctcaaaacagagtaacccaaaaaacagagcaatctctaaaaaatctcaagaaacctcactaaaatgggttcaacggcagagacacaattaactccggtgcaagtcaccgacgacgaagctgccctcttcgccatgcaactagccagtgcttccgttcttccgatggctttaaaatccgccttagagcttgaccttcttgagattatggccaagaatggttctcccatgtctcctaccgagatcgcttctaaacttccgaccaaaaatcctgaagctccggtcatgctcgaccgtatcctccgtcttcttacgtcttactccgtcttaacctgctccaaccgtaaactttccggtgatggcgttgaacggatttacgggcttggtccggtttgcaagtatttgaccaagaacgaagatggtgtttccattgctgctctttgtcttatgaaccaagacaaggttctcatggaaagctggtaccatttgaaggatgcaattcttgatggtgggattccattcaacaaggcttatggaatgagcgcgttcgagtaccacgggactgaccctagattcaacaaggtctttaacaatggaatgtctaaccattccacaatcaccatgaagaagattcttgagacctataagggttttgaaggattgacttctttggttgatgttggtggtggcattggtgctacactcaaaatgattgtctccaagtaccctaatcttaaaggcatcaactttgatctcccacatgtcatcgaagatgctccttctcatcctggtattgagcatgttggaggagatatgtttgtaagtgtccctaaaggtgatgccatattcatgaagtggatatgtcatgactggagtgacgaacattgcgtgaaattcttgaagaactgctacgagtcacttccagaggatggaaaagtgatattagcagagtgtatacttccagagacaccagactcaagcctctcaaccaaacaagtagtccatgtcgattgcattatgttggctcacaatcccggaggcaaagaacgaaccgagaaagagtttgaggcattagccaaagcatcaggcttcaagggcatcaaagttgtctgcgacgcttttggtgttaaccttattgagttactcaagaagctctaaaaacaaacaatgttcctatgaagatgatttatatgtaaacattatctcatatctccttccacggttccaaaactatgctgtttaataatggtttttacaagaatttgattatgagtttgtatttttgtttgtttggaacaaaattatgtgattatagggaaaaataaaatgagctattattg

SEQ ID NO: 2146 - protein, 1394 aa, Arabidopsis thaliana
  misc_feature: PFam Name: Methyltransf_2; PFam Description: O-methyltransferase
  misc_feature: PFam Name: Dimerisation; PFam Description: Dimerisation domain
  misc_feature: GI Number: 29839288; NR Description: Caffeic acid 3-O-methyltransferase 1 (S-adenosysl-L-methionine:caffeic acid 3-O-methyltransferase 1) (COMT-1) (CAOMT-1) >gi|762870|dbj|BAA08558.1| caffeic acid O-methyltransferase
  misc_feature: GI Number: 444327; NR Description: O-methyltransferase
  misc_feature: GI Number: 2781394; NR Description: O-methyltransferase 1
  misc_feature: GI Number: 21592899; NR Description: O-methyltransferase [Arabidopsis thaliana] >gi|10178165|dbj|BAB11578.1| O-methyltransferase [Arabidopsis thaliana] >gi|20148473|gb|AAM10127.1| O-methyltransferase [Arabidopsis
  misc_feature: GI Number: 6760443; NR Description: O-methyltransferase
ATATTTTCATATAAATAAACCTCTCAACCTCCACACTTTCTCACCCATCACACAATCCTCAAAACAGAGTAACCCAAAAAACAGAGCAATCTCTAAAAAATCTCAAGAAACCTCACTAAAATGGGTTCAACGGCAGAGACACAATTAACTCCGGTGCAAGTCACCGACGACGAAGCTGCCCTCTTCGCCATGCAACTAGCCAGTGCTTCCGTTCTTCCGATGGCTTTAAAATCCGCCTTAGAGCTTGACCTTCTTGAGATTATGGCCAAGAATGGTTCTCCCATGTCTCCTACCGAGATCGCTTCTAAACTTCCGACCAAAAATCCTGAAGCTCCGGTCATGCTCGACCGTATCCTCCGTCTTCTTACGTCTTACTCCGTCTTAACCTGCTCCAACCGTAAACTTTCCGGTGATGGCGTTGAACGGATTTACGGGCTTGGTCCGGTTTGCAAGTATTTGACCAAGAACGAAGATGGTGTTTCCATTGCTGCTCTTTGTCTTATGAACCAAGACAAGGTTCTCATGGAAAGCTGGTACCATTTGAAGGATGCAATTCTTGATGGTGGGATTCCATTCAACAAGGCTTATGGAATGAGCGCGTTCGAGTACCACGGGACTGACCCTAGATTCAACAAGGTCTTTAACAATGGAATGTCTAACCATTCCACAATCACCATGAAGAAGATTCTTGAGACCTATAAGGGTTTTGAAGGATTGACTTCTTTGGTTGATGTTGGTGGTGGCATTGGTGCTACACTCAAAATGATTGTCTCCAAGTACCCTAATCTTAAAGGCATCAACTTTGATCTCCCACATGTCATCGAAGATGCTCCTTCTCATCCTGGTATTGAGCATGTTGGAGGAGATATGTTTGTAAGTGTCCCTAAAGGTGATGCCATATTCATGAAGTGGATATGTCATGACTGGAGTGACGAACATTGCGTGAAATTCTTGAAGAACTGCTACGAGTCACTTCCAGAGGATGGAAAAGTGATATTAGCAGAGTGTATACTTCCAGAGACACCAGACTCAAGCCTCTCAACCAAACAAGTAGTCCATGTCGATTGCATTATGTTGGCTCACAATCCCGGAGGCAAAGAACGAACCGAGAAAGAGTTTGAGGCATTAGCCAAAGCATCAGGCTTCAAGGGCATCAAAGTTGTCTGCGACGCTTTTGGTGTTAACCTTATTGAGTTACTCAAGAAGCTCTAAAAACAAACAATGTTCCTATGAAGATGATTTATATGTAAACATTATCTCATATCTCCTTCCACGGTTCCAAAACTATGCTGTTTAATAATGGTTTTTACAAGAATTTGATTATGAGTTTGTATTTTTGTTTGTTTGGAACAAAATTATGTGATTATAGGGAAAAATAAAATGAGCTATTATTG

SEQ ID NO: 2147 - DNA, 1851 bp, Arabidopsis thaliana
  misc_feature (1)..(1851): Ceres cDNA ID no. 13491315
  misc_feature (1)..(1851): Ceres CLONE  ID no. 232152
  misc_feature (1)..(1851): Also known as  Ceres CDNA ID no. 23371389
ggggtcatacaataaaaattgtgtttcttttttgccctaaaccaaaaatttcatctctcttttccctcttcccgtctctatctctctgagaagcgttttttcggtggagagaaagagagatttgactctgtcaagttattagtacattgaggtcgggctgtcaaaacttgacagcccgagtttgaagcttccaggactctttttctattaatgagattggtatgctagatttggagtgtattggattagattgtggcgatcatgggttctttgtctgggatcattcaacggccacttgttgctgctgctgctgtgattacagcttctgtgtctgcagatgtctctgagaggttctcatctcttagatcactagttcgaggttctgaatcagagcagattgctccttcagtgtctggtttagttcaggaagaaaggtccttgtgggtttctcaagtctcggcctccaagcttgcagatttatcttttgtgtcgaggatttgtgttcctgtaccaaatgttgatctcctagcttctaatcctagctgtagtctcgctacttctgttacttctctgtccgctcttcgtagtgtttatcagtctgcagagttggctaaagcatcgaaaccggttgcattcacaatcggtgcctcacttgtggttcctgatatttcctacagatggcatttacctgagcctagtgcagtcgatatgtctggttcttcgagttgtgtgtctgaaaagaatagaactgttgtggttttgcttggatggcttggatcaaagcagaagcatctgaagaaatatgctgattggtacacttcaaagggttaccatgtcattacatttactcttccgatgaatgagattatgagttatcaagttggagggaaagcagagaagaacatcgagtcgctggttaatcacttggctgattggttggatgaagagcaaaagaaaaatctcgtctttcacaccttcagcaacaccgggtggttaacatatggagccattttggaaaagtttcagaagcaagattcatcattgatgggaagagttaaaggttgcatagtggactcagctcctgttgctgctgcagatcctacggtatgggcatcaggtttctcagctgcgttcttgaagaaaagcagtgtagccactaaaggatctgcgagctcatcatatgagtcaaacggtataaacatctcccagcctaaacccgctgcaacagaaacagctttgcttttggttcttgaaaagttctttgcggtgattctaaatcttcccaaagtaaacaggagacttgccgatgttcttgacacattatcaacagcacaaccaagttgtccacagttatacatttacagctctgcagacagagttataccggtggaacaagttgaatcattcattgtagagcagaggaaagcaggacatgaggtccgtgcttgcaacttcatatcttcacctcatgtagaccatttccggagtaacccagaactgtatacagctgagctcaaccatttcatgaacaactttgtcctttcttgctgccaccattcttcatagcgacttccacaagtgttgttgttgctaaccatttttggggtccttttaactcttatacaagaaagagaaaaatagttactgattgatgattctttttggtttggattggtttatagattcaaattcattattcctttgtaaattgttggatattgtacatttaggagaatgaagattcaagaaagtgacgtccttgtcctttgtagtggagatttggatcttatggttgtcttttgttatttgttcaaagagggttgttaagaacccaatcataaagtttttgcc

SEQ ID NO: 2148 - protein, 1851 aa, Arabidopsis thaliana
  misc_feature: GI Number: 21536700; NR Description: unknown [Arabidopsis thaliana]
  misc_feature: GI Number: 25411844; NR Description: probable integral
  misc_feature: GI Number: 61821811; NR Description: PREDICTED: similar to
  misc_feature: GI Number: 48146813; NR Description: FLJ22353 [Homo sapiens]
  misc_feature: GI Number: 19528521; NR Description: RE54285p [Drosophila
GGGGTCATACAATAAAAATTGTGTTTCTTTTTTGCCCTAAACCAAAAATTTCATCTCTCTTTTCCCTCTTCCCGTCTCTATCTCTCTGAGAAGCGTTTTTTCGGTGGAGAGAAAGAGAGATTTGACTCTGTCAAGTTATTAGTACATTGAGGTCGGGCTGTCAAAACTTGACAGCCCGAGTTTGAAGCTTCCAGGACTCTTTTTCTATTAATGAGATTGGTATGCTAGATTTGGAGTGTATTGGATTAGATTGTGGCGATCATGGGTTCTTTGTCTGGGATCATTCAACGGCCACTTGTTGCTGCTGCTGCTGTGATTACAGCTTCTGTGTCTGCAGATGTCTCTGAGAGGTTCTCATCTCTTAGATCACTAGTTCGAGGTTCTGAATCAGAGCAGATTGCTCCTTCAGTGTCTGGTTTAGTTCAGGAAGAAAGGTCCTTGTGGGTTTCTCAAGTCTCGGCCTCCAAGCTTGCAGATTTATCTTTTGTGTCGAGGATTTGTGTTCCTGTACCAAATGTTGATCTCCTAGCTTCTAATCCTAGCTGTAGTCTCGCTACTTCTGTTACTTCTCTGTCCGCTCTTCGTAGTGTTTATCAGTCTGCAGAGTTGGCTAAAGCATCGAAACCGGTTGCATTCACAATCGGTGCCTCACTTGTGGTTCCTGATATTTCCTACAGATGGCATTTACCTGAGCCTAGTGCAGTCGATATGTCTGGTTCTTCGAGTTGTGTGTCTGAAAAGAATAGAACTGTTGTGGTTTTGCTTGGATGGCTTGGATCAAAGCAGAAGCATCTGAAGAAATATGCTGATTGGTACACTTCAAAGGGTTACCATGTCATTACATTTACTCTTCCGATGAATGAGATTATGAGTTATCAAGTTGGAGGGAAAGCAGAGAAGAACATCGAGTCGCTGGTTAATCACTTGGCTGATTGGTTGGATGAAGAGCAAAAGAAAAATCTCGTCTTTCACACCTTCAGCAACACCGGGTGGTTAACATATGGAGCCATTTTGGAAAAGTTTCAGAAGCAAGATTCATCATTGATGGGAAGAGTTAAAGGTTGCATAGTGGACTCAGCTCCTGTTGCTGCTGCAGATCCTACGGTATGGGCATCAGGTTTCTCAGCTGCGTTCTTGAAGAAAAGCAGTGTAGCCACTAAAGGATCTGCGAGCTCATCATATGAGTCAAACGGTATAAACATCTCCCAGCCTAAACCCGCTGCAACAGAAACAGCTTTGCTTTTGGTTCTTGAAAAGTTCTTTGCGGTGATTCTAAATCTTCCCAAAGTAAACAGGAGACTTGCCGATGTTCTTGACACATTATCAACAGCACAACCAAGTTGTCCACAGTTATACATTTACAGCTCTGCAGACAGAGTTATACCGGTGGAACAAGTTGAATCATTCATTGTAGAGCAGAGGAAAGCAGGACATGAGGTCCGTGCTTGCAACTTCATATCTTCACCTCATGTAGACCATTTCCGGAGTAACCCAGAACTGTATACAGCTGAGCTCAACCATTTCATGAACAACTTTGTCCTTTCTTGCTGCCACCATTCTTCATAGCGACTTCCACAAGTGTTGTTGTTGCTAACCATTTTTGGGGTCCTTTTAACTCTTATACAAGAAAGAGAAAAATAGTTACTGATTGATGATTCTTTTTGGTTTGGATTGGTTTATAGATTCAAATTCATTATTCCTTTGTAAATTGTTGGATATTGTACATTTAGGAGAATGAAGATTCAAGAAAGTGACGTCCTTGTCCTTTGTAGTGGAGATTTGGATCTTATGGTTGTCTTTTGTTATTTGTTCAAAGAGGGTTGTTAAGAACCCAATCATAAAGTTTTTGCC

SEQ ID NO: 2149 - DNA, 1148 bp, Arabidopsis thaliana
  misc_feature (1)..(1148): Ceres cDNA ID no. 13491548
  misc_feature (1)..(1148): Ceres CLONE  ID no. 19156
  misc_feature (1)..(1148): Also known as  Ceres CDNA ID no. 23372099
aaaaatctctcccccttcttctctcttcctcacattcctcaccaaaccctctccaaaacacacccacacgtacgcacacacacaaagacaatgtctcctttcaaaatattcttcttcacgactcttctcgtggcggcgttttcagtgtcggctgctgatttcaacactgacgtcaacgtagcttggggaaatggccgtgggaagatactcaacaacggccagcttcttactctctccttagacaaatcctctggttccggttttcaatccaaaacagagtatttgtttggaaagattgatatgcagattaagcttgttcctggtaactctgcaggaacagtcacaactttttacctaaaatccgaaggatccacttgggatgagattgattttgagttcttgggtaatatgagtggagatccttatactttacacactaatgtttacactcaaggtaaaggtgacaaagagcaacaattccatctctggttcgacccaaccgccaatttccacacttactcaatcctctggaaccctcaaagaatcatattgaccgtcgatgacacacccattagagagtttaaaaactatgagtctctcggtgtcttgtttccaaagaacaagccgatgaggatgtacgcgagtttatggaacgcagacgattgggcaacaagaggcggtcttgttaaaactgattggtctaaagctccattcatggcttcttacagaaacattaagattgactcgaaaccaaactccaattggtacactcaagaaatggattcaacaagccaagctagactcaaatgggttcagaagaattacatgatctacaattattgtactgaccataggaggtttccacagggagctcctaaggaatgcacaacaagctcatagaatctcaaattatattctatttatttatctacacttcctctctttcttttatgtgaaaattgtgaatgctctgtttctagcttgtctattatgtccgagaatttctttttctgtttttgattcttttcgttgtatatctttgtccaataaaggaaatgatgtgtctttactcttatagatatgtataaaaagatgtccctgttttatttgttaaaaaaaattgtttatgataatgatagttctttctc

SEQ ID NO: 2150 - protein, 1148 aa, Arabidopsis thaliana
  misc_feature: PFam Name: Glyco_hydro_16; PFam Description: Glycosyl
  misc_feature: PFam Name: XET_C; PFam Description: Xyloglucan
  misc_feature: GI Number: 17104625; NR Description: putative xyloglucan endo-1,4-beta-D-glucanase precursor [Arabidopsis thaliana] >gi|14334966|gb|AAK59660.1| putative xyloglucan endo-1,4-beta-D-glucanase precursor [Arabidopsis thaliana]
  misc_feature: GI Number: 21553999; NR Description: xyloglucan
  misc_feature: GI Number: 9758317; NR Description: TCH4 protein [Arabidopsis thaliana] >gi|17386136|gb|AAL38614.1| AT5g57560/MUA2_13 [Arabidopsis thaliana] >gi|15777883|gb|AAL05902.1| AT5g57560/MUA2_13 [Arabidopsis thaliana]
  misc_feature: GI Number: 29500899; NR Description: putative xyloglucan endotransglycosylase [Cucumis sativus] >gi|29500891|emb|CAD87535.1|
  misc_feature: GI Number: 29500901; NR Description: putative xyloglucan endotransglycosylase [Cucumis sativus] >gi|29500893|emb|CAD87536.1|
AAAAATCTCTCCCCCTTCTTCTCTCTTCCTCACATTCCTCACCAAACCCTCTCCAAAACACACCCACACGTACGCACACACACAAAGACAATGTCTCCTTTCAAAATATTCTTCTTCACGACTCTTCTCGTGGCGGCGTTTTCAGTGTCGGCTGCTGATTTCAACACTGACGTCAACGTAGCTTGGGGAAATGGCCGTGGGAAGATACTCAACAACGGCCAGCTTCTTACTCTCTCCTTAGACAAATCCTCTGGTTCCGGTTTTCAATCCAAAACAGAGTATTTGTTTGGAAAGATTGATATGCAGATTAAGCTTGTTCCTGGTAACTCTGCAGGAACAGTCACAACTTTTTACCTAAAATCCGAAGGATCCACTTGGGATGAGATTGATTTTGAGTTCTTGGGTAATATGAGTGGAGATCCTTATACTTTACACACTAATGTTTACACTCAAGGTAAAGGTGACAAAGAGCAACAATTCCATCTCTGGTTCGACCCAACCGCCAATTTCCACACTTACTCAATCCTCTGGAACCCTCAAAGAATCATATTGACCGTCGATGACACACCCATTAGAGAGTTTAAAAACTATGAGTCTCTCGGTGTCTTGTTTCCAAAGAACAAGCCGATGAGGATGTACGCGAGTTTATGGAACGCAGACGATTGGGCAACAAGAGGCGGTCTTGTTAAAACTGATTGGTCTAAAGCTCCATTCATGGCTTCTTACAGAAACATTAAGATTGACTCGAAACCAAACTCCAATTGGTACACTCAAGAAATGGATTCAACAAGCCAAGCTAGACTCAAATGGGTTCAGAAGAATTACATGATCTACAATTATTGTACTGACCATAGGAGGTTTCCACAGGGAGCTCCTAAGGAATGCACAACAAGCTCATAGAATCTCAAATTATATTCTATTTATTTATCTACACTTCCTCTCTTTCTTTTATGTGAAAATTGTGAATGCTCTGTTTCTAGCTTGTCTATTATGTCCGAGAATTTCTTTTTCTGTTTTTGATTCTTTTCGTTGTATATCTTTGTCCAATAAAGGAAATGATGTGTCTTTACTCTTATAGATATGTATAAAAAGATGTCCCTGTTTTATTTGTTAAAAAAAATTGTTTATGATAATGATAGTTCTTTCTC

SEQ ID NO: 2151 - DNA, 1302 bp, Arabidopsis thaliana
  misc_feature (1)..(1302): Ceres cDNA ID no. 13491936
  misc_feature (1)..(1302): Ceres CLONE  ID no. 34690
  misc_feature (1)..(1302): Also known as  Ceres CDNA ID no. 23373382
gtcttggcatcctcgtcctcttcagcaaaactcgtctctcttgcactccaaaaagcaaccatgtctgcttttgtcggcaaatacgcagatgagctgataaagacggctaagtacattgccacaccgggaaagggcattttggcagcagacgagagcacgggaactattgggaaacgattcgccagcatcaatgttgagaacattgagtccaaccgccaagctctccgtgagctcctcttcacgtcccctggcactttcccttgcctctccggtgttatcctcttcgaggaaaccctctaccagaaaaccacggatggcaaacccttcgttgagctcctcatggaaaacggagttatccctggaatcaaagtggacaagggtgtggttgatctagcaggaaccaatggcgagaccactactcagggtctagattcacttggtgcacgttgccaggagtattacaaggcaggagctcggtttgcaaaatggcgtgcagtcctcaagattggggccaccgagccaagcgagctctctatccaagagaacgccaaggggctagcccgctatgccatcatctgccaggagaatggactcgtcccaatcgtcgagccagaggtactgaccgacgggagccatgacatcaagaaatgtgcagcggtgaccgagaccgttcttgctgccgtgtacaaggccttgaacgaccaccatgtcctcctcgaaggcactctgcttaaaccgaacatggtcactcccggctctgacagcccaaaggttgcaccggaagtgatagcggaatacacagtgactgctctgcgccgcacagtcccacctgcagttccaggaatcgtgttcctctcaggcggacagagtgaagaggaagcaacactaaatctgaacgcaatgaacaagctcgatgtgttgaagccatggactctcactttctcatttggccgagccctccaacaaagcactctcaaggcttgggcaggtaagacagagaatgtagccaaagctcaggccactttcctgaccaggtgcaagggtaactcggacgctaccctcgggaaatacaccggcggggcttctggtgactcggccgcctctgagagcttgtatgaggaaggatacaagtattaggagcgtttaaatacgggtgtcgccttttatacgatttgaatatatgtcaaatgtttcgtaggcgtttaactgtttaaatttttatcgatttggtttagcgtctgtgtaatgttcttaaactgtgttgtgttttttgtgatggtttctataatattttcgcgccat

SEQ ID NO: 2152 - protein, 1302 aa, Arabidopsis thaliana
  misc_feature: PFam Name: Glycolytic; PFam Description:
  misc_feature: GI Number: 31711854; NR Description: At4g26530 [Arabidopsis thaliana] >gi|21592977|gb|AAM64926.1| fructose-bisphosphate aldolase-like protein [Arabidopsis thaliana] >gi|7269505|emb|CAB79508.1| fructose-bisphosphate aldolase-like
  misc_feature: GI Number: 40362980; NR Description: fructose 1,6,
  misc_feature: GI Number: 16284; NR Description: fructose 1,6-diphosphate aldolase [Arabidopsis thaliana] >gi|113617|sp|P22197|ALF_ARATH Fructose-bisphosphate aldolase, cytoplasmic isozyme >gi|68199|pir||ADMU fructose-bisphosphate aldolase (EC 4.1.2.13)
  misc_feature: GI Number: 927507; NR Description: fructose-1,6-bisphosphate aldolase [Pisum sativum] >gi|2118268|pir||S58168 fructose-bisphosphate aldolase (EC 4.1.2.13) - garden pea >gi|1168408|sp|P46256|ALF1_PEA Fructose-bisphosphate aldolase,
  misc_feature: GI Number: 2213867; NR Description: fructose-biphosphate aldolase [Mesembryanthemum crystallinum] >gi|7436609|pir||T12416 fructose-bisphosphate aldolase (EC 4.1.2.13), cytosolic - common
GTCTTGGCATCCTCGTCCTCTTCAGCAAAACTCGTCTCTCTTGCACTCCAAAAAGCAACCATGTCTGCTTTTGTCGGCAAATACGCAGATGAGCTGATAAAGACGGCTAAGTACATTGCCACACCGGGAAAGGGCATTTTGGCAGCAGACGAGAGCACGGGAACTATTGGGAAACGATTCGCCAGCATCAATGTTGAGAACATTGAGTCCAACCGCCAAGCTCTCCGTGAGCTCCTCTTCACGTCCCCTGGCACTTTCCCTTGCCTCTCCGGTGTTATCCTCTTCGAGGAAACCCTCTACCAGAAAACCACGGATGGCAAACCCTTCGTTGAGCTCCTCATGGAAAACGGAGTTATCCCTGGAATCAAAGTGGACAAGGGTGTGGTTGATCTAGCAGGAACCAATGGCGAGACCACTACTCAGGGTCTAGATTCACTTGGTGCACGTTGCCAGGAGTATTACAAGGCAGGAGCTCGGTTTGCAAAATGGCGTGCAGTCCTCAAGATTGGGGCCACCGAGCCAAGCGAGCTCTCTATCCAAGAGAACGCCAAGGGGCTAGCCCGCTATGCCATCATCTGCCAGGAGAATGGACTCGTCCCAATCGTCGAGCCAGAGGTACTGACCGACGGGAGCCATGACATCAAGAAATGTGCAGCGGTGACCGAGACCGTTCTTGCTGCCGTGTACAAGGCCTTGAACGACCACCATGTCCTCCTCGAAGGCACTCTGCTTAAACCGAACATGGTCACTCCCGGCTCTGACAGCCCAAAGGTTGCACCGGAAGTGATAGCGGAATACACAGTGACTGCTCTGCGCCGCACAGTCCCACCTGCAGTTCCAGGAATCGTGTTCCTCTCAGGCGGACAGAGTGAAGAGGAAGCAACACTAAATCTGAACGCAATGAACAAGCTCGATGTGTTGAAGCCATGGACTCTCACTTTCTCATTTGGCCGAGCCCTCCAACAAAGCACTCTCAAGGCTTGGGCAGGTAAGACAGAGAATGTAGCCAAAGCTCAGGCCACTTTCCTGACCAGGTGCAAGGGTAACTCGGACGCTACCCTCGGGAAATACACCGGCGGGGCTTCTGGTGACTCGGCCGCCTCTGAGAGCTTGTATGAGGAAGGATACAAGTATTAGGAGCGTTTAAATACGGGTGTCGCCTTTTATACGATTTGAATATATGTCAAATGTTTCGTAGGCGTTTAACTGTTTAAATTTTTATCGATTTGGTTTAGCGTCTGTGTAATGTTCTTAAACTGTGTTGTGTTTTTTGTGATGGTTTCTATAATATTTTCGCGCCAT

SEQ ID NO: 2153 - DNA, 1369 bp, Arabidopsis thaliana
  misc_feature (1)..(1369): Ceres cDNA ID no. 13491972
  misc_feature (1)..(1369): Ceres CLONE  ID no. 33020
  misc_feature (1)..(1369): Also known as  Ceres CDNA ID no. 23373497
atcatccgcggttcacttccttcgtttcgaaattattagggttactgcgtatttgcactctccttcttcgtctctccagcttgacaatgcctcgctatgatgatcgctatggaaacactcgcctctatgttggtcgcttatcatctagaactcgtaccagagaccttgagcgtctctttagcagatacggaaggtttctgggggtttgcctaacctggagatgtttgatgaatgggtggactgtggtgtaattggtggaaattctcgtctggtgtatagagggtgcatcggcgattttgtttgttgatttattgcatgtttttattggaaatggcctcaaatctcaaaaactggtgtttggaagttccttaagtaatgatggccttgattttctggcaacaatttacgcagagtacgagatgtggatatgaagcgtgattatgcctttgttgaatttagtgatcctcgtgatgctgatgacgcaagatattacttggatggacgggatttcgatggaagtcgcatcactgtggaggcatcaagaggggctcctcgtggttcgcgggacaatggtagcagaggcccacctcctggttctggtcgctgttttaattgtggtgtcgatggccactgggcccgagactgcacagcaggagactggaagaataaatgttaccgctgtggtgaaagaggacacattgagagaaactgcaaaaacagtcctagtccaaagaaggccaggcagggtggaagctattccaggtcaccagtcaaatcccgctcccctcgtcgccgaaggagcccaagccgtagccgtagttacagtcgaggtcgcagctacagtcgatcgcgatccccagtgagaagagagaaaagcgtggaggacagatcacgcagtcctaaggcaatggagcgatctgtatctcccaaaggtagggaccaaagcctgagtccagaccgaaaagtgatagatgcaagcccaaagcgtggatcagactatgatggtagcccaaaagagaatggtaatggcaggaactctgcgagtcccattgttggaggtggtgaaagtcctgttggacttaatggtcaagacaggagcccgattgatgatgaggctgagcttagccgtccttcccctaaaggcagtgagtcaccttgatggttcacaggttaaaagctctatgtagcattctgtactgaaggatgttgtttcctttccctttctttctgcgtgatacttttcttttcgttgcgtgacaatcctggatgttactttgccttctctcttgatgactcttggtttgttttccgacaactttcaaactctgcgatgttacttttcattgtttagtaagaatcatgcatttat

SEQ ID NO: 2154 - protein, 1369 aa, Arabidopsis thaliana
  misc_feature: PFam Name: RRM_1; PFam Description: RNA recognition motif.
  misc_feature: PFam Name: zf-CCHC; PFam Description: Zinc knuckle
  misc_feature: GI Number: 24111329; NR Description: At3g53500/F4P12_200 [Arabidopsis thaliana] >gi|20465265|gb|AAM19952.1| AT3g53500/F4P12_200 [Arabidopsis thaliana] >gi|30693836|ref|NP_851015.1| zinc knuckle (CCHC-type) family
  misc_feature: GI Number: 11346381; NR Description: splicing factor-like
  misc_feature: GI Number: 9795142; NR Description: splicing factor-like protein [Arabidopsis thaliana] >gi|30693839|ref|NP_190918.3| zinc
  misc_feature: GI Number: 9843663; NR Description: splicing factor RSZ33
  misc_feature: GI Number: 42571091; NR Description: splicing factor RSZ33
ATCATCCGCGGTTCACTTCCTTCGTTTCGAAATTATTAGGGTTACTGCGTATTTGCACTCTCCTTCTTCGTCTCTCCAGCTTGACAATGCCTCGCTATGATGATCGCTATGGAAACACTCGCCTCTATGTTGGTCGCTTATCATCTAGAACTCGTACCAGAGACCTTGAGCGTCTCTTTAGCAGATACGGAAGGTTTCTGGGGGTTTGCCTAACCTGGAGATGTTTGATGAATGGGTGGACTGTGGTGTAATTGGTGGAAATTCTCGTCTGGTGTATAGAGGGTGCATCGGCGATTTTGTTTGTTGATTTATTGCATGTTTTTATTGGAAATGGCCTCAAATCTCAAAAACTGGTGTTTGGAAGTTCCTTAAGTAATGATGGCCTTGATTTTCTGGCAACAATTTACGCAGAGTACGAGATGTGGATATGAAGCGTGATTATGCCTTTGTTGAATTTAGTGATCCTCGTGATGCTGATGACGCAAGATATTACTTGGATGGACGGGATTTCGATGGAAGTCGCATCACTGTGGAGGCATCAAGAGGGGCTCCTCGTGGTTCGCGGGACAATGGTAGCAGAGGCCCACCTCCTGGTTCTGGTCGCTGTTTTAATTGTGGTGTCGATGGCCACTGGGCCCGAGACTGCACAGCAGGAGACTGGAAGAATAAATGTTACCGCTGTGGTGAAAGAGGACACATTGAGAGAAACTGCAAAAACAGTCCTAGTCCAAAGAAGGCCAGGCAGGGTGGAAGCTATTCCAGGTCACCAGTCAAATCCCGCTCCCCTCGTCGCCGAAGGAGCCCAAGCCGTAGCCGTAGTTACAGTCGAGGTCGCAGCTACAGTCGATCGCGATCCCCAGTGAGAAGAGAGAAAAGCGTGGAGGACAGATCACGCAGTCCTAAGGCAATGGAGCGATCTGTATCTCCCAAAGGTAGGGACCAAAGCCTGAGTCCAGACCGAAAAGTGATAGATGCAAGCCCAAAGCGTGGATCAGACTATGATGGTAGCCCAAAAGAGAATGGTAATGGCAGGAACTCTGCGAGTCCCATTGTTGGAGGTGGTGAAAGTCCTGTTGGACTTAATGGTCAAGACAGGAGCCCGATTGATGATGAGGCTGAGCTTAGCCGTCCTTCCCCTAAAGGCAGTGAGTCACCTTGATGGTTCACAGGTTAAAAGCTCTATGTAGCATTCTGTACTGAAGGATGTTGTTTCCTTTCCCTTTCTTTCTGCGTGATACTTTTCTTTTCGTTGCGTGACAATCCTGGATGTTACTTTGCCTTCTCTCTTGATGACTCTTGGTTTGTTTTCCGACAACTTTCAAACTCTGCGATGTTACTTTTCATTGTTTAGTAAGAATCATGCATTTAT

SEQ ID NO: 2155 - DNA, 1534 bp, Zea mays
  misc_feature (1)..(1534): Ceres cDNA ID no. 13492041
  misc_feature (1)..(1534): Ceres CLONE  ID no. 220862
  misc_feature (1)..(1534): Also known as  Ceres CDNA ID no. 23764425
tccaaattccccggtcacctacctcctctgccctctcactctcagatccgcgtcctcggctcctcctcctcctcctcctcctcccttccttcgttccttccagatctccctcccagtcgagagtcgagatccaccgcctccgcgccccctcaccggtgcagcgcgaggaagcggggggccagaggccagccatgggcaaggaaggggccagcgacggcggcatgtcggagtcggtgatccgcaaggtcctggtctcgtacatgtacgtggcggtgtggatcttcctctccttctccgtgatcgtctacaacaagtacatcctcgaccccaagatgtacaactggcccttccccatctccctcaccatggtgcacatggccttctgctcctccctcgccgtggcgctcgtccgcgtcctccgcgtcgtcgacctcccgtcctcgcccgccatgacgtcgcagctctacgtctcctccgtgctccctatcggcgcgctctactcgctctcgctctggttctccaactccgcctacatctacctctccgtctccttcatccagatgctcaaggcgctcatgcccgtcgccgtctactccatcggggtcctcttcaagaaggagaccttcaagtcctccgccatgctcaacatgctctccatctcgttcggcgtcgccatcgccgcctacggagaggcccgcttcgacgcccgcggcgtcgccctgcagctcgccgccgtcgccttcgaggccacgcgcctcgtcctcatccagatcctcctcacctccaagggcatctccctcaaccccatcacctcgctctactacgtcgcgccctgctgcctcgctttcctcgtcgtgccctgggtcttcgtcgagctgcccaggctgcgcgccgtcggcatcttccagccggacctcttcgtcttcggcaccaactccctctgcgccttcgcgctcaacctcgccgtcttcctgctcgtcggcaagacgtcggctctcaccatgaacgtcgccggcgtcgtcaaggactggctgctcatcgccttctcctggtccgtcatccgcgacaccgtcacccccatcaacctcttcggctacgggatcgccttcctcggggtgggatactacaaccacgtcaagctgcaggcgctcaaggccaaggaggcgcagaagaaggcgacgcaggccgacgaggaggccgggtcgctgctgcaggagcgcgactcgcacggcgaccgcaagactgacaaccaggcctagcgagtgtgccggatctcatgatccaattcgctcggttctgaacccagtgtactccaaatatgtgatccaacccttacacgtttgatgcaaaatttgttcatttcttgtctttgacttgatctggtggtaccaaggaaataagcacgggaaagatgcaagctttgtgtcgaacatgtgaaaaaaaatatatatgtatgagcaattttttgtcttttttttggggccagttgtagctgttactaccattaaacagtaagcaaaactgtttgcatttt

SEQ ID NO: 2156 - protein, 1534 aa, Zea mays
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: PFam Name: Atrophin-1; PFam Description: Atrophin-1 family
  misc_feature: PFam Name: MAGE; PFam Description: MAGE family
  misc_feature: GI Number: 34908982; NR Description: P0003D09.29 [Oryza sativa (japonica cultivar-group)] >gi|19571007|dbj|BAB86434.1| P0003D09.29 [Oryza sativa (japonica cultivar-group)] >gi|20804546|dbj|BAB92238.1| similar to
  misc_feature: GI Number: 18420914; NR Description: phosphate
  misc_feature: GI Number: 61651606; NR Description: plastidic phosphate
  misc_feature: GI Number: 15810281; NR Description: putative phosphate/phosphoenolpyruvate translocator protein [Arabidopsis thaliana] >gi|4432863|gb|AAD20711.1| putative phosphate/phosphoenolpyruvate translocator protein [Arabidopsis
  misc_feature: GI Number: 15221115; NR Description: phosphate
TCCAAATTCCCCGGTCACCTACCTCCTCTGCCCTCTCACTCTCAGATCCGCGTCCTCGGCTCCTCCTCCTCCTCCTCCTCCTCCCTTCCTTCGTTCCTTCCAGATCTCCCTCCCAGTCGAGAGTCGAGATCCACCGCCTCCGCGCCCCCTCACCGGTGCAGCGCGAGGAAGCGGGGGGCCAGAGGCCAGCCATGGGCAAGGAAGGGGCCAGCGACGGCGGCATGTCGGAGTCGGTGATCCGCAAGGTCCTGGTCTCGTACATGTACGTGGCGGTGTGGATCTTCCTCTCCTTCTCCGTGATCGTCTACAACAAGTACATCCTCGACCCCAAGATGTACAACTGGCCCTTCCCCATCTCCCTCACCATGGTGCACATGGCCTTCTGCTCCTCCCTCGCCGTGGCGCTCGTCCGCGTCCTCCGCGTCGTCGACCTCCCGTCCTCGCCCGCCATGACGTCGCAGCTCTACGTCTCCTCCGTGCTCCCTATCGGCGCGCTCTACTCGCTCTCGCTCTGGTTCTCCAACTCCGCCTACATCTACCTCTCCGTCTCCTTCATCCAGATGCTCAAGGCGCTCATGCCCGTCGCCGTCTACTCCATCGGGGTCCTCTTCAAGAAGGAGACCTTCAAGTCCTCCGCCATGCTCAACATGCTCTCCATCTCGTTCGGCGTCGCCATCGCCGCCTACGGAGAGGCCCGCTTCGACGCCCGCGGCGTCGCCCTGCAGCTCGCCGCCGTCGCCTTCGAGGCCACGCGCCTCGTCCTCATCCAGATCCTCCTCACCTCCAAGGGCATCTCCCTCAACCCCATCACCTCGCTCTACTACGTCGCGCCCTGCTGCCTCGCTTTCCTCGTCGTGCCCTGGGTCTTCGTCGAGCTGCCCAGGCTGCGCGCCGTCGGCATCTTCCAGCCGGACCTCTTCGTCTTCGGCACCAACTCCCTCTGCGCCTTCGCGCTCAACCTCGCCGTCTTCCTGCTCGTCGGCAAGACGTCGGCTCTCACCATGAACGTCGCCGGCGTCGTCAAGGACTGGCTGCTCATCGCCTTCTCCTGGTCCGTCATCCGCGACACCGTCACCCCCATCAACCTCTTCGGCTACGGGATCGCCTTCCTCGGGGTGGGATACTACAACCACGTCAAGCTGCAGGCGCTCAAGGCCAAGGAGGCGCAGAAGAAGGCGACGCAGGCCGACGAGGAGGCCGGGTCGCTGCTGCAGGAGCGCGACTCGCACGGCGACCGCAAGACTGACAACCAGGCCTAGCGAGTGTGCCGGATCTCATGATCCAATTCGCTCGGTTCTGAACCCAGTGTACTCCAAATATGTGATCCAACCCTTACACGTTTGATGCAAAATTTGTTCATTTCTTGTCTTTGACTTGATCTGGTGGTACCAAGGAAATAAGCACGGGAAAGATGCAAGCTTTGTGTCGAACATGTGAAAAAAAATATATATGTATGAGCAATTTTTTGTCTTTTTTTTGGGGCCAGTTGTAGCTGTTACTACCATTAAACAGTAAGCAAAACTGTTTGCATTTT

SEQ ID NO: 2157 - DNA, 1550 bp, Arabidopsis thaliana
  misc_feature (1)..(1550): Ceres cDNA ID no. 13492477
  misc_feature (1)..(1550): Ceres CLONE  ID no. 100072
  misc_feature (1)..(1550): Also known as  Ceres CDNA ID no. 23374286
actttcttcttcgattagccacttttttttcttttgtaattttcctttcttttttttttcttttgaattttcgggaagcagcatttccactggagctgcaaaatcttcctatcaaaattatagatcgatccaagttttagattcgagaatcattttctccaaattagatttatatatcaaaaggaatcgaaaatagacagcaatttttgttttgtcggatcgtattgaatcagctgtgaattttagcgccaatttaaccactgaatcgtttgattagaagctaagatttggtcttacgatcgatctaagtagggttcttcttcttaagtgtgtgttttgttaaaattagtaaagagagatggagaagaagaaagtcgcgactccgctagtgtgccatggccattcgagacctgttgtggatttgttctacagtccaatcactcctgatggtttcttcctcatcagcgcaagtaaagattctcaaccaatgttgagaaatggggaaactggagattggattggtacatttgaaggtcataaaggtgctgtgtggagttcttgtcttgataacaatgctttacgtgcagcttctgcatctgctgatttttcagcgaagctttgggatgctttgactggggatgtcttgcattcttttgagcacaagcatattgttcgagcatgcgccttctctcaggatacgaaatatctaatcacaggaggatttgagaaaattcttcgtgttttcgacttgaatcgcttggatgcacctcctacagaaattgataaatctcctggttctatcagaacactaacatggcttcacggtgatcaaacaatattaagttcttgcactgatattggtggtgtgaggttatgggatgtgaggagtggcaaaatagtgcaaactctagaaaccaagtctcctgtcaccagtgctgaagtgagtcaagatggacggtatataacaactgccgatgggtcaactgttaaattttgggatgcaaatcattttggactagtgaaaagttacgacatgccctgcaatatcgaatctgcatcgcttgagccaaaatctggcaacaaattcgttgctggtggagaagatatgtgggttcgactctttgatttccacaccggaaaggagattggatgcaacaagggacatcatggtccggttcactgtgtgagatttgcaccaacaggtgagtcttatgcttcagggtctgaagatggtacaatcagaatttggcaaactggaccggtgaatcctgaagagatcagcgagtcaaagccgaagcagagtgtggatgaggttgctcgtaagattgaaggctttcacattaacaaggaaggaaaaaccgcagagaaaccatctgatgcttaaaccaagaaaagaaccaagaaaaatggctgcttctctttgtcttcttactgtgtttttacttccagactgaatatacggaaattcaaaacaagtgtttgaaaaacagtcgttgtcaatcttcattcgagtcaagtttatggatgtggctgaaaatttacgaattaat

SEQ ID NO: 2158 - protein, 1550 aa, Arabidopsis thaliana
  misc_feature: PFam Name: WD40; PFam Description: WD domain, G-beta repeat
  misc_feature: GI Number: 30725304; NR Description: At1g52730 [Arabidopsis thaliana] >gi|5903032|gb|AAD55591.1| Similar to gb|AJ010025 unr-interacting protein from Homo sapiens and contains 3 PF|00400
  misc_feature: GI Number: 50725469; NR Description: putative WD-40 repeat
  misc_feature: GI Number: 50906147; NR Description: putative serine-threonine kinase receptor-associated protein [Oryza sativa (japonica cultivar-group)] >gi|51536270|dbj|BAD38438.1| putative serine-threonine kinase receptor-associated protein [Oryza sativa
  misc_feature: GI Number: 41053501; NR Description: serine/threonine kinase receptor associated protein [Danio rerio] >gi|41107550|gb|AAH65428.1| Serine/threonine kinase receptor
  misc_feature: GI Number: 48122105; NR Description: similar to
ACTTTCTTCTTCGATTAGCCACTTTTTTTTCTTTTGTAATTTTCCTTTCTTTTTTTTTTCTTTTGAATTTTCGGGAAGCAGCATTTCCACTGGAGCTGCAAAATCTTCCTATCAAAATTATAGATCGATCCAAGTTTTAGATTCGAGAATCATTTTCTCCAAATTAGATTTATATATCAAAAGGAATCGAAAATAGACAGCAATTTTTGTTTTGTCGGATCGTATTGAATCAGCTGTGAATTTTAGCGCCAATTTAACCACTGAATCGTTTGATTAGAAGCTAAGATTTGGTCTTACGATCGATCTAAGTAGGGTTCTTCTTCTTAAGTGTGTGTTTTGTTAAAATTAGTAAAGAGAGATGGAGAAGAAGAAAGTCGCGACTCCGCTAGTGTGCCATGGCCATTCGAGACCTGTTGTGGATTTGTTCTACAGTCCAATCACTCCTGATGGTTTCTTCCTCATCAGCGCAAGTAAAGATTCTCAACCAATGTTGAGAAATGGGGAAACTGGAGATTGGATTGGTACATTTGAAGGTCATAAAGGTGCTGTGTGGAGTTCTTGTCTTGATAACAATGCTTTACGTGCAGCTTCTGCATCTGCTGATTTTTCAGCGAAGCTTTGGGATGCTTTGACTGGGGATGTCTTGCATTCTTTTGAGCACAAGCATATTGTTCGAGCATGCGCCTTCTCTCAGGATACGAAATATCTAATCACAGGAGGATTTGAGAAAATTCTTCGTGTTTTCGACTTGAATCGCTTGGATGCACCTCCTACAGAAATTGATAAATCTCCTGGTTCTATCAGAACACTAACATGGCTTCACGGTGATCAAACAATATTAAGTTCTTGCACTGATATTGGTGGTGTGAGGTTATGGGATGTGAGGAGTGGCAAAATAGTGCAAACTCTAGAAACCAAGTCTCCTGTCACCAGTGCTGAAGTGAGTCAAGATGGACGGTATATAACAACTGCCGATGGGTCAACTGTTAAATTTTGGGATGCAAATCATTTTGGACTAGTGAAAAGTTACGACATGCCCTGCAATATCGAATCTGCATCGCTTGAGCCAAAATCTGGCAACAAATTCGTTGCTGGTGGAGAAGATATGTGGGTTCGACTCTTTGATTTCCACACCGGAAAGGAGATTGGATGCAACAAGGGACATCATGGTCCGGTTCACTGTGTGAGATTTGCACCAACAGGTGAGTCTTATGCTTCAGGGTCTGAAGATGGTACAATCAGAATTTGGCAAACTGGACCGGTGAATCCTGAAGAGATCAGCGAGTCAAAGCCGAAGCAGAGTGTGGATGAGGTTGCTCGTAAGATTGAAGGCTTTCACATTAACAAGGAAGGAAAAACCGCAGAGAAACCATCTGATGCTTAAACCAAGAAAAGAACCAAGAAAAATGGCTGCTTCTCTTTGTCTTCTTACTGTGTTTTTACTTCCAGACTGAATATACGGAAATTCAAAACAAGTGTTTGAAAAACAGTCGTTGTCAATCTTCATTCGAGTCAAGTTTATGGATGTGGCTGAAAATTTACGAATTAAT

SEQ ID NO: 2159 - DNA, 1779 bp, Arabidopsis thaliana
  misc_feature (1)..(1779): Ceres cDNA ID no. 13492875
  misc_feature (1)..(1779): Ceres CLONE  ID no. 125606
  misc_feature (1)..(1779): Also known as  Ceres CDNA ID no. 23374554
acttgcactcctctttttctttctttctttcttgttggtctctcttacttctttcttattcatctaaaacaatttcgatccatttacacataaatatatgtaactggccgtagaagaaacacattgaaggaagagatggctcataggagattaatcatgacgatgacaaagatgatgatgatggtgaccatgatgatgatgatgatgatggataaaacatgcatatgtgcggacatttccagaggcagttttccaaagggctttgtctttggaactgcttcttcggcttttcagcatgaaggagcggtgaaggcagaaggcagaggtcctacgatatgggacacattttcccacacttttggtaaaatcaccgattttagcaatgctgatgtcgctgttgatcagtatcatcgttacgaggaagatgtacaacttatgaagaatatgggaatggacgcttacagattttccatttcttggacccgcatctttccaaatggtgttggacatataaatgaagccggaatcgatcactacaacaaactcataaatgctttacttgctaaagggatcgagccgtacgtgacactgtaccactgggatcttccacaagcacttcatgatcgatacctcggttggctaaacccacaaatcataaatgattttgcagcgtatgcggaggtttgtttccagagatttggagatagagtgaagcactggatcacgttcaacgagccacacacgttcgcgatacaaggctatgatgttggcctacaagctccaggccgttgcactattctttttaagctcacttgtcgcgaaggaaactcatcgaccgagccttacattgttggtcacaatgttattttaactcacgccacagtatccgatatctataggaaaaagtataaggcaaagcaaggaggttcgttagggattgcgtttgatgtaatgtggtttgaaccagagtcgaacaagacagaggacattgaagctgcacaaagagctcaagactttcaacttggctggtttttggatccgttgatgtttggggattacccaagctcgatgagaagcagagtcggaagcagattaccggtgtttacaggatctcaatcttctctggtgaagggttctttagattttgtagggattaatcactacacaacgtactacgcaaggaacaatgccaccaatctcattggcactcttctacacgacgccgtttctgattctggaaccgtcactctaccgtttaagggtttaagcacgattggagatagggcaagttcgatatggttgtacatagtgcctagagggatgagaagcttgatgaattacattaaacatagatatggaaaccctccagtcttcatcactgaaaatggaatggacgacccaaacagcattctgatctcaagaaaagacgctctcaaagatgcaaagaggatcaaataccatcatgattacctttctagcttacaagcttcgataaaagaggatggatgtaatgtcaaagggtacttcgtatggtcgctattggacaattgggaatgggcagcaggttatagttcaagatttggtctctacttcgttgattacagagacaacctcaagagatatcctaaagactctgttcattggttcacttctttcttaaactccacttcttgatttttccttcccattttattggtttagcgtaatgtatacaaaagtttatgattagttatggatttcggtttagataaatatatttaaatcaagatatgttgatat

SEQ ID NO: 2160 - protein, 1779 aa, Arabidopsis thaliana
  misc_feature: PFam Name: Glyco_hydro_1; PFam Description: Glycosyl
  misc_feature: GI Number: 15778634; NR Description: amygdalin hydrolase
  misc_feature: GI Number: 16757966; NR Description: amygdalin hydrolase
  misc_feature: GI Number: 7435445; NR Description: beta-glucosidase (EC 3.2.1.21) precursor isoform AH I, cyanogenic - black cherry
  misc_feature: GI Number: 9758949; NR Description: beta-glucosidase
  misc_feature: GI Number: 22658440; NR Description: beta-glucosidase [Oryza
ACTTGCACTCCTCTTTTTCTTTCTTTCTTTCTTGTTGGTCTCTCTTACTTCTTTCTTATTCATCTAAAACAATTTCGATCCATTTACACATAAATATATGTAACTGGCCGTAGAAGAAACACATTGAAGGAAGAGATGGCTCATAGGAGATTAATCATGACGATGACAAAGATGATGATGATGGTGACCATGATGATGATGATGATGATGGATAAAACATGCATATGTGCGGACATTTCCAGAGGCAGTTTTCCAAAGGGCTTTGTCTTTGGAACTGCTTCTTCGGCTTTTCAGCATGAAGGAGCGGTGAAGGCAGAAGGCAGAGGTCCTACGATATGGGACACATTTTCCCACACTTTTGGTAAAATCACCGATTTTAGCAATGCTGATGTCGCTGTTGATCAGTATCATCGTTACGAGGAAGATGTACAACTTATGAAGAATATGGGAATGGACGCTTACAGATTTTCCATTTCTTGGACCCGCATCTTTCCAAATGGTGTTGGACATATAAATGAAGCCGGAATCGATCACTACAACAAACTCATAAATGCTTTACTTGCTAAAGGGATCGAGCCGTACGTGACACTGTACCACTGGGATCTTCCACAAGCACTTCATGATCGATACCTCGGTTGGCTAAACCCACAAATCATAAATGATTTTGCAGCGTATGCGGAGGTTTGTTTCCAGAGATTTGGAGATAGAGTGAAGCACTGGATCACGTTCAACGAGCCACACACGTTCGCGATACAAGGCTATGATGTTGGCCTACAAGCTCCAGGCCGTTGCACTATTCTTTTTAAGCTCACTTGTCGCGAAGGAAACTCATCGACCGAGCCTTACATTGTTGGTCACAATGTTATTTTAACTCACGCCACAGTATCCGATATCTATAGGAAAAAGTATAAGGCAAAGCAAGGAGGTTCGTTAGGGATTGCGTTTGATGTAATGTGGTTTGAACCAGAGTCGAACAAGACAGAGGACATTGAAGCTGCACAAAGAGCTCAAGACTTTCAACTTGGCTGGTTTTTGGATCCGTTGATGTTTGGGGATTACCCAAGCTCGATGAGAAGCAGAGTCGGAAGCAGATTACCGGTGTTTACAGGATCTCAATCTTCTCTGGTGAAGGGTTCTTTAGATTTTGTAGGGATTAATCACTACACAACGTACTACGCAAGGAACAATGCCACCAATCTCATTGGCACTCTTCTACACGACGCCGTTTCTGATTCTGGAACCGTCACTCTACCGTTTAAGGGTTTAAGCACGATTGGAGATAGGGCAAGTTCGATATGGTTGTACATAGTGCCTAGAGGGATGAGAAGCTTGATGAATTACATTAAACATAGATATGGAAACCCTCCAGTCTTCATCACTGAAAATGGAATGGACGACCCAAACAGCATTCTGATCTCAAGAAAAGACGCTCTCAAAGATGCAAAGAGGATCAAATACCATCATGATTACCTTTCTAGCTTACAAGCTTCGATAAAAGAGGATGGATGTAATGTCAAAGGGTACTTCGTATGGTCGCTATTGGACAATTGGGAATGGGCAGCAGGTTATAGTTCAAGATTTGGTCTCTACTTCGTTGATTACAGAGACAACCTCAAGAGATATCCTAAAGACTCTGTTCATTGGTTCACTTCTTTCTTAAACTCCACTTCTTGATTTTTCCTTCCCATTTTATTGGTTTAGCGTAATGTATACAAAAGTTTATGATTAGTTATGGATTTCGGTTTAGATAAATATATTTAAATCAAGATATGTTGATAT

SEQ ID NO: 2161 - DNA, 1248 bp, Arabidopsis thaliana
  misc_feature (1)..(1248): Ceres cDNA ID no. 13492921
  misc_feature (1)..(1248): Ceres CLONE  ID no. 100990
  misc_feature (1)..(1248): Also known as  Ceres CDNA ID no. 23374726
accaactcctctaataagcttcttctttctatccctcacttttacaaacaaagggagaccaaaaatgggtctaagcaaaactattcccttagtgttactcccgattttgatgtttggggttttgagtaacgctcagcttacctctgatttttactccacgacatgccctaacgtcacagccattgctcggggactgatcgagcgagcaagccgtaacgacgtcagactcactgctaaagtcatgcgtcttcactttcatgactgtttcgtgaacgggtgcgatggttcggtactattggacgctgctccagcggatggggtagagggtgaaaaggaggctttccaaaacgcgggttctcttgatggattcgaagtgatcgatgatatcaaaaccgccctcgagaatgtttgtcccggagttgtctcttgtgctgatatcctcgctatcgcagctgaaatctctgttgcactggcgggagggccgtcattggacgtattgctaggaaggagagatggccggacagcgatccgtgcggacgcagtggctgcacttccactaggacctgattctctcgagattcttacttccaaattctccgtacataatcttgacactaccgatctcgtcgctttatctggtgctcataccttcgggagggttcagtgtggagtgataaacaatcgtctacacaactttagtggtaacagcggacagtccgacccaagtatcgaaccggagttcttgcaaacgttacgacgacaatgcccgcaaggcggagatctcaccgcaagggcgaatcttgatcctacgagccccgactcatttgataacgactatttcaagaaccttcaaaacaaccgcggagtgattgaatcagatcaaatcttgttctcttcgacaggagcgcctactgtgtctttggtgaatcgttttgctgagaaccaaaatgagttctttacaaattttgcgagatcaatgatcaagatgggaaatgtgaggattctcacaggacgtgagggagagatacgtagagactacagacgcgtcaattaataagttttgcatggttaaatgatcaaacgtaacttattgttattcatgaaataagtgttctttagtttgtgcttctccacaattaattgtttttcttcttttgattttatttactgttaagcatgccattgttacttgtaattgtaaatcttatataatatttttctttttgaaaaaatccactatcatgtctg

SEQ ID NO: 2162 - protein, 1248 aa, Arabidopsis thaliana
  misc_feature: PFam Name: peroxidase; PFam Description: Peroxidase
  misc_feature: GI Number: 21536505; NR Description: peroxidase [Arabidopsis
  misc_feature: GI Number: 15241208; NR Description: peroxidase, putative [Arabidopsis thaliana] gi|26397619|sp|P59120|PE58_ARATH Peroxidase
  misc_feature: GI Number: 26451205; NR Description: putative peroxidase
  misc_feature: GI Number: 8546851; NR Description: peroxidase [Ipomoea batatas]
  misc_feature: GI Number: 217997; NR Description: peroxidase [Populus kitakamiensis] >gi|478389|pir||JQ2217 peroxidase (EC 1.11.1.7) precursor, anionic - Japanese aspen x large-toothed aspen
ACCAACTCCTCTAATAAGCTTCTTCTTTCTATCCCTCACTTTTACAAACAAAGGGAGACCAAAAATGGGTCTAAGCAAAACTATTCCCTTAGTGTTACTCCCGATTTTGATGTTTGGGGTTTTGAGTAACGCTCAGCTTACCTCTGATTTTTACTCCACGACATGCCCTAACGTCACAGCCATTGCTCGGGGACTGATCGAGCGAGCAAGCCGTAACGACGTCAGACTCACTGCTAAAGTCATGCGTCTTCACTTTCATGACTGTTTCGTGAACGGGTGCGATGGTTCGGTACTATTGGACGCTGCTCCAGCGGATGGGGTAGAGGGTGAAAAGGAGGCTTTCCAAAACGCGGGTTCTCTTGATGGATTCGAAGTGATCGATGATATCAAAACCGCCCTCGAGAATGTTTGTCCCGGAGTTGTCTCTTGTGCTGATATCCTCGCTATCGCAGCTGAAATCTCTGTTGCACTGGCGGGAGGGCCGTCATTGGACGTATTGCTAGGAAGGAGAGATGGCCGGACAGCGATCCGTGCGGACGCAGTGGCTGCACTTCCACTAGGACCTGATTCTCTCGAGATTCTTACTTCCAAATTCTCCGTACATAATCTTGACACTACCGATCTCGTCGCTTTATCTGGTGCTCATACCTTCGGGAGGGTTCAGTGTGGAGTGATAAACAATCGTCTACACAACTTTAGTGGTAACAGCGGACAGTCCGACCCAAGTATCGAACCGGAGTTCTTGCAAACGTTACGACGACAATGCCCGCAAGGCGGAGATCTCACCGCAAGGGCGAATCTTGATCCTACGAGCCCCGACTCATTTGATAACGACTATTTCAAGAACCTTCAAAACAACCGCGGAGTGATTGAATCAGATCAAATCTTGTTCTCTTCGACAGGAGCGCCTACTGTGTCTTTGGTGAATCGTTTTGCTGAGAACCAAAATGAGTTCTTTACAAATTTTGCGAGATCAATGATCAAGATGGGAAATGTGAGGATTCTCACAGGACGTGAGGGAGAGATACGTAGAGACTACAGACGCGTCAATTAATAAGTTTTGCATGGTTAAATGATCAAACGTAACTTATTGTTATTCATGAAATAAGTGTTCTTTAGTTTGTGCTTCTCCACAATTAATTGTTTTTCTTCTTTTGATTTTATTTACTGTTAAGCATGCCATTGTTACTTGTAATTGTAAATCTTATATAATATTTTTCTTTTTGAAAAAATCCACTATCATGTCTG

SEQ ID NO: 2163 - DNA, 1794 bp, Zea mays
  misc_feature (1)..(1794): Ceres cDNA ID no. 13492961
  misc_feature (1)..(1794): Ceres CLONE  ID no. 296071
  misc_feature (1)..(1794): Also known as  Ceres CDNA ID no. 23743766
cttccgctttctcccttactcgcgctcagcacgcaggcgacggcgtcggcgctcaggtcgggctctgggcgacggcgtcatcggcttctcctcccgcctctctccagtcgcctcgcgccctcgcctccggtcctccgcacaccggccggtgaccctgcaattgccgtgagcttccaggatctgttgtagatggatatgatgtcttcaaaaagcaaattgcacaaacagctttgttatctgctgacacagggttgctgccagtgtctacggcgattggttttgatgaaagaatgctgctccacagtgagctagaagttaaaccaaatccacatccagaaagaccggatcgccttcgcgccattgctgcaagtcttgctgctgcagggatctttccctcaaaatgtgctttggtacctcctcgagaaatcacgaaggaggaacttcttatggttcatagtccagaccacattgaaagtgtcgagcagacaaagaacatgctttacagttacttcacttcggatacttacgcaaatggacattcagcatgtgctgccaaacttgcagctggattatgtgctgatcttgctagtttgatagtatctgggcgtgttcgcaatggctttgcgctggtaagacctcctgggcatcatgcaggggtgaagcaagcaatggggttttgtcttcacaacaatgcagcagtagctgcgttagctgcaaaaagagcaggtgccaagaaagtcctcatagttgactgggatgtgcaccatggaaatggcacacaagagatattcgacggggacaaaacagtcttgtacatatcattacatcgtcatgaggatggaaacttttaccctggaactggagctgctcatgaggtgggagttcttgatggtcaaggattctcagttaatataccttggagccgtggtggtgttggagatgatgactacatctttgcttttcagactgtggtgcttccaatagcttcagagtttgccgcagacatcactataatatctgcaggattcgatgcagctagaggtgaccctctgggttgttgtgacgtcactccaactggatactcttggatgacatccctgctagctggttcctcaaatggaagattgttggtgatacttgagggaggatacaatctccggtcgatatcctcatcagctactgaagttgttaaggtcctacttggggagggtcccaatcgtgcttcatttgtagtttcaccatcaaaagaggccttgagtactgtttctcaagtcctgaagattcaacaacagttttggccagttttaggtccaacatacgcatcactacaggcgcagcaggggtcggtttcttccaatcatagtaatgagctgaagaaaaggaagcgtccaggaggaggaccagggcccttctggtggaagatgggaagcaaaaggcttctatacgaagcgcttattgagcctcgcagccgtccgaggaaactcaaggggtcaactggttcagcagcgccttagacttagatgggcagtttgctggccgttgatcttctagacatgaacagggtagctcgctgaccgcgtttcctcaagcagagtaggctgcgtttacctagaaaacctagttttggctggttacttgcatgatggtcgaccgtttcagatggagtttgacagcaaacccgttgtgttaaccatgcgtggcgtatcagccgatgtttcatgcatgctactgtctttttctttggttggtttcgtaccatagatagacgtgtgtagcgaccatcgatgaagggcg

SEQ ID NO: 2164 - protein, 1794 aa, Zea mays
  misc_feature: PFam Name: Hist_deacetyl; PFam Description: Histone
  misc_feature: GI Number: 22135463; NR Description: histone deacetylase
  misc_feature: GI Number: 22135467; NR Description: histone deacetylase HDA110 isoform 3 [Zea mays] >gi|22135465|gb|AAM93213.1| histone
  misc_feature: GI Number: 22135469; NR Description: histone deacetylase
  misc_feature: GI Number: 50934369; NR Description: putative histone deacetylase [Oryza sativa (japonica cultivar-group)] >gi|33146793|dbj|BAC79741.1| putative histone deacetylase [Oryza sativa (japonica cultivar-group)] >gi|50510096|dbj|BAD30767.1|
  misc_feature: GI Number: 18401915; NR Description: histone deacetylase
CTTCCGCTTTCTCCCTTACTCGCGCTCAGCACGCAGGCGACGGCGTCGGCGCTCAGGTCGGGCTCTGGGCGACGGCGTCATCGGCTTCTCCTCCCGCCTCTCTCCAGTCGCCTCGCGCCCTCGCCTCCGGTCCTCCGCACACCGGCCGGTGACCCTGCAATTGCCGTGAGCTTCCAGGATCTGTTGTAGATGGATATGATGTCTTCAAAAAGCAAATTGCACAAACAGCTTTGTTATCTGCTGACACAGGGTTGCTGCCAGTGTCTACGGCGATTGGTTTTGATGAAAGAATGCTGCTCCACAGTGAGCTAGAAGTTAAACCAAATCCACATCCAGAAAGACCGGATCGCCTTCGCGCCATTGCTGCAAGTCTTGCTGCTGCAGGGATCTTTCCCTCAAAATGTGCTTTGGTACCTCCTCGAGAAATCACGAAGGAGGAACTTCTTATGGTTCATAGTCCAGACCACATTGAAAGTGTCGAGCAGACAAAGAACATGCTTTACAGTTACTTCACTTCGGATACTTACGCAAATGGACATTCAGCATGTGCTGCCAAACTTGCAGCTGGATTATGTGCTGATCTTGCTAGTTTGATAGTATCTGGGCGTGTTCGCAATGGCTTTGCGCTGGTAAGACCTCCTGGGCATCATGCAGGGGTGAAGCAAGCAATGGGGTTTTGTCTTCACAACAATGCAGCAGTAGCTGCGTTAGCTGCAAAAAGAGCAGGTGCCAAGAAAGTCCTCATAGTTGACTGGGATGTGCACCATGGAAATGGCACACAAGAGATATTCGACGGGGACAAAACAGTCTTGTACATATCATTACATCGTCATGAGGATGGAAACTTTTACCCTGGAACTGGAGCTGCTCATGAGGTGGGAGTTCTTGATGGTCAAGGATTCTCAGTTAATATACCTTGGAGCCGTGGTGGTGTTGGAGATGATGACTACATCTTTGCTTTTCAGACTGTGGTGCTTCCAATAGCTTCAGAGTTTGCCGCAGACATCACTATAATATCTGCAGGATTCGATGCAGCTAGAGGTGACCCTCTGGGTTGTTGTGACGTCACTCCAACTGGATACTCTTGGATGACATCCCTGCTAGCTGGTTCCTCAAATGGAAGATTGTTGGTGATACTTGAGGGAGGATACAATCTCCGGTCGATATCCTCATCAGCTACTGAAGTTGTTAAGGTCCTACTTGGGGAGGGTCCCAATCGTGCTTCATTTGTAGTTTCACCATCAAAAGAGGCCTTGAGTACTGTTTCTCAAGTCCTGAAGATTCAACAACAGTTTTGGCCAGTTTTAGGTCCAACATACGCATCACTACAGGCGCAGCAGGGGTCGGTTTCTTCCAATCATAGTAATGAGCTGAAGAAAAGGAAGCGTCCAGGAGGAGGACCAGGGCCCTTCTGGTGGAAGATGGGAAGCAAAAGGCTTCTATACGAAGCGCTTATTGAGCCTCGCAGCCGTCCGAGGAAACTCAAGGGGTCAACTGGTTCAGCAGCGCCTTAGACTTAGATGGGCAGTTTGCTGGCCGTTGATCTTCTAGACATGAACAGGGTAGCTCGCTGACCGCGTTTCCTCAAGCAGAGTAGGCTGCGTTTACCTAGAAAACCTAGTTTTGGCTGGTTACTTGCATGATGGTCGACCGTTTCAGATGGAGTTTGACAGCAAACCCGTTGTGTTAACCATGCGTGGCGTATCAGCCGATGTTTCATGCATGCTACTGTCTTTTTCTTTGGTTGGTTTCGTACCATAGATAGACGTGTGTAGCGACCATCGATGAAGGGCG

SEQ ID NO: 2165 - DNA, 1191 bp, Zea mays
  misc_feature (1)..(1191): Ceres cDNA ID no. 13492990
  misc_feature (1)..(1191): Ceres CLONE  ID no. 280193
  misc_feature (1)..(1191): Also known as  Ceres CDNA ID no. 23775369
cttccagttcgcaagggtttcccagccaaagaaccagcatcctggttgtgaaaatggggggtgtgcgtagctacttcttcatcatcgccgccgcggtcgttgccgtcgtcctcgcgcttctcccggccggcgccacaggtgccggcctcaaggtcggcttctacagcaagacatgcccgtcggcggagtccctggtgcagcaggcggtggctgccgccttcaagaacaacagcggcatcgccgccggcctcatccgcctgcacttccatgactgcttcgtcaggggctgcgacggctcggtgctgatcgactcgacggcgaacaacacggcggagaaggacgcggtcccgaacaacccgagcctgcggggcttcgaggtcatcgacgccgccaagaaggcggtggaggcacggtgccccaagacggtgtcctgcgccgacatcctggcgttcgcggcgcgggacagcatcgcgctggcggggaacaacctgacgtacaaggtccccgcggggcggcgcgacgggcgggtgtccagggacacggacgccaacagcaacctcccctcgccgctctccaccgccgccgagctcgtcggcaacttcacgcgcaagaacctcaccgccgaggacatggtggtgctctccggcgcgcacaccgtcggccgctcccactgctcctccttcaccaaccgcctctacggcttcagcaacgccagcgacgtcgaccccaccatcagctccgcctacgccctcctgctgcgggccatctgcccgtccaacaccagccagttcttccccaacaccaccaccgacatggacctcatcacgcccgcgctgctcgacaacaggtactacgtcggcctcgccaacaacctcggcctcttcacgtccgaccaggctctgctcaccaacgccacgctcaagaagtccgtcgacgccttcgtcaagagcgaaagcgcgtggaagaccaagttcgccaagtccatggtcaagatgggcaatatcgacgtgctcacgggcaccaagggggagatcaggctcaactgcagggtcatcaacagcggcagcagcagctctggattattccagcttcacacggcaaccgcctctgacgaggaattcgcccacgttgcaactaactagcagctactatatctctatccgtagaggatctagtgatctactgctaccc

SEQ ID NO: 2166 - protein, 1191 aa, Zea mays
  misc_feature: PFam Name: peroxidase; PFam Description: Peroxidase
  misc_feature: PFam Name: Mucin; PFam Description: Mucin-like glycoprotein
  misc_feature: PFam Name: Extensin_2; PFam Description: Extensin-like region
  misc_feature: PFam Name: Podocalyxin; PFam Description: Podocalyxin
  misc_feature: PFam Name: FH2; PFam Description: Formin Homology 2 Domain
  misc_feature: GI Number: 34894766; NR Description: putative peroxidase [Oryza sativa (japonica cultivar-group)] >gi|13366004|dbj|BAB39281.1| putative peroxidase [Oryza sativa (japonica cultivar-group)] >gi|22535703|dbj|BAC10876.1| putative
  misc_feature: GI Number: 45685311; NR Description: peroxidase [Zea mays] >gi|45685309|gb|AAS75414.1| peroxidase [Zea mays] >gi|45685295|gb|AAS75407.1| peroxidase [Zea mays]
  misc_feature: GI Number: 45685329; NR Description: peroxidase [Zea mays] >gi|45685323|gb|AAS75421.1| peroxidase [Zea mays] >gi|45685321|gb|AAS75420.1| peroxidase [Zea mays] >gi|45685315|gb|AAS75417.1| peroxidase [Zea mays]
  misc_feature: GI Number: 45685285; NR Description: peroxidase [Zea mays]
  misc_feature: GI Number: 45685317; NR Description: peroxidase [Zea mays] >gi|45685303|gb|AAS75411.1| peroxidase [Zea mays] >gi|45685291|gb|AAS75405.1| peroxidase [Zea mays] >gi|45685287|gb|AAS75403.1| peroxidase [Zea mays]
CTTCCAGTTCGCAAGGGTTTCCCAGCCAAAGAACCAGCATCCTGGTTGTGAAAATGGGGGGTGTGCGTAGCTACTTCTTCATCATCGCCGCCGCGGTCGTTGCCGTCGTCCTCGCGCTTCTCCCGGCCGGCGCCACAGGTGCCGGCCTCAAGGTCGGCTTCTACAGCAAGACATGCCCGTCGGCGGAGTCCCTGGTGCAGCAGGCGGTGGCTGCCGCCTTCAAGAACAACAGCGGCATCGCCGCCGGCCTCATCCGCCTGCACTTCCATGACTGCTTCGTCAGGGGCTGCGACGGCTCGGTGCTGATCGACTCGACGGCGAACAACACGGCGGAGAAGGACGCGGTCCCGAACAACCCGAGCCTGCGGGGCTTCGAGGTCATCGACGCCGCCAAGAAGGCGGTGGAGGCACGGTGCCCCAAGACGGTGTCCTGCGCCGACATCCTGGCGTTCGCGGCGCGGGACAGCATCGCGCTGGCGGGGAACAACCTGACGTACAAGGTCCCCGCGGGGCGGCGCGACGGGCGGGTGTCCAGGGACACGGACGCCAACAGCAACCTCCCCTCGCCGCTCTCCACCGCCGCCGAGCTCGTCGGCAACTTCACGCGCAAGAACCTCACCGCCGAGGACATGGTGGTGCTCTCCGGCGCGCACACCGTCGGCCGCTCCCACTGCTCCTCCTTCACCAACCGCCTCTACGGCTTCAGCAACGCCAGCGACGTCGACCCCACCATCAGCTCCGCCTACGCCCTCCTGCTGCGGGCCATCTGCCCGTCCAACACCAGCCAGTTCTTCCCCAACACCACCACCGACATGGACCTCATCACGCCCGCGCTGCTCGACAACAGGTACTACGTCGGCCTCGCCAACAACCTCGGCCTCTTCACGTCCGACCAGGCTCTGCTCACCAACGCCACGCTCAAGAAGTCCGTCGACGCCTTCGTCAAGAGCGAAAGCGCGTGGAAGACCAAGTTCGCCAAGTCCATGGTCAAGATGGGCAATATCGACGTGCTCACGGGCACCAAGGGGGAGATCAGGCTCAACTGCAGGGTCATCAACAGCGGCAGCAGCAGCTCTGGATTATTCCAGCTTCACACGGCAACCGCCTCTGACGAGGAATTCGCCCACGTTGCAACTAACTAGCAGCTACTATATCTCTATCCGTAGAGGATCTAGTGATCTACTGCTACCC

SEQ ID NO: 2167 - DNA, 678 bp, Zea mays
  misc_feature (1)..(678): Ceres cDNA ID no. 13493064
  misc_feature (1)..(678): Ceres CLONE  ID no. 284340
  misc_feature (1)..(678): Also known as  Ceres CDNA ID no. 13493064
attccaaaacatcactccctcgcgaaccccaagaactgcagcgacggcaatggcgatggcggcggagggcgcggcgagcgagccagagctggtgtcgatcccggcgacgccgcacggtctgtcgacgccggagggcgcggccacgccgaccggagcgggcgggggcggcggcggcaggagcaagggctccgggaccccagggcgtcgcgtggtggagggcctgcgcgggtacctggaggacgtgggccacctcacgcgcctcgacccgcgcgacgcctggctgcccgtcaccgagagccgcggcggcaacgcccgctacgccgctttccactccctcaacgccggcctcggcttccaggcacttctcctcccgctcgccttcccggacctcggctggagctgggggataatttcattgactattgcttatttctggcaactgtacacactgtggatcctagtgaagcttcatgaggctgtgccaggcaggaggtacaacagatatgttgagcttgcacaggcagcatttggagaaaatgggaatgtggctggcctcttttcccaactatttatctctcggcaggcactgcaactgcactgatccttgttggaggggagaccatgaagctgttcttccaaatagtgtgtggcccactctgctcgccgaatcccattacg

SEQ ID NO: 2168 - protein, 678 aa, Zea mays
ATTCCAAAACATCACTCCCTCGCGAACCCCAAGAACTGCAGCGACGGCAATGGCGATGGCGGCGGAGGGCGCGGCGAGCGAGCCAGAGCTGGTGTCGATCCCGGCGACGCCGCACGGTCTGTCGACGCCGGAGGGCGCGGCCACGCCGACCGGAGCGGGCGGGGGCGGCGGCGGCAGGAGCAAGGGCTCCGGGACCCCAGGGCGTCGCGTGGTGGAGGGCCTGCGCGGGTACCTGGAGGACGTGGGCCACCTCACGCGCCTCGACCCGCGCGACGCCTGGCTGCCCGTCACCGAGAGCCGCGGCGGCAACGCCCGCTACGCCGCTTTCCACTCCCTCAACGCCGGCCTCGGCTTCCAGGCACTTCTCCTCCCGCTCGCCTTCCCGGACCTCGGCTGGAGCTGGGGGATAATTTCATTGACTATTGCTTATTTCTGGCAACTGTACACACTGTGGATCCTAGTGAAGCTTCATGAGGCTGTGCCAGGCAGGAGGTACAACAGATATGTTGAGCTTGCACAGGCAGCATTTGGAGAAAATGGGAATGTGGCTGGCCTCTTTTCCCAACTATTTATCTCTCGGCAGGCACTGCAACTGCACTGATCCTTGTTGGAGGGGAGACCATGAAGCTGTTCTTCCAAATAGTGTGTGGCCCACTCTGCTCGCCGAATCCCATTACG

SEQ ID NO: 2169 - DNA, 1919 bp, Zea mays
  misc_feature (1)..(1919): Ceres cDNA ID no. 13493088
  misc_feature (1)..(1919): Ceres CLONE  ID no. 440850
  misc_feature (1)..(1919): Also known as  Ceres CDNA ID no. 13493088
atgtacacattgcccgtccgtgccaccacatccagcatcgtcgccagcctcgccacccccgcgccgtcctcctcctccggctccggccgccccaggctcaggctcatccggaacgcccccgtcttcgccgcccccgccaccgtctgtaaacgggacggcgggcagctgaggagtcaaacgagagagatcgagagagaaagaaagggagggcatccaccagccggcgggcataagaggggaggagagagaggccagagaagaggaggagaagaagaagaagatgagcagctgcctctgccttccgaaaaaaaaggaggggccagcgaaggagaagccgtccacagatacccccacctcgtcactccttcagaaccagaagccctccaacctccacctcctccctccaaggcttcctccaagggcatggaccccaccgtcgagcgcttgaagagcgggttccagaagttcaagaccgaggtctatgacaagaagccggagctgttcgagcctctcaagtccggccagagccccaggtacatggtgttcgcctgctccgactcccgcgtgtgcccgtcggtgacactgggactgcagcccggcgaggcattcaccgtccgcaacatcgcttccatggtcccaccctacgacaagatcaagtacgccggcacagggtccgccatcgagtacgccgtgtgcgcgctcaaggtgcaggtcatcgtggtcattggccacagctgctgcggtggcatcagggcgctcctctccctcaaggacggcgcgcccgacaacttcaccttcgtggaggactgggtcaggatcggcagccctgccaagaacaaggtgaagaaagagcacgcgtccgtgccgttcgatgaccagtgctccatcctggagaaggaggccgtgaacgtgtcgctccagaacctcaagagctaccccttcgtcaaggaagggctggccggcgggacgctcaagctggttggcgcccactcacacttcgtcaaagggcagttcgtcacatgggagcctccccaggacgccatcgagcgcttgacgagcggcttccagcagttcaaggtcaatgtctatgacaagaagccggagcttttcgggcctctcaagtccggccaggcccccaagtacatggtgttcgcctgctccgactcccgtgtgtgcccgtcggtgaccctgggcctgcagccgggcgaggccttcaccgttcgcaacatcgccgccatggtcccaggctacgacaagaccaagtacaccggcatcgggtccgccatcgagtacgctgtgtgcgccctcaaggtggaggtcctcgtggtcattggccatagctgctgcggtggcatcagggcgctcctctcactccaggacggcgcagcctacaccttccacttcgtcgaggactgggttaagatcggcttcattgccaagatgaaggtaaagaaagagcacgcctcggtgccgttcgatgaccagtgctccattctcgagaaggaggccgtgaacgtgtccctggagaacctcaagacctaccccttcgtcaaggaagggcttgcaaatgggaccctcaagctgatcggcgcccactacgactttgtctcaggagagttcctcacatggaaaaagtgaaaaactagggctaaggcaattctaccggcccgccgactctgcatcatcataatatatatactataactatactactagctacctaccgatagtcacccgagcaatgtgaatgcgtcgagtactatctgttttctgcatctacatatatataccggatcaacaatcgcccaatgtgaatgtaataagcaatatcattttctaccacttttcattcctaacgctgaggctttttatgtactatatcttatatgatgaataataatatgaccgccttgtgatct

SEQ ID NO: 2170 - protein, 1919 aa, Zea mays
ATGTACACATTGCCCGTCCGTGCCACCACATCCAGCATCGTCGCCAGCCTCGCCACCCCCGCGCCGTCCTCCTCCTCCGGCTCCGGCCGCCCCAGGCTCAGGCTCATCCGGAACGCCCCCGTCTTCGCCGCCCCCGCCACCGTCTGTAAACGGGACGGCGGGCAGCTGAGGAGTCAAACGAGAGAGATCGAGAGAGAAAGAAAGGGAGGGCATCCACCAGCCGGCGGGCATAAGAGGGGAGGAGAGAGAGGCCAGAGAAGAGGAGGAGAAGAAGAAGAAGATGAGCAGCTGCCTCTGCCTTCCGAAAAAAAAGGAGGGGCCAGCGAAGGAGAAGCCGTCCACAGATACCCCCACCTCGTCACTCCTTCAGAACCAGAAGCCCTCCAACCTCCACCTCCTCCCTCCAAGGCTTCCTCCAAGGGCATGGACCCCACCGTCGAGCGCTTGAAGAGCGGGTTCCAGAAGTTCAAGACCGAGGTCTATGACAAGAAGCCGGAGCTGTTCGAGCCTCTCAAGTCCGGCCAGAGCCCCAGGTACATGGTGTTCGCCTGCTCCGACTCCCGCGTGTGCCCGTCGGTGACACTGGGACTGCAGCCCGGCGAGGCATTCACCGTCCGCAACATCGCTTCCATGGTCCCACCCTACGACAAGATCAAGTACGCCGGCACAGGGTCCGCCATCGAGTACGCCGTGTGCGCGCTCAAGGTGCAGGTCATCGTGGTCATTGGCCACAGCTGCTGCGGTGGCATCAGGGCGCTCCTCTCCCTCAAGGACGGCGCGCCCGACAACTTCACCTTCGTGGAGGACTGGGTCAGGATCGGCAGCCCTGCCAAGAACAAGGTGAAGAAAGAGCACGCGTCCGTGCCGTTCGATGACCAGTGCTCCATCCTGGAGAAGGAGGCCGTGAACGTGTCGCTCCAGAACCTCAAGAGCTACCCCTTCGTCAAGGAAGGGCTGGCCGGCGGGACGCTCAAGCTGGTTGGCGCCCACTCACACTTCGTCAAAGGGCAGTTCGTCACATGGGAGCCTCCCCAGGACGCCATCGAGCGCTTGACGAGCGGCTTCCAGCAGTTCAAGGTCAATGTCTATGACAAGAAGCCGGAGCTTTTCGGGCCTCTCAAGTCCGGCCAGGCCCCCAAGTACATGGTGTTCGCCTGCTCCGACTCCCGTGTGTGCCCGTCGGTGACCCTGGGCCTGCAGCCGGGCGAGGCCTTCACCGTTCGCAACATCGCCGCCATGGTCCCAGGCTACGACAAGACCAAGTACACCGGCATCGGGTCCGCCATCGAGTACGCTGTGTGCGCCCTCAAGGTGGAGGTCCTCGTGGTCATTGGCCATAGCTGCTGCGGTGGCATCAGGGCGCTCCTCTCACTCCAGGACGGCGCAGCCTACACCTTCCACTTCGTCGAGGACTGGGTTAAGATCGGCTTCATTGCCAAGATGAAGGTAAAGAAAGAGCACGCCTCGGTGCCGTTCGATGACCAGTGCTCCATTCTCGAGAAGGAGGCCGTGAACGTGTCCCTGGAGAACCTCAAGACCTACCCCTTCGTCAAGGAAGGGCTTGCAAATGGGACCCTCAAGCTGATCGGCGCCCACTACGACTTTGTCTCAGGAGAGTTCCTCACATGGAAAAAGTGAAAAACTAGGGCTAAGGCAATTCTACCGGCCCGCCGACTCTGCATCATCATAATATATATACTATAACTATACTACTAGCTACCTACCGATAGTCACCCGAGCAATGTGAATGCGTCGAGTACTATCTGTTTTCTGCATCTACATATATATACCGGATCAACAATCGCCCAATGTGAATGTAATAAGCAATATCATTTTCTACCACTTTTCATTCCTAACGCTGAGGCTTTTTATGTACTATATCTTATATGATGAATAATAATATGACCGCCTTGTGATCT

SEQ ID NO: 2171 - DNA, 1917 bp, Zea mays
  misc_feature (1)..(1917): Ceres cDNA ID no. 13493155
  misc_feature (1)..(1917): Ceres CLONE  ID no. 391751
  misc_feature (1)..(1917): Also known as  Ceres CDNA ID no. 23808386
tagaacatcctaatcaaaaacacataagaggcgacatcacatcgcgttccgccgcctcacacgctagttggagctgtagtattagccaaccagccagcctccgatctccatccatatggaggaggctgcgcccgcggcggtcatggagcgggagcgcctcacggccgagatggccttccgcggcgcggacgaagctcggcgggaaggcggcgacccggcgcccagcatcgtcatcaagatccgccgccggctcccggacttcgcccgcaacatcaagctcaagtacgtgaagctcgggatccgccacggcggcagccccacgtcgctgctgccggcgctctgcgtgccggcggtcgccgccgccgcctactcgttcgtccgcctcgacgtcatctactactccgtcgacctgctcacctgcgtcgcctggctcggcaccgcgctgctgctgctcaccgtctactacctcaagcggccccgccccgtgtacctcgtcgagttcgcgtgctacaagccggaggagcggctcaagatctccaagtcggccttcctcgagatgaccgagagcaccggctccttcaatgaggcggctctggacttccagaccaagatcaccagccgctccgcgctcggggacgagacgtacctgcccccgggcgtccaggcgcgcccgcccaggctaaacatggcggaggcgcggaaggaggccgaggcggtcatgttcgggtgcctggacgcgctgttcgagtccacggggatcgacccgcgccgcgacgtgcgcatcctcatcgtcaactgcagcctcttcaacccgacgccgtcgctggcgtccatggtcatcaaccactacaggatgagggaggacgtcaagtcgttcaacctcggcggcatggggtgcagcgccggcctcatcgccgtcgacctcgccaaggacatgctccaggcgaaccccggatcgtacgccgtggtgctcagcaccgagaacatcaccctcaactggtacttcggcaacgaccgctccatgctcctctccaactgcatcttccgcatgggcggggccgcggcgctgctgtccaacaggcgcgcggacgccgggcgcgccaagtaccggctgctccacacggtgcgcacccacaaggcgccaccgacgagtgcttcaactgcgtgtaccagcgcgaggacgaggccggcaaggcgggcgtctcgctggcgcgggagctcatggcggtggccggcgacgcgctcaagaccaacatcacgacgctggggcccctggtgctgcccctgagcgagcagctcaagttcctcaggtcgctgatgatgcgccgcgtgttccgcgtcaggggcgtgcgcccctacatcccggacttccggcgcgcgttcgagcacttctgcgtgcacgccggcgggcgcgcggtgctggaggaggtgcagcgcagcctgagcctgcgggacacggacatggagcccagcaagtgctccctccaccggttcggcaacaccagcagcagctcgctgtggtacgagctggcgtacgccgaggccaagggccgggtaaggcgcggccaccgcgtgtggcagatcggcttcggctcggggttcaagtgcaacagcgccgtgtggcgcgctctacgcgacgtgccgccgctgccgtcgtcgcccggcgccgcggcggggccgggggccaggaagggcgcgccgcagagctgctgcaatccctgggtggacgacgtggacaggtaccctcccaaggcgtacgtctgatgggccacgtcacgtggccacaacaattgcatgatcccaatcccattcggatttcctcacgacgaattaatgaagaagggcgtgtgagtgtgagggagaaagttatacttgtatgtattttttttttcagttttattttgtcgtttcgttttc

SEQ ID NO: 2172 - protein, 1917 aa, Zea mays
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: Cupin_1; PFam Description: Cupin
  misc_feature: PFam Name: MMTV_SAg; PFam Description: Mouse mammary tumour
  misc_feature: GI Number: 32172500; NR Description: FAE3 [Marchantia polymorpha]
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 29417540; NR Description:
  misc_feature: GI Number: 4091810; NR Description: fatty acid elongase
  misc_feature: GI Number: 49355348; NR Description: fatty acid elongase
TAGAACATCCTAATCAAAAACACATAAGAGGCGACATCACATCGCGTTCCGCCGCCTCACACGCTAGTTGGAGCTGTAGTATTAGCCAACCAGCCAGCCTCCGATCTCCATCCATATGGAGGAGGCTGCGCCCGCGGCGGTCATGGAGCGGGAGCGCCTCACGGCCGAGATGGCCTTCCGCGGCGCGGACGAAGCTCGGCGGGAAGGCGGCGACCCGGCGCCCAGCATCGTCATCAAGATCCGCCGCCGGCTCCCGGACTTCGCCCGCAACATCAAGCTCAAGTACGTGAAGCTCGGGATCCGCCACGGCGGCAGCCCCACGTCGCTGCTGCCGGCGCTCTGCGTGCCGGCGGTCGCCGCCGCCGCCTACTCGTTCGTCCGCCTCGACGTCATCTACTACTCCGTCGACCTGCTCACCTGCGTCGCCTGGCTCGGCACCGCGCTGCTGCTGCTCACCGTCTACTACCTCAAGCGGCCCCGCCCCGTGTACCTCGTCGAGTTCGCGTGCTACAAGCCGGAGGAGCGGCTCAAGATCTCCAAGTCGGCCTTCCTCGAGATGACCGAGAGCACCGGCTCCTTCAATGAGGCGGCTCTGGACTTCCAGACCAAGATCACCAGCCGCTCCGCGCTCGGGGACGAGACGTACCTGCCCCCGGGCGTCCAGGCGCGCCCGCCCAGGCTAAACATGGCGGAGGCGCGGAAGGAGGCCGAGGCGGTCATGTTCGGGTGCCTGGACGCGCTGTTCGAGTCCACGGGGATCGACCCGCGCCGCGACGTGCGCATCCTCATCGTCAACTGCAGCCTCTTCAACCCGACGCCGTCGCTGGCGTCCATGGTCATCAACCACTACAGGATGAGGGAGGACGTCAAGTCGTTCAACCTCGGCGGCATGGGGTGCAGCGCCGGCCTCATCGCCGTCGACCTCGCCAAGGACATGCTCCAGGCGAACCCCGGATCGTACGCCGTGGTGCTCAGCACCGAGAACATCACCCTCAACTGGTACTTCGGCAACGACCGCTCCATGCTCCTCTCCAACTGCATCTTCCGCATGGGCGGGGCCGCGGCGCTGCTGTCCAACAGGCGCGCGGACGCCGGGCGCGCCAAGTACCGGCTGCTCCACACGGTGCGCACCCACAAGGCGCCACCGACGAGTGCTTCAACTGCGTGTACCAGCGCGAGGACGAGGCCGGCAAGGCGGGCGTCTCGCTGGCGCGGGAGCTCATGGCGGTGGCCGGCGACGCGCTCAAGACCAACATCACGACGCTGGGGCCCCTGGTGCTGCCCCTGAGCGAGCAGCTCAAGTTCCTCAGGTCGCTGATGATGCGCCGCGTGTTCCGCGTCAGGGGCGTGCGCCCCTACATCCCGGACTTCCGGCGCGCGTTCGAGCACTTCTGCGTGCACGCCGGCGGGCGCGCGGTGCTGGAGGAGGTGCAGCGCAGCCTGAGCCTGCGGGACACGGACATGGAGCCCAGCAAGTGCTCCCTCCACCGGTTCGGCAACACCAGCAGCAGCTCGCTGTGGTACGAGCTGGCGTACGCCGAGGCCAAGGGCCGGGTAAGGCGCGGCCACCGCGTGTGGCAGATCGGCTTCGGCTCGGGGTTCAAGTGCAACAGCGCCGTGTGGCGCGCTCTACGCGACGTGCCGCCGCTGCCGTCGTCGCCCGGCGCCGCGGCGGGGCCGGGGGCCAGGAAGGGCGCGCCGCAGAGCTGCTGCAATCCCTGGGTGGACGACGTGGACAGGTACCCTCCCAAGGCGTACGTCTGATGGGCCACGTCACGTGGCCACAACAATTGCATGATCCCAATCCCATTCGGATTTCCTCACGACGAATTAATGAAGAAGGGCGTGTGAGTGTGAGGGAGAAAGTTATACTTGTATGTATTTTTTTTTTCAGTTTTATTTTGTCGTTTCGTTTTC

SEQ ID NO: 2173 - DNA, 1865 bp, Zea mays
  misc_feature (1)..(1865): Ceres cDNA ID no. 13493199
  misc_feature (1)..(1865): Ceres CLONE  ID no. 358078
  misc_feature (1)..(1865): Also known as  Ceres CDNA ID no. 23797005
taatcgaaaaacacacgcgggcgcgctagctagtgagagtcggagatgtcgtcgccgcggccacacttcctcgtgctcaccttccctttccagggccacatcgccccggctctccgcctcgccaggcagctgctcgcggcggcgcccgacgcgctcgtgaccttctccaccaccgaggtcgcgcacaggcgcatgttcccggcaaagcccaacgacggcgccaaggactccgacgaagacggccgcctcgagttcctcccgttctccgacggcacggaggccgggtacgtccggagcgccgacctgggctcgttcaacgcctacatgacgtctttccacgccgcgggggcgcgcagcgccgcggagatcgtggacgcgctcgcggcgcggggccgccccgtgtcccgcgtcgtgtacacgctgctcctcccgtgggcggccgacgtcgcgcgggaccgcgggatcccgtccgcgctctactggatccagccggtctccgtgttcgccatctaccaccactacttccacggccacgccggcgtcgtcgccgaccaccttcacgacccgtcgttcgtcgtggagatgccgggcctggcgccacagccggtcggcgacctgccgtccttcctcaccgactccaccgacccttccaatatgttccacagcgtcttcaccacgatccgagacctgatcgaaacgcttgacaaggaaagccccaggtccactgtcctcgtcaacacgtgccgagagctcgaggtgggcgcgctcgccgccgtgggggcgcaccacgacgtgctccccgtcggcccggtgctcccatccggcggcgacgccggcatcttcaagcaggacgacgacgccaagtacatggagtggctcgacgccaaaccggcgaattccgtggtgtacgtctccttcggcagtctgaccacggtggcgagagaacatctcgaggagctgctccggggccttgaggagagcggcaggccgtacctctgcgtcatccggaaggacaacaaggctgcactcgcggatgccgagacgaaggtagacgaggagctcaagaacggcatcgtagtggagtggtgcgaccaggtgcgggtgctgtcgcacgcggcggtcgggtgcttcgtgacgcactgtggctggaactcggtgctggagagcctggcggcgggggtgcccatggtgtgcgtgccccggatgtcggaccagcgcaccaacgctcaacttgtcgtgcgcgagtggcgcgtcggcgtgcgcgcgcaggtggacgatggtggcgtgctgcgagcggcggaggtgcggcggtgcatcgacgaggcgatggggaatttggaggccgccgcggaggtgcgacgcatggcggcggagtggaagcaggtagtgacaaaggccatgggaaaaggagggtcgtcggatcgtaatctcatgacgttcgtggatggcgcgaggaacgccgtttgaagattggcatgtgtttctttctttcttcacgttcggttacaccaatccagaaaaagattagcttgttcggttacattaatccaaaagagaattgggggagaattggttacatcaatcaaccaatcctattatgaattggtgtaaccgaacaaaccataagtggtcaaaggcggatggcttccggccattgacgtacggggccagacaaccgctggctccacgcgttattgactggtccacaactacttttctagaagttacggtataggatccagttgtgttaactgtggacattatgttgtcagtagctgttaagcttttcaacgtctgcttgactggacgactgctcccgataaactaggttatcttatattcatacagaactaaatcttagacct

SEQ ID NO: 2174 - protein, 1865 aa, Zea mays
  misc_feature: PFam Name: UDPGT; PFam Description: UDP-glucoronosyl and
  misc_feature: PFam Name: Mucin; PFam Description: Mucin-like glycoprotein
  misc_feature: GI Number: 50906103; NR Description: putative anthocyanin 5-O-glucosyltransferase [Oryza sativa (japonica cultivar-group)] >gi|46390092|dbj|BAD15509.1| putative anthocyanin
  misc_feature: GI Number: 34906162; NR Description: putative anthocyanin 5-O-glucosyltransferase [Oryza sativa (japonica cultivar-group)] >gi|9711868|dbj|BAB07962.1| putative anthocyanin
  misc_feature: GI Number: 50725394; NR Description: putative
  misc_feature: GI Number: 14192682; NR Description: cold-induced glucosyl
  misc_feature: GI Number: 60650091; NR Description: monoterpene
TAATCGAAAAACACACGCGGGCGCGCTAGCTAGTGAGAGTCGGAGATGTCGTCGCCGCGGCCACACTTCCTCGTGCTCACCTTCCCTTTCCAGGGCCACATCGCCCCGGCTCTCCGCCTCGCCAGGCAGCTGCTCGCGGCGGCGCCCGACGCGCTCGTGACCTTCTCCACCACCGAGGTCGCGCACAGGCGCATGTTCCCGGCAAAGCCCAACGACGGCGCCAAGGACTCCGACGAAGACGGCCGCCTCGAGTTCCTCCCGTTCTCCGACGGCACGGAGGCCGGGTACGTCCGGAGCGCCGACCTGGGCTCGTTCAACGCCTACATGACGTCTTTCCACGCCGCGGGGGCGCGCAGCGCCGCGGAGATCGTGGACGCGCTCGCGGCGCGGGGCCGCCCCGTGTCCCGCGTCGTGTACACGCTGCTCCTCCCGTGGGCGGCCGACGTCGCGCGGGACCGCGGGATCCCGTCCGCGCTCTACTGGATCCAGCCGGTCTCCGTGTTCGCCATCTACCACCACTACTTCCACGGCCACGCCGGCGTCGTCGCCGACCACCTTCACGACCCGTCGTTCGTCGTGGAGATGCCGGGCCTGGCGCCACAGCCGGTCGGCGACCTGCCGTCCTTCCTCACCGACTCCACCGACCCTTCCAATATGTTCCACAGCGTCTTCACCACGATCCGAGACCTGATCGAAACGCTTGACAAGGAAAGCCCCAGGTCCACTGTCCTCGTCAACACGTGCCGAGAGCTCGAGGTGGGCGCGCTCGCCGCCGTGGGGGCGCACCACGACGTGCTCCCCGTCGGCCCGGTGCTCCCATCCGGCGGCGACGCCGGCATCTTCAAGCAGGACGACGACGCCAAGTACATGGAGTGGCTCGACGCCAAACCGGCGAATTCCGTGGTGTACGTCTCCTTCGGCAGTCTGACCACGGTGGCGAGAGAACATCTCGAGGAGCTGCTCCGGGGCCTTGAGGAGAGCGGCAGGCCGTACCTCTGCGTCATCCGGAAGGACAACAAGGCTGCACTCGCGGATGCCGAGACGAAGGTAGACGAGGAGCTCAAGAACGGCATCGTAGTGGAGTGGTGCGACCAGGTGCGGGTGCTGTCGCACGCGGCGGTCGGGTGCTTCGTGACGCACTGTGGCTGGAACTCGGTGCTGGAGAGCCTGGCGGCGGGGGTGCCCATGGTGTGCGTGCCCCGGATGTCGGACCAGCGCACCAACGCTCAACTTGTCGTGCGCGAGTGGCGCGTCGGCGTGCGCGCGCAGGTGGACGATGGTGGCGTGCTGCGAGCGGCGGAGGTGCGGCGGTGCATCGACGAGGCGATGGGGAATTTGGAGGCCGCCGCGGAGGTGCGACGCATGGCGGCGGAGTGGAAGCAGGTAGTGACAAAGGCCATGGGAAAAGGAGGGTCGTCGGATCGTAATCTCATGACGTTCGTGGATGGCGCGAGGAACGCCGTTTGAAGATTGGCATGTGTTTCTTTCTTTCTTCACGTTCGGTTACACCAATCCAGAAAAAGATTAGCTTGTTCGGTTACATTAATCCAAAAGAGAATTGGGGGAGAATTGGTTACATCAATCAACCAATCCTATTATGAATTGGTGTAACCGAACAAACCATAAGTGGTCAAAGGCGGATGGCTTCCGGCCATTGACGTACGGGGCCAGACAACCGCTGGCTCCACGCGTTATTGACTGGTCCACAACTACTTTTCTAGAAGTTACGGTATAGGATCCAGTTGTGTTAACTGTGGACATTATGTTGTCAGTAGCTGTTAAGCTTTTCAACGTCTGCTTGACTGGACGACTGCTCCCGATAAACTAGGTTATCTTATATTCATACAGAACTAAATCTTAGACCT

SEQ ID NO: 2175 - DNA, 1658 bp, Zea mays
  misc_feature (1)..(1658): Ceres cDNA ID no. 13493696
  misc_feature (1)..(1658): Ceres CLONE  ID no. 356857
  misc_feature (1)..(1658): Also known as  Ceres CDNA ID no. 23799802
gcacgagaccattacctagaacatcctaatcaaaaagcaaccagcaggccattctctcgccgtctcatcacaactagcgccactctagtagtaagtactaagtagtagtaggaggtggcagcagcagccaatcttgccacgatgacactctgcaccgtcttgctccagatcctccttccaacgctgctcttggtttctgccatcacaggcgcggacgctagcggcatcggcgtcaactacggcacgcggggcacgacgctcccggcgccggccgacgtggcgcggttcctggcccgggacaccatcttcgaccgcgtgaggctgttggacgccgacccggtcctgctgcgggccttcgcaggcacgggcctcgccgtggacgtgacggtgcccaacggcgtcgtcccgcgcctgttgaatctgaccttcgcgcggcgctgggtgcgcgacaacgtgacgccctacgcgggcgccaccaacatctcgcgcctcctggtcggcgacgaggtgaccaccgaggccaaccggacgctgctgctggcgctggtgccggccatgcagaacctgcacaccgcgctggtcgccgcgtccctgcacggccgggtgaaggtctccaccacgcactcgctcggggtgctcaccaccacggagcagccgtcggcggcgcggttccgcgacggctacgacgcggccatcgtgaggccgctgctcaggttcctccgcgcgaccggcgcgccgttcatggtgaacgcgtacccgttctacgcgctcgccaacgacagcagcctcgacttcgcgctgttccgggtgaacgacggcgtcatggaccagggcaccgggctggtgtacggcaacatgctggacgcgcagctcgacgccgtgcactcggccgtcaggcggatgggcttcggggacgtcgacatcgccgtgtcggagaccgggtggccatcggccggggaggactgggaggtcggcgtcggcgcggacctcgcccgggactacaacatcaacgccatccgccacctcggctccggcgtcggcacgccgctcatgcccaaccgcaccttcgaggtctccatcttctccctcttcgacgagaacctcaagccagggccggtgtcggagaggaatttcggcttgttccgcggcgacatgacgccggtctacgacgtcggcatcttcactgatccggagacccttgagccggtgagagcgaaggtgacgagccggaaatggtgcgtgccggagccggcggcggacgagatggtgctgcaggaaaacatcgacttcgcgtgcggccaaaagggcgtcgactgtaccgcgatccggccgggcggcgtctgctacgagccggacacggtgcaggcccacgcggcgtacgccatgaacctctacttccaggccaatggccagcatgcctttgactgcgattttggacagacaggcattgttaccacagctgatcccagttatggaggctgcaaattcatgtgaacaaggcataggggatgtttgttttgaggaatcactctattgaaatttagatggtacatcatgagtccatttctcaaatttgttgggatgattatattacttatattaatactaactaactatgaaaaatgagatagtgatagataaactcattttatttcatc

SEQ ID NO: 2176 - protein, 1658 aa, Zea mays
  misc_feature: PFam Name: Glyco_hydro_17; PFam Description: Glycosyl
  misc_feature: PFam Name: X8; PFam Description: X8 domain
  misc_feature: PFam Name: Peptidase_S8; PFam Description: Subtilase family
  misc_feature: PFam Name: HlyD; PFam Description: HlyD family secretion protein
  misc_feature: GI Number: 62733153; NR Description: glucan endo-1,3-beta-glucosidase precursor (ec 3.2.1.39) ((1-3)-beta-glucan endohydrolase) ((1-3)-beta-glucanase)
  misc_feature: GI Number: 62733240; NR Description: glucan endo-1,3-beta-glucosidase precursor (ec 3.2.1.39) ((1->3)-beta-glucan endohydrolase) ((1->3)-beta-glucanase)
  misc_feature: GI Number: 7414433; NR Description: beta-1,3 glucanase [Pisum sativum] >gi|11279328|pir||T50645 glucan
  misc_feature: GI Number: 4544403; NR Description: putative beta-1,3-glucanase [Arabidopsis thaliana] >gi|15226720|ref|NP_179219.1| glycosyl hydrolase family 17 protein [Arabidopsis thaliana] >gi|25316441|pir||B84538 probable
  misc_feature: GI Number: 62733152; NR Description: glucan endo-1,3-beta-glucosidase precursor (ec 3.2.1.39) ((1-3)-beta-glucan endohydrolase) ((1-3)-beta-glucanase)
GCACGAGACCATTACCTAGAACATCCTAATCAAAAAGCAACCAGCAGGCCATTCTCTCGCCGTCTCATCACAACTAGCGCCACTCTAGTAGTAAGTACTAAGTAGTAGTAGGAGGTGGCAGCAGCAGCCAATCTTGCCACGATGACACTCTGCACCGTCTTGCTCCAGATCCTCCTTCCAACGCTGCTCTTGGTTTCTGCCATCACAGGCGCGGACGCTAGCGGCATCGGCGTCAACTACGGCACGCGGGGCACGACGCTCCCGGCGCCGGCCGACGTGGCGCGGTTCCTGGCCCGGGACACCATCTTCGACCGCGTGAGGCTGTTGGACGCCGACCCGGTCCTGCTGCGGGCCTTCGCAGGCACGGGCCTCGCCGTGGACGTGACGGTGCCCAACGGCGTCGTCCCGCGCCTGTTGAATCTGACCTTCGCGCGGCGCTGGGTGCGCGACAACGTGACGCCCTACGCGGGCGCCACCAACATCTCGCGCCTCCTGGTCGGCGACGAGGTGACCACCGAGGCCAACCGGACGCTGCTGCTGGCGCTGGTGCCGGCCATGCAGAACCTGCACACCGCGCTGGTCGCCGCGTCCCTGCACGGCCGGGTGAAGGTCTCCACCACGCACTCGCTCGGGGTGCTCACCACCACGGAGCAGCCGTCGGCGGCGCGGTTCCGCGACGGCTACGACGCGGCCATCGTGAGGCCGCTGCTCAGGTTCCTCCGCGCGACCGGCGCGCCGTTCATGGTGAACGCGTACCCGTTCTACGCGCTCGCCAACGACAGCAGCCTCGACTTCGCGCTGTTCCGGGTGAACGACGGCGTCATGGACCAGGGCACCGGGCTGGTGTACGGCAACATGCTGGACGCGCAGCTCGACGCCGTGCACTCGGCCGTCAGGCGGATGGGCTTCGGGGACGTCGACATCGCCGTGTCGGAGACCGGGTGGCCATCGGCCGGGGAGGACTGGGAGGTCGGCGTCGGCGCGGACCTCGCCCGGGACTACAACATCAACGCCATCCGCCACCTCGGCTCCGGCGTCGGCACGCCGCTCATGCCCAACCGCACCTTCGAGGTCTCCATCTTCTCCCTCTTCGACGAGAACCTCAAGCCAGGGCCGGTGTCGGAGAGGAATTTCGGCTTGTTCCGCGGCGACATGACGCCGGTCTACGACGTCGGCATCTTCACTGATCCGGAGACCCTTGAGCCGGTGAGAGCGAAGGTGACGAGCCGGAAATGGTGCGTGCCGGAGCCGGCGGCGGACGAGATGGTGCTGCAGGAAAACATCGACTTCGCGTGCGGCCAAAAGGGCGTCGACTGTACCGCGATCCGGCCGGGCGGCGTCTGCTACGAGCCGGACACGGTGCAGGCCCACGCGGCGTACGCCATGAACCTCTACTTCCAGGCCAATGGCCAGCATGCCTTTGACTGCGATTTTGGACAGACAGGCATTGTTACCACAGCTGATCCCAGTTATGGAGGCTGCAAATTCATGTGAACAAGGCATAGGGGATGTTTGTTTTGAGGAATCACTCTATTGAAATTTAGATGGTACATCATGAGTCCATTTCTCAAATTTGTTGGGATGATTATATTACTTATATTAATACTAACTAACTATGAAAAATGAGATAGTGATAGATAAACTCATTTTATTTCATC

SEQ ID NO: 2177 - DNA, 1637 bp, Arabidopsis thaliana
  misc_feature (1)..(1637): Ceres cDNA ID no. 13493856
  misc_feature (1)..(1637): Ceres CLONE  ID no. 37734
  misc_feature (1)..(1637): Also known as  Ceres CDNA ID no. 23376065
aaatcttgaaattaaaaaaacagagcaatctttctctctctgttctgagagcttccatgtctgaaaccaacaacaacaaagcttgagtcttcctgttccttttccttttctctctcaaactcatgaaattttctcgggaaaatatgaaatgggttttcccagaaatcaaaacaactcagaatttcctctctccttcatcacttccacaagaaccaccgttatctctccgctccagcgcaaacttcgatctaaacagcaaaatcagtccaagtattctcctcataatcataatcctctcaatcatcttcttcatctccggtctccttcatctcttagtcagattcctcctcacaccaccgagcagagacagagaagattacttcgacaacgtcactgctcttcaaggccagcttcaacagctttttcatctccatgattctggagttgaccaatccttcatcgacacgttacctgttttccattacaaatccataatcggtctcaagaactatccttttgattgtgcagtttgtctttgtgagttcgaaacagaggataagctcaggctcttacctaaatgcagccacgcctttcacatggattgtatcgatacttggcttctatctcactctacttgtcctttgtgtagatccagtctcctctctgatctctcttcgcaccaagatcctcgttcttctttcctccttgtgctcgagtctgcgagtgatcatagctcgagagagattggaggagatagagacagtgcagcttgtgtggctgcaaatgatgatattgatgtgtctagtgctcatcttggtttggtcggaaacaatgatcttggatcaaccaggatagattcgggtcacggagatcagtacctggatggtgaattgggtggttcggttggaaaggttgttcctttttcagttaagctagggaagtttaggaatatagatattggtgaaggaactagtagcaacaacaacattggtaatagtagtagtttagatgagaggaggtgtttctcaatgggatcatatgagtatataatggatgaagaaacgactcttaaggttcatgtttcaaccaagaaacaatcaagcaagaaccgtggcttgcccggtcataggacagcgatgtccgaatgcgggtttgatccaacagggagattgaaattcagtgggagtggatcgatgaggatagtggaagaagcggccgagaagaatgtagtggaaagagagagcttttcggtatcgaaaatatggctaagggggaagaaggagaagcatagtaaagttcaaggaaaagaggatagttcattggtttcttcgtcttcgggaagagcattctctttcaggttatcgaaccagcggaaccatcccgatgcgatgatcgaaagtggttgcgaagaagataatcaaaagtgcgaaaactcggagtctttggagactaaaacaccatcttttgctaggaggactatgctttggcttgcagggagacaaaacaaggttgttcattcttcttcttcaactaatgtctagttactataatttttccattttcaaatttagttttctgttcaattgtttctttgtgttagtcctcataagtgcaaaaagatatatgaatcattgtag

SEQ ID NO: 2178 - protein, 1637 aa, Arabidopsis thaliana
  misc_feature: PFam Name: zf-C3HC4; PFam Description: Zinc finger, C3HC4
  misc_feature: GI Number: 21655299; NR Description: AT4g30400/F17I23_260 [Arabidopsis thaliana] >gi|15809840|gb|AAL06848.1|
  misc_feature: GI Number: 4185131; NR Description: putative RING zinc finger protein [Arabidopsis thaliana] >gi|25411889|pir||H84566 probable RING zinc finger protein [imported] - Arabidopsis thaliana
  misc_feature: GI Number: 18417587; NR Description: zinc finger (C3HC4-type
  misc_feature: GI Number: 50946255; NR Description: putative RING finger 1 [Oryza sativa (japonica cultivar-group)] >gi|42407444|dbj|BAD10051.1| putative RING finger 1 [Oryza sativa
  misc_feature: GI Number: 10177512; NR Description: RING zinc finger protein-like [Arabidopsis thaliana] >gi|51970768|dbj|BAD44076.1| RING finger -like protein [Arabidopsis thaliana] >gi|15242616|ref|NP_198841.1| zinc finger (C3HC4-type RING
AAATCTTGAAATTAAAAAAACAGAGCAATCTTTCTCTCTCTGTTCTGAGAGCTTCCATGTCTGAAACCAACAACAACAAAGCTTGAGTCTTCCTGTTCCTTTTCCTTTTCTCTCTCAAACTCATGAAATTTTCTCGGGAAAATATGAAATGGGTTTTCCCAGAAATCAAAACAACTCAGAATTTCCTCTCTCCTTCATCACTTCCACAAGAACCACCGTTATCTCTCCGCTCCAGCGCAAACTTCGATCTAAACAGCAAAATCAGTCCAAGTATTCTCCTCATAATCATAATCCTCTCAATCATCTTCTTCATCTCCGGTCTCCTTCATCTCTTAGTCAGATTCCTCCTCACACCACCGAGCAGAGACAGAGAAGATTACTTCGACAACGTCACTGCTCTTCAAGGCCAGCTTCAACAGCTTTTTCATCTCCATGATTCTGGAGTTGACCAATCCTTCATCGACACGTTACCTGTTTTCCATTACAAATCCATAATCGGTCTCAAGAACTATCCTTTTGATTGTGCAGTTTGTCTTTGTGAGTTCGAAACAGAGGATAAGCTCAGGCTCTTACCTAAATGCAGCCACGCCTTTCACATGGATTGTATCGATACTTGGCTTCTATCTCACTCTACTTGTCCTTTGTGTAGATCCAGTCTCCTCTCTGATCTCTCTTCGCACCAAGATCCTCGTTCTTCTTTCCTCCTTGTGCTCGAGTCTGCGAGTGATCATAGCTCGAGAGAGATTGGAGGAGATAGAGACAGTGCAGCTTGTGTGGCTGCAAATGATGATATTGATGTGTCTAGTGCTCATCTTGGTTTGGTCGGAAACAATGATCTTGGATCAACCAGGATAGATTCGGGTCACGGAGATCAGTACCTGGATGGTGAATTGGGTGGTTCGGTTGGAAAGGTTGTTCCTTTTTCAGTTAAGCTAGGGAAGTTTAGGAATATAGATATTGGTGAAGGAACTAGTAGCAACAACAACATTGGTAATAGTAGTAGTTTAGATGAGAGGAGGTGTTTCTCAATGGGATCATATGAGTATATAATGGATGAAGAAACGACTCTTAAGGTTCATGTTTCAACCAAGAAACAATCAAGCAAGAACCGTGGCTTGCCCGGTCATAGGACAGCGATGTCCGAATGCGGGTTTGATCCAACAGGGAGATTGAAATTCAGTGGGAGTGGATCGATGAGGATAGTGGAAGAAGCGGCCGAGAAGAATGTAGTGGAAAGAGAGAGCTTTTCGGTATCGAAAATATGGCTAAGGGGGAAGAAGGAGAAGCATAGTAAAGTTCAAGGAAAAGAGGATAGTTCATTGGTTTCTTCGTCTTCGGGAAGAGCATTCTCTTTCAGGTTATCGAACCAGCGGAACCATCCCGATGCGATGATCGAAAGTGGTTGCGAAGAAGATAATCAAAAGTGCGAAAACTCGGAGTCTTTGGAGACTAAAACACCATCTTTTGCTAGGAGGACTATGCTTTGGCTTGCAGGGAGACAAAACAAGGTTGTTCATTCTTCTTCTTCAACTAATGTCTAGTTACTATAATTTTTCCATTTTCAAATTTAGTTTTCTGTTCAATTGTTTCTTTGTGTTAGTCCTCATAAGTGCAAAAAGATATATGAATCATTGTAG

SEQ ID NO: 2179 - DNA, 1539 bp, Arabidopsis thaliana
  misc_feature (1)..(1539): Ceres cDNA ID no. 13494002
  misc_feature (1)..(1539): Ceres CLONE  ID no. 94166
  misc_feature (1)..(1539): Also known as  Ceres CDNA ID no. 23376503
atcatcaaagtgaaaatgacaaacttcaaagacaacgatggagatggaaccaaactccacgtggtaatgtttccatggttagcctttggtcacatggttccatacttggagctctctaaactcatagctcaaaagggtcacaaagtctctttcatttccactccacgtaacatcgaccgtctcctcccacggttaccggaaaatctctcctccgtcattaacttcgtcaagctatcacttcccgtcggcgacaacaaactcccggaagacggtgaagctaccacagacgtccctttcgaactcataccttacttaaaaatcgcttacgacgggttaaaagttccggtgacggagtttcttgaatcttcgaaacccgattgggttcttcaagatttcgcggggttttggcttcctccaatctctcgtcgtctcggaatcaaaaccggattctttagcgctttcaacggcgcgacgctcggtattcttaaaccgccggggttcgaagagtaccgtacttcgccggcggattttatgaagccgcctaagtgggttccgtttgaaacttcggtagctttcaagttatttgaatgcaggttcattttcaaaggatttatggcggaaaccaccgaagggaatgttcccgacatccaccgtgtcggcggcgtaattgacggctgtgacgtcatcttcgtacggagctgttacgagtatgaagcggagtggttaggacttacacaagaacttcaccggaaaccggttataccggtcggagttttgcctccaaaaccggacgaaaagtttgaagataccgacacgtggctgtctgttaaaaaatggttggactcacggaaaagtaagtccattgtctacgtagcttttggttcagaagctaaaccgagtcaaacggagctaaatgagatcgctctcggtttagagctttctggtttacctttcttttgggtgttaaagactcgtcgtggtccgtgggataccgaaccggtcgagcttccggaaggattcgaagagcgtacagcggatagagggatggtgtggagaggttgggttgagcaattgcgtacattgagccatgactcgatcggtttggttctgactcatcccggttggggaacgataattgaagctatccggtttgctaaaccgatggcaatgctggtttttgtgtatgaccaaggattgaatgcgagagtcattgaagagaagaaaattgggtatatgatccctcgagacgagacagaaggtttctttactaaagaaagtgttgcgaattcgctaagattggtaatggtggaagaagaaggaaaggtttatagagagaatgtgaaggagatgaaaggagtgtttggagatatggatagacaagatcgttatgtggattcattcttggaatatcttgttactaatcgttaactttgagtcttgatccaatggtcggttaattgagtgaagttgatcaagtgttgcaaggatgatcattgtataatgttatgatattttggaatggtcaagttttcttgaggc

SEQ ID NO: 2180 - protein, 1539 aa, Arabidopsis thaliana
  misc_feature: PFam Name: UDPGT; PFam Description: UDP-glucoronosyl and
  misc_feature: PFam Name: Glyco_transf_28; PFam Description:
  misc_feature: GI Number: 17380626; NR Description: At2g22590/T9I22.3 [Arabidopsis thaliana] >gi|15450577|gb|AAK96560.1|
  misc_feature: GI Number: 20149064; NR Description: putative anthocyanidine
  misc_feature: GI Number: 51705431; NR Description: putative
  misc_feature: GI Number: 21435782; NR Description: UDP-glucosyltransferase
  misc_feature: GI Number: 37993665; NR Description: UDP-glycosyltransferase
ATCATCAAAGTGAAAATGACAAACTTCAAAGACAACGATGGAGATGGAACCAAACTCCACGTGGTAATGTTTCCATGGTTAGCCTTTGGTCACATGGTTCCATACTTGGAGCTCTCTAAACTCATAGCTCAAAAGGGTCACAAAGTCTCTTTCATTTCCACTCCACGTAACATCGACCGTCTCCTCCCACGGTTACCGGAAAATCTCTCCTCCGTCATTAACTTCGTCAAGCTATCACTTCCCGTCGGCGACAACAAACTCCCGGAAGACGGTGAAGCTACCACAGACGTCCCTTTCGAACTCATACCTTACTTAAAAATCGCTTACGACGGGTTAAAAGTTCCGGTGACGGAGTTTCTTGAATCTTCGAAACCCGATTGGGTTCTTCAAGATTTCGCGGGGTTTTGGCTTCCTCCAATCTCTCGTCGTCTCGGAATCAAAACCGGATTCTTTAGCGCTTTCAACGGCGCGACGCTCGGTATTCTTAAACCGCCGGGGTTCGAAGAGTACCGTACTTCGCCGGCGGATTTTATGAAGCCGCCTAAGTGGGTTCCGTTTGAAACTTCGGTAGCTTTCAAGTTATTTGAATGCAGGTTCATTTTCAAAGGATTTATGGCGGAAACCACCGAAGGGAATGTTCCCGACATCCACCGTGTCGGCGGCGTAATTGACGGCTGTGACGTCATCTTCGTACGGAGCTGTTACGAGTATGAAGCGGAGTGGTTAGGACTTACACAAGAACTTCACCGGAAACCGGTTATACCGGTCGGAGTTTTGCCTCCAAAACCGGACGAAAAGTTTGAAGATACCGACACGTGGCTGTCTGTTAAAAAATGGTTGGACTCACGGAAAAGTAAGTCCATTGTCTACGTAGCTTTTGGTTCAGAAGCTAAACCGAGTCAAACGGAGCTAAATGAGATCGCTCTCGGTTTAGAGCTTTCTGGTTTACCTTTCTTTTGGGTGTTAAAGACTCGTCGTGGTCCGTGGGATACCGAACCGGTCGAGCTTCCGGAAGGATTCGAAGAGCGTACAGCGGATAGAGGGATGGTGTGGAGAGGTTGGGTTGAGCAATTGCGTACATTGAGCCATGACTCGATCGGTTTGGTTCTGACTCATCCCGGTTGGGGAACGATAATTGAAGCTATCCGGTTTGCTAAACCGATGGCAATGCTGGTTTTTGTGTATGACCAAGGATTGAATGCGAGAGTCATTGAAGAGAAGAAAATTGGGTATATGATCCCTCGAGACGAGACAGAAGGTTTCTTTACTAAAGAAAGTGTTGCGAATTCGCTAAGATTGGTAATGGTGGAAGAAGAAGGAAAGGTTTATAGAGAGAATGTGAAGGAGATGAAAGGAGTGTTTGGAGATATGGATAGACAAGATCGTTATGTGGATTCATTCTTGGAATATCTTGTTACTAATCGTTAACTTTGAGTCTTGATCCAATGGTCGGTTAATTGAGTGAAGTTGATCAAGTGTTGCAAGGATGATCATTGTATAATGTTATGATATTTTGGAATGGTCAAGTTTTCTTGAGGC

SEQ ID NO: 2181 - DNA, 1617 bp, Arabidopsis thaliana
  misc_feature (1)..(1617): Ceres cDNA ID no. 13494093
  misc_feature (1)..(1617): Ceres CLONE  ID no. 112338
  misc_feature (1)..(1617): Also known as  Ceres CDNA ID no. 23376785
ctagagttagaagtcgaaaaatctcgcttttagattcgttcaggcatttcgtcgagcaccttctctgcattactctcccctacttctctctattcattctttcaatgataagtcctaactaaactccgagagaacactaaaccctaaacccattttgcactctcaattacagatcatccacatttcgcgctttcgtcaaatctctttagatgttcgtcaaatcacaaagctttctcttttcggtgagtaagctgtttcaccagcatcaacaatggcgaggaatgggtgcaatgacaaaggtgagactgaagtgggtgaagaacaagaacctggatcacgtcattgatactgagaccgatctcaaagcagcttgtatcctcaaagacgccataaagcgatctcccactggtttcctcaccgcaaaatccgtcgccgattggcaaaaactccttggtctcaccgtccctgttctccgcttcttgcgcaggtatccgactctgtttcacgaatttcctcatgctcgttacgcaagcttaccatgtttcaagctaacggacacagcactaatgcttgactcacaagaagagattattcatcaaagccacgaggctgatacagtggagagactctgtagagttctgatgatgatgagatcaaaaactgtctctcttagatcactacattctctcaaattcgatctcggtttacccgataactacgaaaagacgctagtcatgaaataccctgatcatttctgcttcgtcaaggcttctaatggtaacccgtgtttaaagcttgtaaaatggcgtgatgagttcgcattctcggcgctgcagaagcgaaacgaggacaatgatgtttccggggaggagtctagataccgcgagttcaagagaggtcagtctacgttgacttttcctatgagtttccctagaggatatggagcacagaagaaggtcaaagcatggatggatgagtttcaaaaacttccctacatatctccttacgatgacccgagtaacattgatccggaaagcgatctcatggagaaacgagctgtggctgttttgcacgagctcttgagcttgactatccacaagaaaaccaagaggaactacttgagaagcatgagagcggagctcaacattccgcacaagttcactcgtctattcacgcgataccccggcattttctacctctcattgaagtgtaagacaacaactgtgatcctcaaagaagggtatcgccgaggaaaactagtggatccgcatcctctcactcgtcttcgagataagttttatcatgtgatgagaacagggtttctttatcgggcgagagggctaggcatggtctctaaagaggaacttttgcttgataggccagaggatgaccttgaggaagaaggctctgaagaagaagagattgtggaaggaagtgagcttgaagaagattctgaagctgaatagcaatagttgttgaatctaattgttgtatgttaattcacacagagcaacaatttatgtacctgcattttatctttttgaagtaacggaacggagtttaaacaatgtaagcacaaagtccttaaaatgatataaagagagattgtatttcacc

SEQ ID NO: 2182 - protein, 1617 aa, Arabidopsis thaliana
  misc_feature: GI Number: 21536812; NR Description: unknown [Arabidopsis thaliana]
  misc_feature: GI Number: 7239512; NR Description: Strong similarity to the higher plant tyrosine-specific protein phosphatases (PTPs) from A. thaliana gi|3413424 expressed during embryogenesis. [Arabidopsis
  misc_feature: GI Number: 53793176; NR Description: tyrosine-specific protein phosphatase-like protein [Oryza sativa (japonica
  misc_feature: GI Number: 34912696; NR Description: P0686E09.18 [Oryza sativa (japonica cultivar-group)] >gi|13365580|dbj|BAB39125.1|
CTAGAGTTAGAAGTCGAAAAATCTCGCTTTTAGATTCGTTCAGGCATTTCGTCGAGCACCTTCTCTGCATTACTCTCCCCTACTTCTCTCTATTCATTCTTTCAATGATAAGTCCTAACTAAACTCCGAGAGAACACTAAACCCTAAACCCATTTTGCACTCTCAATTACAGATCATCCACATTTCGCGCTTTCGTCAAATCTCTTTAGATGTTCGTCAAATCACAAAGCTTTCTCTTTTCGGTGAGTAAGCTGTTTCACCAGCATCAACAATGGCGAGGAATGGGTGCAATGACAAAGGTGAGACTGAAGTGGGTGAAGAACAAGAACCTGGATCACGTCATTGATACTGAGACCGATCTCAAAGCAGCTTGTATCCTCAAAGACGCCATAAAGCGATCTCCCACTGGTTTCCTCACCGCAAAATCCGTCGCCGATTGGCAAAAACTCCTTGGTCTCACCGTCCCTGTTCTCCGCTTCTTGCGCAGGTATCCGACTCTGTTTCACGAATTTCCTCATGCTCGTTACGCAAGCTTACCATGTTTCAAGCTAACGGACACAGCACTAATGCTTGACTCACAAGAAGAGATTATTCATCAAAGCCACGAGGCTGATACAGTGGAGAGACTCTGTAGAGTTCTGATGATGATGAGATCAAAAACTGTCTCTCTTAGATCACTACATTCTCTCAAATTCGATCTCGGTTTACCCGATAACTACGAAAAGACGCTAGTCATGAAATACCCTGATCATTTCTGCTTCGTCAAGGCTTCTAATGGTAACCCGTGTTTAAAGCTTGTAAAATGGCGTGATGAGTTCGCATTCTCGGCGCTGCAGAAGCGAAACGAGGACAATGATGTTTCCGGGGAGGAGTCTAGATACCGCGAGTTCAAGAGAGGTCAGTCTACGTTGACTTTTCCTATGAGTTTCCCTAGAGGATATGGAGCACAGAAGAAGGTCAAAGCATGGATGGATGAGTTTCAAAAACTTCCCTACATATCTCCTTACGATGACCCGAGTAACATTGATCCGGAAAGCGATCTCATGGAGAAACGAGCTGTGGCTGTTTTGCACGAGCTCTTGAGCTTGACTATCCACAAGAAAACCAAGAGGAACTACTTGAGAAGCATGAGAGCGGAGCTCAACATTCCGCACAAGTTCACTCGTCTATTCACGCGATACCCCGGCATTTTCTACCTCTCATTGAAGTGTAAGACAACAACTGTGATCCTCAAAGAAGGGTATCGCCGAGGAAAACTAGTGGATCCGCATCCTCTCACTCGTCTTCGAGATAAGTTTTATCATGTGATGAGAACAGGGTTTCTTTATCGGGCGAGAGGGCTAGGCATGGTCTCTAAAGAGGAACTTTTGCTTGATAGGCCAGAGGATGACCTTGAGGAAGAAGGCTCTGAAGAAGAAGAGATTGTGGAAGGAAGTGAGCTTGAAGAAGATTCTGAAGCTGAATAGCAATAGTTGTTGAATCTAATTGTTGTATGTTAATTCACACAGAGCAACAATTTATGTACCTGCATTTTATCTTTTTGAAGTAACGGAACGGAGTTTAAACAATGTAAGCACAAAGTCCTTAAAATGATATAAAGAGAGATTGTATTTCACC

SEQ ID NO: 2183 - DNA, 1318 bp, Arabidopsis thaliana
  misc_feature (1)..(1318): Ceres cDNA ID no. 13494113
  misc_feature (1)..(1318): Ceres CLONE  ID no. 106878
  misc_feature (1)..(1318): Also known as  Ceres CDNA ID no. 23376839
agacaaaacaaacaaacaaaacttcagtctctctgcaaagctccatcctttgtggttgtgtcgtagatagcccattcgagtggttaaaagttgaaacttttatgtccacttgaatcctttttttttggattttatctgatcactcgttttgtgtctctgaatctctatcccgtggattcgcatctggatttgttcttttttcatttttattcgagcggcttatctttctcggatccatctgatatcgatttgattctctttggtcaatcgttgaaatggcggatgcgtggaaggatttagcttcagggacagttggaggagcggctcagctagttgttggtcatccatttgacacaatcaaagtcaaacttcagagccaaccgactccagcaccaggccaacttccaaggtacaccggtgcaatcgatgcggttaaacagaccgttgcttctgaaggaactaaaggtttgtacaaaggtatgggagctccactggcaaccgttgctgccttcaatgcggttttgttcactgtgagaggtcaaatggaagggctgcttaggtctgaagctggaattcctttgaccattagtcaacagtttgtggccggtgcaggcgctggtttcgctgtttcgttccttgcttgtcctactgagttgatcaaatgcaggttgcaagcacaaggtgcattagctggtgcctctactacaagctcagtggttgcagccgtgaaatacggtggaccaatggatgtagcccgtcatgtcctacgatcagaaggcggagcacgaggtctattcaaaggtttattcccgacattcgcccgtgaagtcccgggaaatgcaacaatgtttgcagcctacgaagctttcaagcggtttttagccggtggttcagacacttcaagcttaggacaagggtcattgatcatggcgggtggagtcgctggtgcgtcgttttggggaattgtatatccgacagatgttgtgaagagtgttcttcaagtcgacgattacaaaaacccgaaatacacggggtcgatggatgctttccggaagattctgaaatctgaaggagttaaaggtttgtataaaggatttggtccagctatggctaggagtgttcctgctaatgctgcttgcttcttggcttatgagatgacaaggtcaagcttgggataaaccggttcgttttgggtttaactgttggtcctatttctggatgttccattgtcattaacctctctgtttttagatttgattcttttgaaatttctgcaaaaattatgtatctcttacacagtttatttcaactatctctt

SEQ ID NO: 2184 - protein, 1318 aa, Arabidopsis thaliana
  misc_feature: PFam Name: Mito_carr; PFam Description: Mitochondrial
  misc_feature: GI Number: 9758516; NR Description: carnitine/acylcarnitine
  misc_feature: GI Number: 22531072; NR Description: carnitine/acylcarnitine translocase-like protein [Arabidopsis thaliana] >gi|23197914|gb|AAN15484.1| carnitine/acylcarnitine translocase-like protein [Arabidopsis thaliana]
  misc_feature: GI Number: 37537070; NR Description: putative carnitine/acylcarnitine translocase [Oryza sativa (japonica cultivar-group)] >gi|12643054|gb|AAK00443.1| putative carnitine/acylcarnitine translocase [Oryza sativa]
  misc_feature: GI Number: 37537072; NR Description: putative carnitine/acylcarnitine translocase [Oryza sativa (japonica cultivar-group)] >gi|12643066|gb|AAK00455.1| putative carnitine/acylcarnitine translocase; tRNA-Gly; tRNA-Met [Oryza
  misc_feature: GI Number: 17539560; NR Description: mitochondrial carrier protein family, embryonic tissue differentiation factor, DIFferentiation abnormal DIF-1 (33.1 kD) (dif-1) [Caenorhabditis elegans] >gi|21542027|sp|Q27257|DIF1_CAEEL [Caenorhabditis
AGACAAAACAAACAAACAAAACTTCAGTCTCTCTGCAAAGCTCCATCCTTTGTGGTTGTGTCGTAGATAGCCCATTCGAGTGGTTAAAAGTTGAAACTTTTATGTCCACTTGAATCCTTTTTTTTTGGATTTTATCTGATCACTCGTTTTGTGTCTCTGAATCTCTATCCCGTGGATTCGCATCTGGATTTGTTCTTTTTTCATTTTTATTCGAGCGGCTTATCTTTCTCGGATCCATCTGATATCGATTTGATTCTCTTTGGTCAATCGTTGAAATGGCGGATGCGTGGAAGGATTTAGCTTCAGGGACAGTTGGAGGAGCGGCTCAGCTAGTTGTTGGTCATCCATTTGACACAATCAAAGTCAAACTTCAGAGCCAACCGACTCCAGCACCAGGCCAACTTCCAAGGTACACCGGTGCAATCGATGCGGTTAAACAGACCGTTGCTTCTGAAGGAACTAAAGGTTTGTACAAAGGTATGGGAGCTCCACTGGCAACCGTTGCTGCCTTCAATGCGGTTTTGTTCACTGTGAGAGGTCAAATGGAAGGGCTGCTTAGGTCTGAAGCTGGAATTCCTTTGACCATTAGTCAACAGTTTGTGGCCGGTGCAGGCGCTGGTTTCGCTGTTTCGTTCCTTGCTTGTCCTACTGAGTTGATCAAATGCAGGTTGCAAGCACAAGGTGCATTAGCTGGTGCCTCTACTACAAGCTCAGTGGTTGCAGCCGTGAAATACGGTGGACCAATGGATGTAGCCCGTCATGTCCTACGATCAGAAGGCGGAGCACGAGGTCTATTCAAAGGTTTATTCCCGACATTCGCCCGTGAAGTCCCGGGAAATGCAACAATGTTTGCAGCCTACGAAGCTTTCAAGCGGTTTTTAGCCGGTGGTTCAGACACTTCAAGCTTAGGACAAGGGTCATTGATCATGGCGGGTGGAGTCGCTGGTGCGTCGTTTTGGGGAATTGTATATCCGACAGATGTTGTGAAGAGTGTTCTTCAAGTCGACGATTACAAAAACCCGAAATACACGGGGTCGATGGATGCTTTCCGGAAGATTCTGAAATCTGAAGGAGTTAAAGGTTTGTATAAAGGATTTGGTCCAGCTATGGCTAGGAGTGTTCCTGCTAATGCTGCTTGCTTCTTGGCTTATGAGATGACAAGGTCAAGCTTGGGATAAACCGGTTCGTTTTGGGTTTAACTGTTGGTCCTATTTCTGGATGTTCCATTGTCATTAACCTCTCTGTTTTTAGATTTGATTCTTTTGAAATTTCTGCAAAAATTATGTATCTCTTACACAGTTTATTTCAACTATCTCTT

SEQ ID NO: 2185 - DNA, 1201 bp, Zea mays
  misc_feature (1)..(1201): Ceres cDNA ID no. 13494423
  misc_feature (1)..(1201): Ceres CLONE  ID no. 292070
  misc_feature (1)..(1201): Also known as  Ceres CDNA ID no. 23776565
gcacgagaccattacctagaacatcctaatcgaaaagaaaaagaaaattagaaaaccgcagccaatccagccgaggctgcaaaaaatcttggaagccgcgggagcgagagccatggaggacatcggcgagggccccgccgagaaccttccggagcccctgtctccagccgtggaggccgaggacgaggacggcgacgagttcagcttccccgttcctccggtcgccgccgacgcgtgcatcgtgcccgtgtacccgatcttcggccggcccccgtccccgcctcggggggaggaggaggagccggagacggccaccgtgcgggtgccgctgggccggctcctgctggaggagcgggagttccgcgcgcgggagccggacgggcgatcggcgagtgcgcaggcgtggcaggacgaggacgaggacgacgcctcgggcggcgccggggacgaggatctgcagggtgtgccggcggagagctactgcctgtgggcgcccggcgggcagtcgccggcgcccgcgtccccgcgccggtgccggaagagcggctccacgggctccgtcctccgctggcgccgcatcagcgaccgcctcgtcggccgcagccacagcgacggcaaggagaagttcgtgttcctcaccgccgttccggatccgcttcgtcctagtaggagtaacaaggaagtggatgaaggaggcggcgacggcgaggcaggcagcgtggcgcatcagctgagatattacggtagaggccgcggcggcggcggcggcagccggaggcgttcgtacctgccgtacaagcaagagctcgtcgggctgttcgccaacgtcagtgggctgcgccggagctaccacccgttctaaaacgcgatctgtccatgccttccgacctccgtcagtgggccaaaaagtaaaaaaaaaagatgatatcttgctcgtttttctgtggataatactgcctatagtactgtgcactgtttttttacagtacggcggaagcagtagatctgcgtattttctctctaagttatcggcttggataaaatagggttttagtttttaattaaaaaaatagcagaacctcagcaaggggaaaagaggtaacgtagcgtgtgtactgctgctactcatttgttcacatacttgacttcacttgagaaaaataacctgaggtttccttaatatacatacgccatgcagtgc

SEQ ID NO: 2186 - protein, 1201 aa, Zea mays
  misc_feature: PFam Name: GRP; PFam Description: Glycine rich protein family
  misc_feature: PFam Name: Transferase; PFam Description: Transferase family
  misc_feature: GI Number: 34912066; NR Description: P0445H04.35 [Oryza sativa (japonica cultivar-group)] >gi|20521218|dbj|BAB91735.1| P0671D01.12 [Oryza sativa (japonica cultivar-group)] >gi|21952910|dbj|BAC06322.1| P0445H04.35 [Oryza sativa (japonica
  misc_feature: GI Number: 34911600; NR Description: P0004A09.25 [Oryza sativa (japonica cultivar-group)] >gi|15290094|dbj|BAB63787.1|
  misc_feature: GI Number: 66776365; NR Description: PE-PGRS family protein [Anaeromyxobacter dehalogenans 2CP-C] >gi|66857891|ref|ZP_00401930.1| PE-PGRS family protein
  misc_feature: GI Number: 66778264; NR Description: LigA [Anaeromyxobacter dehalogenans 2CP-C] >gi|66856061|ref|ZP_00400131.1| LigA
  misc_feature: GI Number: 66776103; NR Description: LigA [Anaeromyxobacter dehalogenans 2CP-C] >gi|66858140|ref|ZP_00402169.1| LigA
GCACGAGACCATTACCTAGAACATCCTAATCGAAAAGAAAAAGAAAATTAGAAAACCGCAGCCAATCCAGCCGAGGCTGCAAAAAATCTTGGAAGCCGCGGGAGCGAGAGCCATGGAGGACATCGGCGAGGGCCCCGCCGAGAACCTTCCGGAGCCCCTGTCTCCAGCCGTGGAGGCCGAGGACGAGGACGGCGACGAGTTCAGCTTCCCCGTTCCTCCGGTCGCCGCCGACGCGTGCATCGTGCCCGTGTACCCGATCTTCGGCCGGCCCCCGTCCCCGCCTCGGGGGGAGGAGGAGGAGCCGGAGACGGCCACCGTGCGGGTGCCGCTGGGCCGGCTCCTGCTGGAGGAGCGGGAGTTCCGCGCGCGGGAGCCGGACGGGCGATCGGCGAGTGCGCAGGCGTGGCAGGACGAGGACGAGGACGACGCCTCGGGCGGCGCCGGGGACGAGGATCTGCAGGGTGTGCCGGCGGAGAGCTACTGCCTGTGGGCGCCCGGCGGGCAGTCGCCGGCGCCCGCGTCCCCGCGCCGGTGCCGGAAGAGCGGCTCCACGGGCTCCGTCCTCCGCTGGCGCCGCATCAGCGACCGCCTCGTCGGCCGCAGCCACAGCGACGGCAAGGAGAAGTTCGTGTTCCTCACCGCCGTTCCGGATCCGCTTCGTCCTAGTAGGAGTAACAAGGAAGTGGATGAAGGAGGCGGCGACGGCGAGGCAGGCAGCGTGGCGCATCAGCTGAGATATTACGGTAGAGGCCGCGGCGGCGGCGGCGGCAGCCGGAGGCGTTCGTACCTGCCGTACAAGCAAGAGCTCGTCGGGCTGTTCGCCAACGTCAGTGGGCTGCGCCGGAGCTACCACCCGTTCTAAAACGCGATCTGTCCATGCCTTCCGACCTCCGTCAGTGGGCCAAAAAGTAAAAAAAAAAGATGATATCTTGCTCGTTTTTCTGTGGATAATACTGCCTATAGTACTGTGCACTGTTTTTTTACAGTACGGCGGAAGCAGTAGATCTGCGTATTTTCTCTCTAAGTTATCGGCTTGGATAAAATAGGGTTTTAGTTTTTAATTAAAAAAATAGCAGAACCTCAGCAAGGGGAAAAGAGGTAACGTAGCGTGTGTACTGCTGCTACTCATTTGTTCACATACTTGACTTCACTTGAGAAAAATAACCTGAGGTTTCCTTAATATACATACGCCATGCAGTGC

SEQ ID NO: 2187 - DNA, 2016 bp, Zea mays
  misc_feature (1)..(2016): Ceres cDNA ID no. 13494527
  misc_feature (1)..(2016): Also known as  Ceres CDNA ID no. 23776565
  misc_feature (1491)..(1491): n is a, c, t, g, unknown, or other
  misc_feature (1493)..(1493): n is a, c, t, g, unknown, or other
  misc_feature (1494)..(1494): n is a, c, t, g, unknown, or other
  misc_feature (1495)..(1495): n is a, c, t, g, unknown, or other
  misc_feature (1506)..(1506): n is a, c, t, g, unknown, or other
ggcaccagtatatacctctgtatgtgagtgaggccaatgagagccctcgtagtcgtaagtttcgcttcggcgtgcttgctgctgctgttgcagctcgcaggagcgtcgcatgtcgtctacaactacaaggacctcgaagccgaggctgctgcggcgacggaccaggtgccgccgtccatcgtcaaccccctgctcaggacggggtaccacttccagccccccaagaactggatcaatgatcccaacgcgcccatgtactacaaggggtggtaccatttcttctaccaatacaatcccaaggscgccgtatggggcaacatcgygtgggcgcactcggtgtcgcgagacctcatcaactgggtggcgctagagccggcgctcagaccaagcatcccgggcgacaggtacggctgctggtccgggtcggcgacggtgctgcccgacggcggcggcccggtgatcatgwacacgggcgtggaccacccggacatcaactaccaggtccrgaacgtggcgtacccgaagaacgtgtcggacccgctgctccgggagtgggtgaagccctcgcacaaccccgtcatcgtccccgagggcggcatcaacgygacgcagttccgcgacccgaccacggcctggcgcggccccggccccgagcagtggcggctgctcgtcggcagcgcggcggggtcgtcgccgccccgcggcgtggcgtacgtgtaccgyagccgcgacttccggcggtggaggcgggtgcggcggccgctgcactcggcgcccacggggatgtgggagtgcccygacttctacccggtgagcaagggcggcgcgccgcgcgcggggctmgagacgtccgtgccgcccggcccaagggtsaagcacgtgctcaagaacagcctcgacctccggcggtacgactactacaccgtgggcacgtaccacccgagggccgagcggtacgtgccggacgaccccgccggcgacgagcaccgcctgcgctacgactacggcaacttctacgcgtccaagacgttctacgacccggccaagcggcgccgcatcctgtggggctgggctaacgagtccgacaccgccgccgacgatgtggcyaaaggctgggctggaatccaggcsattccaaggacggtgtggctggaccccagygggaagcagctgytgcagtggcctatcgaggaggtggaggcgctgagagcaaagtcggtcactctcargaacagggtaatcaaggcaggacatcacgtcgaggtgaccgggatacaracggcacaggctgacgtggaggtgagcttcgargtgtcgccgkcggccctggccggtgccgagacgctggacccggcgctggcctacgacgcggagaggctgtgcggcgtgaagcgcgcggacgtgmggggcggcgtggggcygttcgggactgtgggtgctggcctccgccaaccgcaaggagagaaccgcggtgttcttcagggtgttcangnnngccgccggcancgacaagcccgtggtgctcatgtgcaccgaccctaccaagtcgtcccwgaacccgaacctgtaccgsccgacatttgcaggatttgtygacacggacatctcgaacggcaagatatccctgagaagcctgatcgaccgrtcggtcgtkgagagcttcggagccgggggcaagacctgcatcctctccagggtctacccgtcgctggccatcggcaaggacgctcgcctctacgtgttcaacaacgggagggcgcacgtcaaggtgtcccgtctcaccgcgtgggagatgaagaagccggtcatgaacggggcctgaagatcttgaataaawaatatatcacccatgcatgacatatagtggcgcctgaggaatctttccttttttwttaaacatattttagatgtcgtttattaagagttgattstccatactaaagggcgccccgttatatgttacaatggtaccagctgcacttctagtaacaaagacaaattgactatttgttgttc

SEQ ID NO: 2188 - protein, 2016 aa, Zea mays
  misc_feature: PFam Name: GRP; PFam Description: Glycine rich protein family
  misc_feature: PFam Name: Transferase; PFam Description: Transferase family
  misc_feature: GI Number: 34912066; NR Description: P0445H04.35 [Oryza sativa (japonica cultivar-group)] >gi|20521218|dbj|BAB91735.1| P0671D01.12 [Oryza sativa (japonica cultivar-group)] >gi|21952910|dbj|BAC06322.1| P0445H04.35 [Oryza sativa (japonica
  misc_feature: GI Number: 34911600; NR Description: P0004A09.25 [Oryza sativa (japonica cultivar-group)] >gi|15290094|dbj|BAB63787.1|
  misc_feature: GI Number: 66776365; NR Description: PE-PGRS family protein [Anaeromyxobacter dehalogenans 2CP-C] >gi|66857891|ref|ZP_00401930.1| PE-PGRS family protein
  misc_feature: GI Number: 66778264; NR Description: LigA [Anaeromyxobacter dehalogenans 2CP-C] >gi|66856061|ref|ZP_00400131.1| LigA
  misc_feature: GI Number: 66776103; NR Description: LigA [Anaeromyxobacter dehalogenans 2CP-C] >gi|66858140|ref|ZP_00402169.1| LigA
GGCACCAGTATATACCTCTGTATGTGAGTGAGGCCAATGAGAGCCCTCGTAGTCGTAAGTTTCGCTTCGGCGTGCTTGCTGCTGCTGTTGCAGCTCGCAGGAGCGTCGCATGTCGTCTACAACTACAAGGACCTCGAAGCCGAGGCTGCTGCGGCGACGGACCAGGTGCCGCCGTCCATCGTCAACCCCCTGCTCAGGACGGGGTACCACTTCCAGCCCCCCAAGAACTGGATCAATGATCCCAACGCGCCCATGTACTACAAGGGGTGGTACCATTTCTTCTACCAATACAATCCCAAGGSCGCCGTATGGGGCAACATCGYGTGGGCGCACTCGGTGTCGCGAGACCTCATCAACTGGGTGGCGCTAGAGCCGGCGCTCAGACCAAGCATCCCGGGCGACAGGTACGGCTGCTGGTCCGGGTCGGCGACGGTGCTGCCCGACGGCGGCGGCCCGGTGATCATGWACACGGGCGTGGACCACCCGGACATCAACTACCAGGTCCRGAACGTGGCGTACCCGAAGAACGTGTCGGACCCGCTGCTCCGGGAGTGGGTGAAGCCCTCGCACAACCCCGTCATCGTCCCCGAGGGCGGCATCAACGYGACGCAGTTCCGCGACCCGACCACGGCCTGGCGCGGCCCCGGCCCCGAGCAGTGGCGGCTGCTCGTCGGCAGCGCGGCGGGGTCGTCGCCGCCCCGCGGCGTGGCGTACGTGTACCGYAGCCGCGACTTCCGGCGGTGGAGGCGGGTGCGGCGGCCGCTGCACTCGGCGCCCACGGGGATGTGGGAGTGCCCYGACTTCTACCCGGTGAGCAAGGGCGGCGCGCCGCGCGCGGGGCTMGAGACGTCCGTGCCGCCCGGCCCAAGGGTSAAGCACGTGCTCAAGAACAGCCTCGACCTCCGGCGGTACGACTACTACACCGTGGGCACGTACCACCCGAGGGCCGAGCGGTACGTGCCGGACGACCCCGCCGGCGACGAGCACCGCCTGCGCTACGACTACGGCAACTTCTACGCGTCCAAGACGTTCTACGACCCGGCCAAGCGGCGCCGCATCCTGTGGGGCTGGGCTAACGAGTCCGACACCGCCGCCGACGATGTGGCYAAAGGCTGGGCTGGAATCCAGGCSATTCCAAGGACGGTGTGGCTGGACCCCAGYGGGAAGCAGCTGYTGCAGTGGCCTATCGAGGAGGTGGAGGCGCTGAGAGCAAAGTCGGTCACTCTCARGAACAGGGTAATCAAGGCAGGACATCACGTCGAGGTGACCGGGATACARACGGCACAGGCTGACGTGGAGGTGAGCTTCGARGTGTCGCCGKCGGCCCTGGCCGGTGCCGAGACGCTGGACCCGGCGCTGGCCTACGACGCGGAGAGGCTGTGCGGCGTGAAGCGCGCGGACGTGMGGGGCGGCGTGGGGCYGTTCGGGACTGTGGGTGCTGGCCTCCGCCAACCGCAAGGAGAGAACCGCGGTGTTCTTCAGGGTGTTCANGNNNGCCGCCGGCANCGACAAGCCCGTGGTGCTCATGTGCACCGACCCTACCAAGTCGTCCCWGAACCCGAACCTGTACCGSCCGACATTTGCAGGATTTGTYGACACGGACATCTCGAACGGCAAGATATCCCTGAGAAGCCTGATCGACCGRTCGGTCGTKGAGAGCTTCGGAGCCGGGGGCAAGACCTGCATCCTCTCCAGGGTCTACCCGTCGCTGGCCATCGGCAAGGACGCTCGCCTCTACGTGTTCAACAACGGGAGGGCGCACGTCAAGGTGTCCCGTCTCACCGCGTGGGAGATGAAGAAGCCGGTCATGAACGGGGCCTGAAGATCTTGAATAAAWAATATATCACCCATGCATGACATATAGTGGCGCCTGAGGAATCTTTCCTTTTTTWTTAAACATATTTTAGATGTCGTTTATTAAGAGTTGATTSTCCATACTAAAGGGCGCCCCGTTATATGTTACAATGGTACCAGCTGCACTTCTAGTAACAAAGACAAATTGACTATTTGTTGTTC

SEQ ID NO: 2189 - DNA, 1711 bp, Zea mays
  misc_feature (1)..(1711): Ceres cDNA ID no. 13494557
  misc_feature (1)..(1711): Ceres CLONE  ID no. 261790
  misc_feature (1)..(1711): Also known as  Ceres CDNA ID no. 23756564
taatcgaaaagtgcttcaagaattgatccgttcgcggtgcgacctccagctccaggagcagcaccaatcccccaagccgccatggccgccgaccccacgctgctgcttctcgtacctttcctcgccatccccctctacttcttcttggccaccagacgtaggacgccacgcgggggcgcgcggctcccgccggggccgtgggcgctgcccgtggtcgggcacctgcatcacctagcccggggcctcccgcaccgcgtcatgcgcgacctggcgaggcgccacggcccgctcatgatgctccggttcggcgaggtccccgtggtggtggcctcctcgccggccgcggcgcgcgaggtgatgcggacccacgacgcggcgttcgcgtcgcggcccatcggtcccgtgtcccggctctggttccagggcgccgagggcatcctcttcgcgccctacggcgacgactggcgccacctccgcagggtctgcacccaggagctcctcaccgcccgccgcgtccaatccttccgccccgtgcgcgaggacgagctccgccgcctgctcgcctccgtcgcctcgacgtcggggcccgtcaacctgaccgagaagatatcgacctacatcgccgactccacggtgcgcgccatcatcggcagccgacggctcaaggaccgcgacgcgtacctgcggatgctcaagggcctcttcggcatcatgcccgggatgagcctgccggacctcttcccgtcctcgcgcctcgccatgctcctcagccgcgctcctgcccggatccaggcctaccgtcgcagcatggcgacgcatcatggacggcatcatccaggagcaccgggacagagcagccgctggcgacggcgacgaagaggacttcgttgacgtgctcctcagacttcagaaggaagtggactcccagttcccgctcacaactgagaacatcaaaacagtcatgctggacatctttggcgcgagcacggagacgtcgacgacgacgctggattgggcgatggccgagctcctgcggaaccccagggtgatggagaaggcgcagcgtgaggtccggcaagcgctttccggccacggcgcggtgaccgaggacagactagccggcctgcgctacctgcgcttcgtcatcaaggagtcgctgcggctgcacccgccggcgacgatgctggttccacgccagtgccagagcgcgtgccaggtgctcgggtacgacgtgccggcgggcatcacggtgatcgtgaacgcgtgggcgatcggcagggacccggcccactgggacgagcccgacaagttcttgccggaaaggttcgagcagagtaccagggacttcaagggggcagacttcgagttcataccgttcggtgccgggcggcggatctgccccggcatgacgttcgggctggctcatatcgagatcgcgctcgccgcgttgctgttccacttcgactggagtttgccgggagggctagcggcggaggagctggacatgaccgaggcatttgggattgctacgccacggcgttccgaccttttggtggtggcaacccctcgtgtcccacttccacaaagttaccgtatataggcattattattctccttgagggcttgttcggttattcctatcctatgtagattggatgggattggaaaaaattatgaaagattttaacttgtttaggattgaaactcatct

SEQ ID NO: 2190 - protein, 1711 aa, Zea mays
  misc_feature: PFam Name: p450; PFam Description: Cytochrome P450
  misc_feature: GI Number: 51535458; NR Description: putative cytochrome P450
  misc_feature: GI Number: 51535459; NR Description: putative cytochrome P450
  misc_feature: GI Number: 51535463; NR Description: putative cytochrome P450
  misc_feature: GI Number: 51536372; NR Description: putative cytochrome P450
  misc_feature: GI Number: 34914838; NR Description: putative cytochrome P450 [Oryza sativa (japonica cultivar-group)] >gi|13365974|dbj|BAB39252.1| putative cytochrome P450 [Oryza sativa (japonica cultivar-group)] >gi|14587241|dbj|BAB61166.1|
TAATCGAAAAGTGCTTCAAGAATTGATCCGTTCGCGGTGCGACCTCCAGCTCCAGGAGCAGCACCAATCCCCCAAGCCGCCATGGCCGCCGACCCCACGCTGCTGCTTCTCGTACCTTTCCTCGCCATCCCCCTCTACTTCTTCTTGGCCACCAGACGTAGGACGCCACGCGGGGGCGCGCGGCTCCCGCCGGGGCCGTGGGCGCTGCCCGTGGTCGGGCACCTGCATCACCTAGCCCGGGGCCTCCCGCACCGCGTCATGCGCGACCTGGCGAGGCGCCACGGCCCGCTCATGATGCTCCGGTTCGGCGAGGTCCCCGTGGTGGTGGCCTCCTCGCCGGCCGCGGCGCGCGAGGTGATGCGGACCCACGACGCGGCGTTCGCGTCGCGGCCCATCGGTCCCGTGTCCCGGCTCTGGTTCCAGGGCGCCGAGGGCATCCTCTTCGCGCCCTACGGCGACGACTGGCGCCACCTCCGCAGGGTCTGCACCCAGGAGCTCCTCACCGCCCGCCGCGTCCAATCCTTCCGCCCCGTGCGCGAGGACGAGCTCCGCCGCCTGCTCGCCTCCGTCGCCTCGACGTCGGGGCCCGTCAACCTGACCGAGAAGATATCGACCTACATCGCCGACTCCACGGTGCGCGCCATCATCGGCAGCCGACGGCTCAAGGACCGCGACGCGTACCTGCGGATGCTCAAGGGCCTCTTCGGCATCATGCCCGGGATGAGCCTGCCGGACCTCTTCCCGTCCTCGCGCCTCGCCATGCTCCTCAGCCGCGCTCCTGCCCGGATCCAGGCCTACCGTCGCAGCATGGCGACGCATCATGGACGGCATCATCCAGGAGCACCGGGACAGAGCAGCCGCTGGCGACGGCGACGAAGAGGACTTCGTTGACGTGCTCCTCAGACTTCAGAAGGAAGTGGACTCCCAGTTCCCGCTCACAACTGAGAACATCAAAACAGTCATGCTGGACATCTTTGGCGCGAGCACGGAGACGTCGACGACGACGCTGGATTGGGCGATGGCCGAGCTCCTGCGGAACCCCAGGGTGATGGAGAAGGCGCAGCGTGAGGTCCGGCAAGCGCTTTCCGGCCACGGCGCGGTGACCGAGGACAGACTAGCCGGCCTGCGCTACCTGCGCTTCGTCATCAAGGAGTCGCTGCGGCTGCACCCGCCGGCGACGATGCTGGTTCCACGCCAGTGCCAGAGCGCGTGCCAGGTGCTCGGGTACGACGTGCCGGCGGGCATCACGGTGATCGTGAACGCGTGGGCGATCGGCAGGGACCCGGCCCACTGGGACGAGCCCGACAAGTTCTTGCCGGAAAGGTTCGAGCAGAGTACCAGGGACTTCAAGGGGGCAGACTTCGAGTTCATACCGTTCGGTGCCGGGCGGCGGATCTGCCCCGGCATGACGTTCGGGCTGGCTCATATCGAGATCGCGCTCGCCGCGTTGCTGTTCCACTTCGACTGGAGTTTGCCGGGAGGGCTAGCGGCGGAGGAGCTGGACATGACCGAGGCATTTGGGATTGCTACGCCACGGCGTTCCGACCTTTTGGTGGTGGCAACCCCTCGTGTCCCACTTCCACAAAGTTACCGTATATAGGCATTATTATTCTCCTTGAGGGCTTGTTCGGTTATTCCTATCCTATGTAGATTGGATGGGATTGGAAAAAATTATGAAAGATTTTAACTTGTTTAGGATTGAAACTCATCT

SEQ ID NO: 2191 - DNA, 1957 bp, Zea mays
  misc_feature (1)..(1957): Ceres cDNA ID no. 13494733
  misc_feature (1)..(1957): Ceres CLONE  ID no. 218351
  misc_feature (1)..(1957): Also known as  Ceres CDNA ID no. 23753365
  misc_feature (251)..(251): n is a, c, t, g, unknown, or other
aggcctccactcattcctgcccccgacactcccactgccaccagtcctctcaccgccaggcgcggcacaatgcagccgcctacccttctcccgctaggcgccgtcgtggtcgccatcctcctgctcgccaccgccccgagccccgccgtctcccgccaccgccactcgtccgccgcggacacggagacgctcgatgtagccgcctcgctctcccgcgcccgcgccgcgctctccaccgacgccgtctcggntgcaccagtccgcggccgccgccgccgccggggcgaagcgctccccgcgagcgcgggagggcggcctcacgctgcggctccactcccgggacttcctgcccgaggagcaggggcggcacgagacgtaccgctcgctcgtgctctcccgcctccgccgcgactcggcgcgcgccgctgcggtgtcggcccgcgcgacgctggcggcggacggcgtgacccggctggacctgcgccccgcgaacgggtcggcggtgttcgcggcgtcggcggcggcggcggcgatccagggtcccgtggtgtccggcgtcgggcagggcagcggcgagtacttctcccgcgtgggcatcggcagccccgcgcggcagctgtacatggtgctggacaccggcagcgacgtcacctgggtgcagtgccagccctgcgccgactgctaccagcagtccgacccggtgttcgacccgtccctctccgcctcctacgccgccgtctcctgcgactcccagcgctgccgggacctggacaccgcggcgtgccgcaacgccacgggcgcctgcctctacgaggtggcctacggcgacggctcctacaccgtgggcgacttcgccaccgagacgctcacgctgggggactccaccccggtcggcaacgtcgccatcgggtgcggccacgacaacgagggcctcttcgtcggcgccgcggggctgctggcgctgggcggcgggccgctctccttcccgtcccagatctccgcgtccaccttctcctactgcctcgtggaccgcgactccccggccgcgtccacgctccagttcggcgacggcgccgccgaggcgggcaccgtgacggcgcctctcgtgcgcagcccgcgcacgagcaccttctactacgtggcgctttcgggcatctcggtgggcgggcagccgctgtccatcccggcatccgccttcgccatggacgccacgtcgggctcgggcggcgtcatcgtggactccggcaccgccgtgacgcggctccagtccgccgcgtacgcggcgctccgcgacgccttcgtccagggcgcgccgtcgctgccccggacctccggggtgtcgctgttcgacacgtgctacgacctgtcggaccggacgagcgtggaggtgcccgcggtgtcgctgcggttcgagggcggcggcgcgctgcggctgccggcgaagaactacctgatccccgtggacggagccggcacctactgcctggcgttcgcgccgacgaacgcggccgtgtccatcatcgggaacgtgcagcagcagggcacccgcgtcagcttcgacaccgccaggggcgccgtcggcttcacccccaacaagtgctagcctagcctagcctaagcctgccttctggctaaccgtgccctgttagccacggttgtcagtagtaatgacaagccggtgtttaattagcgggagaatgattagatggggggtaattaagcggtgggccctgccgggtctggggaggagcgaaaggcaaaggcgaggacagatgatgccattgccatgccagcctgtgtccggcgcgatgggtccagctccagcagtgtttctctctttctctcgagtatgcgtgcgtggagccttgtcatgacgaattagatcgtgggggctcccaagttaagagtatttatttttattttatttgctatgtcaagaaaatggaagtttccatcc

SEQ ID NO: 2192 - protein, 1957 aa, Zea mays
  misc_feature: PFam Name: Asp; PFam Description: Eukaryotic aspartyl protease
  misc_feature: PFam Name: Pyr_redox_2; PFam Description: Pyridine
  misc_feature: PFam Name: FH2; PFam Description: Formin Homology 2 Domain
  misc_feature: PFam Name: APC_basic; PFam Description: APC basic domain
  misc_feature: PFam Name: Extensin_2; PFam Description: Extensin-like region
  misc_feature: GI Number: 34895664; NR Description: nucleoid DNA-binding protein cnd41-like protein [Oryza sativa (japonica cultivar-group)] >gi|12328547|dbj|BAB21205.1| nucleoid DNA-binding protein
  misc_feature: GI Number: 23297732; NR Description: putative chloroplast nucleoid DNA-binding protein [Arabidopsis thaliana] >gi|11994113|dbj|BAB01116.1| CND41, chloroplast nucleoid DNA binding protein-like [Arabidopsis thaliana]
  misc_feature: GI Number: 19424106; NR Description: putative chloroplast
  misc_feature: GI Number: 21594980; NR Description: chloroplast nucleoid DNA
  misc_feature: GI Number: 15231010; NR Description: aspartyl protease family
AGGCCTCCACTCATTCCTGCCCCCGACACTCCCACTGCCACCAGTCCTCTCACCGCCAGGCGCGGCACAATGCAGCCGCCTACCCTTCTCCCGCTAGGCGCCGTCGTGGTCGCCATCCTCCTGCTCGCCACCGCCCCGAGCCCCGCCGTCTCCCGCCACCGCCACTCGTCCGCCGCGGACACGGAGACGCTCGATGTAGCCGCCTCGCTCTCCCGCGCCCGCGCCGCGCTCTCCACCGACGCCGTCTCGGNTGCACCAGTCCGCGGCCGCCGCCGCCGCCGGGGCGAAGCGCTCCCCGCGAGCGCGGGAGGGCGGCCTCACGCTGCGGCTCCACTCCCGGGACTTCCTGCCCGAGGAGCAGGGGCGGCACGAGACGTACCGCTCGCTCGTGCTCTCCCGCCTCCGCCGCGACTCGGCGCGCGCCGCTGCGGTGTCGGCCCGCGCGACGCTGGCGGCGGACGGCGTGACCCGGCTGGACCTGCGCCCCGCGAACGGGTCGGCGGTGTTCGCGGCGTCGGCGGCGGCGGCGGCGATCCAGGGTCCCGTGGTGTCCGGCGTCGGGCAGGGCAGCGGCGAGTACTTCTCCCGCGTGGGCATCGGCAGCCCCGCGCGGCAGCTGTACATGGTGCTGGACACCGGCAGCGACGTCACCTGGGTGCAGTGCCAGCCCTGCGCCGACTGCTACCAGCAGTCCGACCCGGTGTTCGACCCGTCCCTCTCCGCCTCCTACGCCGCCGTCTCCTGCGACTCCCAGCGCTGCCGGGACCTGGACACCGCGGCGTGCCGCAACGCCACGGGCGCCTGCCTCTACGAGGTGGCCTACGGCGACGGCTCCTACACCGTGGGCGACTTCGCCACCGAGACGCTCACGCTGGGGGACTCCACCCCGGTCGGCAACGTCGCCATCGGGTGCGGCCACGACAACGAGGGCCTCTTCGTCGGCGCCGCGGGGCTGCTGGCGCTGGGCGGCGGGCCGCTCTCCTTCCCGTCCCAGATCTCCGCGTCCACCTTCTCCTACTGCCTCGTGGACCGCGACTCCCCGGCCGCGTCCACGCTCCAGTTCGGCGACGGCGCCGCCGAGGCGGGCACCGTGACGGCGCCTCTCGTGCGCAGCCCGCGCACGAGCACCTTCTACTACGTGGCGCTTTCGGGCATCTCGGTGGGCGGGCAGCCGCTGTCCATCCCGGCATCCGCCTTCGCCATGGACGCCACGTCGGGCTCGGGCGGCGTCATCGTGGACTCCGGCACCGCCGTGACGCGGCTCCAGTCCGCCGCGTACGCGGCGCTCCGCGACGCCTTCGTCCAGGGCGCGCCGTCGCTGCCCCGGACCTCCGGGGTGTCGCTGTTCGACACGTGCTACGACCTGTCGGACCGGACGAGCGTGGAGGTGCCCGCGGTGTCGCTGCGGTTCGAGGGCGGCGGCGCGCTGCGGCTGCCGGCGAAGAACTACCTGATCCCCGTGGACGGAGCCGGCACCTACTGCCTGGCGTTCGCGCCGACGAACGCGGCCGTGTCCATCATCGGGAACGTGCAGCAGCAGGGCACCCGCGTCAGCTTCGACACCGCCAGGGGCGCCGTCGGCTTCACCCCCAACAAGTGCTAGCCTAGCCTAGCCTAAGCCTGCCTTCTGGCTAACCGTGCCCTGTTAGCCACGGTTGTCAGTAGTAATGACAAGCCGGTGTTTAATTAGCGGGAGAATGATTAGATGGGGGGTAATTAAGCGGTGGGCCCTGCCGGGTCTGGGGAGGAGCGAAAGGCAAAGGCGAGGACAGATGATGCCATTGCCATGCCAGCCTGTGTCCGGCGCGATGGGTCCAGCTCCAGCAGTGTTTCTCTCTTTCTCTCGAGTATGCGTGCGTGGAGCCTTGTCATGACGAATTAGATCGTGGGGGCTCCCAAGTTAAGAGTATTTATTTTTATTTTATTTGCTATGTCAAGAAAATGGAAGTTTCCATCC

SEQ ID NO: 2193 - DNA, 1448 bp, Zea mays
  misc_feature (1)..(1448): Ceres cDNA ID no. 13494789
  misc_feature (1)..(1448): Ceres CLONE  ID no. 294954
  misc_feature (1)..(1448): Also known as  Ceres CDNA ID no. 23776954
  misc_feature (178)..(178): n is a, c, t, g, unknown, or other
  misc_feature (255)..(255): n is a, c, t, g, unknown, or other
  misc_feature (298)..(298): n is a, c, t, g, unknown, or other
  misc_feature (311)..(311): n is a, c, t, g, unknown, or other
  misc_feature (879)..(879): n is a, c, t, g, unknown, or other
  misc_feature (1126)..(1126): n is a, c, t, g, unknown, or other
gactcagtggcacggggcgcggacgctgccgctcgcgatatttgcgagagagagagagagagagagggcccgagagccgaggacgagtgcagtctggctggcgtgatgctgcttcggagcgcgtcctcgccgctgctcaactgcgggcgcgcgccggctgcggcggcgtcggtcgagncacctcgcggtggtttcgccgttgttatcaccggcagtggcggcgctaggcaggggccggtgctgtgccgcgccatntccgagggggacctcgccgcgccgctcgtgcccaagaaggatnatggacacggganggcgccgaggctatcggcgtccttgtcctcgtccgcctccatcttcgtcgaggaggacggcgagggcgaggaggaggaggaggacctggtcgcggtcgcggtcgcgggggccggcgtggacgtgccgctgccgctgcgtcggctgctgacgaacacggggctggacgtgtccgccgccgcggcgctggcgttcgtggagcagggcgtcggcggcagcggcgggggcgggaaggcgtgcggcagcagcggcggcaagggtggggtcggggacggcgacggtggcagcaaccgcgccgccacggacgcccactaccggcagatgatcgaggcggacccgggcaactcgctgctcctggtcaactacgccaggttcctcaaggaggtggcgggggacgcagcaagggcgcaggagtactgcgagcgcgccatcctcgccagtcccggcgacgccgaggcgctgtcgctctacgcgggcctcgtttgggagaccagccgcgacgctggccgcgccgaggactactacagccgcgccgtccaggccgcacccgacgactgctacgtcctgggntcttacgccgggttcctgtgggacgccgaggaggacgaggaagagaactccgagcccttgccacctccttcgctgttccagggggcagctcagcgtccttccatcacagcggcctcttagatgatcgtgaactcgatctagatctcaccaccgcctgtgaacgaagctgaatctggaaccctggagagtggagagtgactgggagtgggagataaccgtgcagaaacccccgacgagtgactcgcantcgccggccggctcctcgccgcttgtgaactgaatcacggcacatgtaaaactgaatctggcagagcacacacgcgccgcgcctaagcctattagcgtctatagactttgcagggctatgtatagtagatatgtagattgagaccctgctgagcttgtacgtgcagtatgttcctagtcacttgtgtatcattactagtaatgcagtatctctcgcaaaataaacgtcaaaaacccttcctgctgcttcatccgagcagagcatcttccaagaagagcagatatcgaactgcaagaactgatgcactgaatcacaaagcttt

SEQ ID NO: 2194 - protein, 1448 aa, Zea mays
  misc_feature: PFam Name: Peptidase_S8; PFam Description: Subtilase family
  misc_feature: PFam Name: GRP; PFam Description: Glycine rich protein family
  misc_feature: GI Number: 21592868; NR Description: unknown [Arabidopsis thaliana]
  misc_feature: GI Number: 21555875; NR Description: unknown [Arabidopsis thaliana]
  misc_feature: GI Number: 66776365; NR Description: PE-PGRS family protein [Anaeromyxobacter dehalogenans 2CP-C] >gi|66857891|ref|ZP_00401930.1| PE-PGRS family protein
  misc_feature: GI Number: 66780099; NR Description: PE-PGRS family protein [Anaeromyxobacter dehalogenans 2CP-C] >gi|66854329|ref|ZP_00398411.1| PE-PGRS family protein
  misc_feature: GI Number: 56784432; NR Description: peroxidase-like protein
GACTCAGTGGCACGGGGCGCGGACGCTGCCGCTCGCGATATTTGCGAGAGAGAGAGAGAGAGAGAGGGCCCGAGAGCCGAGGACGAGTGCAGTCTGGCTGGCGTGATGCTGCTTCGGAGCGCGTCCTCGCCGCTGCTCAACTGCGGGCGCGCGCCGGCTGCGGCGGCGTCGGTCGAGNCACCTCGCGGTGGTTTCGCCGTTGTTATCACCGGCAGTGGCGGCGCTAGGCAGGGGCCGGTGCTGTGCCGCGCCATNTCCGAGGGGGACCTCGCCGCGCCGCTCGTGCCCAAGAAGGATNATGGACACGGGANGGCGCCGAGGCTATCGGCGTCCTTGTCCTCGTCCGCCTCCATCTTCGTCGAGGAGGACGGCGAGGGCGAGGAGGAGGAGGAGGACCTGGTCGCGGTCGCGGTCGCGGGGGCCGGCGTGGACGTGCCGCTGCCGCTGCGTCGGCTGCTGACGAACACGGGGCTGGACGTGTCCGCCGCCGCGGCGCTGGCGTTCGTGGAGCAGGGCGTCGGCGGCAGCGGCGGGGGCGGGAAGGCGTGCGGCAGCAGCGGCGGCAAGGGTGGGGTCGGGGACGGCGACGGTGGCAGCAACCGCGCCGCCACGGACGCCCACTACCGGCAGATGATCGAGGCGGACCCGGGCAACTCGCTGCTCCTGGTCAACTACGCCAGGTTCCTCAAGGAGGTGGCGGGGGACGCAGCAAGGGCGCAGGAGTACTGCGAGCGCGCCATCCTCGCCAGTCCCGGCGACGCCGAGGCGCTGTCGCTCTACGCGGGCCTCGTTTGGGAGACCAGCCGCGACGCTGGCCGCGCCGAGGACTACTACAGCCGCGCCGTCCAGGCCGCACCCGACGACTGCTACGTCCTGGGNTCTTACGCCGGGTTCCTGTGGGACGCCGAGGAGGACGAGGAAGAGAACTCCGAGCCCTTGCCACCTCCTTCGCTGTTCCAGGGGGCAGCTCAGCGTCCTTCCATCACAGCGGCCTCTTAGATGATCGTGAACTCGATCTAGATCTCACCACCGCCTGTGAACGAAGCTGAATCTGGAACCCTGGAGAGTGGAGAGTGACTGGGAGTGGGAGATAACCGTGCAGAAACCCCCGACGAGTGACTCGCANTCGCCGGCCGGCTCCTCGCCGCTTGTGAACTGAATCACGGCACATGTAAAACTGAATCTGGCAGAGCACACACGCGCCGCGCCTAAGCCTATTAGCGTCTATAGACTTTGCAGGGCTATGTATAGTAGATATGTAGATTGAGACCCTGCTGAGCTTGTACGTGCAGTATGTTCCTAGTCACTTGTGTATCATTACTAGTAATGCAGTATCTCTCGCAAAATAAACGTCAAAAACCCTTCCTGCTGCTTCATCCGAGCAGAGCATCTTCCAAGAAGAGCAGATATCGAACTGCAAGAACTGATGCACTGAATCACAAAGCTTT

SEQ ID NO: 2195 - DNA, 1408 bp, Arabidopsis thaliana
  misc_feature (1)..(1408): Ceres cDNA ID no. 13495671
  misc_feature (1)..(1408): Ceres CLONE  ID no. 32212
  misc_feature (1)..(1408): Also known as  Ceres CDNA ID no. 23380276
tttttttttttttttcttctgctttcgtgactttcaggggacacttttgtttttataacttacgcttaaaatcctatgaattcgccgccggttgacgcaatgattaccggagaatcatcgtcacaaagatctatcccaacgccgtttctcacaaaaacgtttaacctcgttgaagatagttccatcgacgatgttatctcatggaacgaagatggttcctctttcatcgtatggaatccgacagatttcgctaaagatttgcttcctaaacacttcaaacacaacaatttctctagtttcgttcgtcagctcaacacttacggattcaaaaaagttgtaccggatcgatgggagttttcaaacgatttctttaagagaggagaaaaacgtcttctccgtgagatccaacgtcggaaaataacaacgacgcatcaaacagttgttgctccttcgtcggaacaacgaaaccagacgatggttgtatcaccgtcaaattccggggaagataataataataatcaggtgatgtcttcgtctccgtcgtcgtggtattgtcatcaaacgaagacgactgggaatggtggtttatcagtggagttattggaagagaacgagaagcttcggagtcaaaacattcagctaaaccgtgagcttactcagatgaaatctatctgcgataatatctatagtctcatgtcgaattacgtcggatctcagcccactgatcggagttattctcccggaggtagtagtagtcaaccgatggagtttttaccggcgaagcggttttcggagatggagattgaagaagaagaagaagcgagtccgaggttgtttggtgttccgattgggttaaaacggacgagaagtgaaggtgttcaggtgaagacgacggcggtggttggggaaaattccgatgaggagacgccgtggttgagacattataatcgaaccaatcagagagtttgtaattaaaaacgaacggtttagatttgtggtgtagatatgtgcgcgaagtagacgattacagctttttaagacaagcagagcacgtgtcccatctgtttcaagaagtttctgcaatcttgacttcttcttttaacactttgtgttttttattatttaattaataacaataaatgttctttttcagttttgttttcttcaaaaatagttcggctgtttctagactttccttttttgacctttttttattcttcacatctttttgtgtgttttacaaatataataaacgagaaatgaggtagggatttcttattataaggataagaaattaaaatttgtaatgtaatgaagcatctggaatctcccgtttggtgggcgcgattcagggaacgtgttgtggacccagtttcgtcgactatcacaagtacatttttagattttc

SEQ ID NO: 2196 - protein, 1408 aa, Arabidopsis thaliana
  misc_feature: PFam Name: HSF_DNA-bind; PFam Description: HSF-type DNA-binding
  misc_feature: GI Number: 30794050; NR Description: putative heat shock factor 6 [Arabidopsis thaliana] >gi|30793833|gb|AAP40369.1| putative heat shock factor 6 [Arabidopsis thaliana] >gi|10176919|dbj|BAB10163.1| heat shock factor 6 [Arabidopsis
  misc_feature: GI Number: 6624618; NR Description: heat shock factor 7
  misc_feature: GI Number: 30725616; NR Description: At4g11660 [Arabidopsis thaliana] >gi|4539457|emb|CAB39937.1| heat shock transcription factor-like protein [Arabidopsis thaliana] >gi|7267866|emb|CAB78209.1| heat shock transcription factor-like
  misc_feature: GI Number: 52077317; NR Description: putative heat shock
  misc_feature: GI Number: 52077316; NR Description: putative heat shock
TTTTTTTTTTTTTTTCTTCTGCTTTCGTGACTTTCAGGGGACACTTTTGTTTTTATAACTTACGCTTAAAATCCTATGAATTCGCCGCCGGTTGACGCAATGATTACCGGAGAATCATCGTCACAAAGATCTATCCCAACGCCGTTTCTCACAAAAACGTTTAACCTCGTTGAAGATAGTTCCATCGACGATGTTATCTCATGGAACGAAGATGGTTCCTCTTTCATCGTATGGAATCCGACAGATTTCGCTAAAGATTTGCTTCCTAAACACTTCAAACACAACAATTTCTCTAGTTTCGTTCGTCAGCTCAACACTTACGGATTCAAAAAAGTTGTACCGGATCGATGGGAGTTTTCAAACGATTTCTTTAAGAGAGGAGAAAAACGTCTTCTCCGTGAGATCCAACGTCGGAAAATAACAACGACGCATCAAACAGTTGTTGCTCCTTCGTCGGAACAACGAAACCAGACGATGGTTGTATCACCGTCAAATTCCGGGGAAGATAATAATAATAATCAGGTGATGTCTTCGTCTCCGTCGTCGTGGTATTGTCATCAAACGAAGACGACTGGGAATGGTGGTTTATCAGTGGAGTTATTGGAAGAGAACGAGAAGCTTCGGAGTCAAAACATTCAGCTAAACCGTGAGCTTACTCAGATGAAATCTATCTGCGATAATATCTATAGTCTCATGTCGAATTACGTCGGATCTCAGCCCACTGATCGGAGTTATTCTCCCGGAGGTAGTAGTAGTCAACCGATGGAGTTTTTACCGGCGAAGCGGTTTTCGGAGATGGAGATTGAAGAAGAAGAAGAAGCGAGTCCGAGGTTGTTTGGTGTTCCGATTGGGTTAAAACGGACGAGAAGTGAAGGTGTTCAGGTGAAGACGACGGCGGTGGTTGGGGAAAATTCCGATGAGGAGACGCCGTGGTTGAGACATTATAATCGAACCAATCAGAGAGTTTGTAATTAAAAACGAACGGTTTAGATTTGTGGTGTAGATATGTGCGCGAAGTAGACGATTACAGCTTTTTAAGACAAGCAGAGCACGTGTCCCATCTGTTTCAAGAAGTTTCTGCAATCTTGACTTCTTCTTTTAACACTTTGTGTTTTTTATTATTTAATTAATAACAATAAATGTTCTTTTTCAGTTTTGTTTTCTTCAAAAATAGTTCGGCTGTTTCTAGACTTTCCTTTTTTGACCTTTTTTTATTCTTCACATCTTTTTGTGTGTTTTACAAATATAATAAACGAGAAATGAGGTAGGGATTTCTTATTATAAGGATAAGAAATTAAAATTTGTAATGTAATGAAGCATCTGGAATCTCCCGTTTGGTGGGCGCGATTCAGGGAACGTGTTGTGGACCCAGTTTCGTCGACTATCACAAGTACATTTTTAGATTTTC

SEQ ID NO: 2197 - DNA, 1394 bp, Arabidopsis thaliana
  misc_feature (1)..(1394): Ceres cDNA ID no. 13495730
  misc_feature (1)..(1394): Ceres CLONE  ID no. 260615
  misc_feature (1)..(1394): Also known as  Ceres CDNA ID no. 23380494
tgagacgagaggcacacaaaaagagatacaaaaccaaaactttcaagcaaagcaattcaatttcaatcaaaaaccaaatcgaagatctttgaaagtttcctttttttccgaaatctgagcttgggtattgttggataagcttctcggagattgagattgaggattttgataggtgaggagattgaaagatttggatttttgggcggcaaaaatggtgatgcagacggaagctagggttggtgtgagctcaggacatggcgtagcttcgtcttctcatcgtttaacgcaggaccagagatcacatatcgaatcggcgtcgcagctcttagccggaggactcgctggtgcttttagcaagacttgtactgctcctctatctcgtctcaccattctcttccaggtgcaaggtatgcacacaaatgctgcagctttaagaaagccaagcatattacacgaggcttcacggatattgaatgaagaaggattgaaagctttttggaaagggaatctagttactattgctcaccggcttccatattcttctgttaatttctacgcatatgaacactacaagaagttcatgtatatggttactgggatggaaaatcacaaggagggtataagttcaaacctttttgtacattttgtagccggtggtttggctggaatcacagctgcttctgccacttatccacttgatcttgttagaactcgtcttgctgctcagacaaaagtaatctactactcgggtatctggcatactctgcgctctattacaaccgatgaaggtatcttgggcctctacaagggactaggaacaacgcttgtgggtgttgggcctagtattgccattagcttttctgtgtatgaatcattgagatcttattggaggtcaactaggccccatgattcccctatcatggtcagtctagcttgtggaagtctttcaggaatagcatcttcaacagctacgtttccattggatctggtgagaagaaggaagcagctggaaggaataggcgggcgagcggtagtgtacaagacaggtttgttaggcacattaaagcgtattgttcaaacggaaggagcgagaggcctgtacagaggaattcttccagagtactacaaagtggtacctggtgtagggatttgcttcatgacctacgagacactcaagctttacttcaaggatctttcttcgaatctataacggtttaaaaggttggtagatttgtttaggtctatttttggtgagaggaaaaaaactgtaaaaaccaaacagcggaaaatgataatgtatacgaaatgtagaattatatatgtagttgttggatgtagcttatacgagattaacatttgtattggtacaatccttttccattgttacatggctt

SEQ ID NO: 2198 - protein, 1394 aa, Arabidopsis thaliana
  misc_feature: PFam Name: Mito_carr; PFam Description: Mitochondrial
  misc_feature: GI Number: 21554682; NR Description: Ca-dependent solute
  misc_feature: GI Number: 17104715; NR Description: putative Ca-dependent solute carrier protein [Arabidopsis thaliana] >gi|13877985|gb|AAK44070.1| putative Ca-dependent solute carrier
  misc_feature: GI Number: 34902034; NR Description: putative peroxisomal Ca-dependent solute carrier protein [Oryza sativa (japonica cultivar-group)] >gi|29893633|gb|AAP06887.1| putative peroxisomal
  misc_feature: GI Number: 51970652; NR Description: mitochondrial carrier
  misc_feature: GI Number: 23197668; NR Description: putative mitochondrial carrier protein [Arabidopsis thaliana] >gi|22135876|gb|AAM91520.1| putative mitochondrial carrier protein [Arabidopsis thaliana] >gi|51968668|dbj|BAD43026.1|
TGAGACGAGAGGCACACAAAAAGAGATACAAAACCAAAACTTTCAAGCAAAGCAATTCAATTTCAATCAAAAACCAAATCGAAGATCTTTGAAAGTTTCCTTTTTTTCCGAAATCTGAGCTTGGGTATTGTTGGATAAGCTTCTCGGAGATTGAGATTGAGGATTTTGATAGGTGAGGAGATTGAAAGATTTGGATTTTTGGGCGGCAAAAATGGTGATGCAGACGGAAGCTAGGGTTGGTGTGAGCTCAGGACATGGCGTAGCTTCGTCTTCTCATCGTTTAACGCAGGACCAGAGATCACATATCGAATCGGCGTCGCAGCTCTTAGCCGGAGGACTCGCTGGTGCTTTTAGCAAGACTTGTACTGCTCCTCTATCTCGTCTCACCATTCTCTTCCAGGTGCAAGGTATGCACACAAATGCTGCAGCTTTAAGAAAGCCAAGCATATTACACGAGGCTTCACGGATATTGAATGAAGAAGGATTGAAAGCTTTTTGGAAAGGGAATCTAGTTACTATTGCTCACCGGCTTCCATATTCTTCTGTTAATTTCTACGCATATGAACACTACAAGAAGTTCATGTATATGGTTACTGGGATGGAAAATCACAAGGAGGGTATAAGTTCAAACCTTTTTGTACATTTTGTAGCCGGTGGTTTGGCTGGAATCACAGCTGCTTCTGCCACTTATCCACTTGATCTTGTTAGAACTCGTCTTGCTGCTCAGACAAAAGTAATCTACTACTCGGGTATCTGGCATACTCTGCGCTCTATTACAACCGATGAAGGTATCTTGGGCCTCTACAAGGGACTAGGAACAACGCTTGTGGGTGTTGGGCCTAGTATTGCCATTAGCTTTTCTGTGTATGAATCATTGAGATCTTATTGGAGGTCAACTAGGCCCCATGATTCCCCTATCATGGTCAGTCTAGCTTGTGGAAGTCTTTCAGGAATAGCATCTTCAACAGCTACGTTTCCATTGGATCTGGTGAGAAGAAGGAAGCAGCTGGAAGGAATAGGCGGGCGAGCGGTAGTGTACAAGACAGGTTTGTTAGGCACATTAAAGCGTATTGTTCAAACGGAAGGAGCGAGAGGCCTGTACAGAGGAATTCTTCCAGAGTACTACAAAGTGGTACCTGGTGTAGGGATTTGCTTCATGACCTACGAGACACTCAAGCTTTACTTCAAGGATCTTTCTTCGAATCTATAACGGTTTAAAAGGTTGGTAGATTTGTTTAGGTCTATTTTTGGTGAGAGGAAAAAAACTGTAAAAACCAAACAGCGGAAAATGATAATGTATACGAAATGTAGAATTATATATGTAGTTGTTGGATGTAGCTTATACGAGATTAACATTTGTATTGGTACAATCCTTTTCCATTGTTACATGGCTT

SEQ ID NO: 2199 - DNA, 1410 bp, Arabidopsis thaliana
  misc_feature (1)..(1410): Ceres cDNA ID no. 13495787
  misc_feature (1)..(1410): Ceres CLONE  ID no. 6275
  misc_feature (1)..(1410): Also known as  Ceres CDNA ID no. 23659740
attatagtctcgatgaagatgctgagacttagaaagaagcaacatttggtgtttctactatgcgtgtggtgtttggtggtggattggagcaaagcagaaacagaggaaagtgatggaagtcccatggagaaaacagagcaagctgctctatactctaccattcaaggctttgttggtgaatcttggaatggctcttatctttatcctgacccttgtggctggactcctatccagggtgtgacttgtgatatctatgatgagctttggtatgtaactgctctaagctttgggactatgaaagacaactctcttgcttgttctgaaagtccagtgatcagaccacaactctttgagctcaagcacctcaagtctctctctcttttcaactgcttcacaacgcctaaccgatatctagcttcaatctccgatgaaaagtggttggatctctctaaaagcttggagagacttgagatcagatcaaacccgggactgataggtgaactcccttctgtcatcactaacctcaccaaccttcaatctctggtggtgctagaaaacaagttaacaggtccattgccagtgaatttggccaagttaaccagattgagacgtttagtactgtctggaaaccggttcacagggagaatacctgaggtctacgggttaaccggattgttgatattggatgtgagcaggaatttcttatctggggcgttgcctttaagcgttggaggattgtattctctgctgaaacttgatcttagtaacaattacttggaaggaaagttacctagagagctagagtccttgaagaatctcactctattggacttgagaaacaacagattatcaggtgggttgagtaaagagatccaagagatgacttctttggtagaactggttctgtccaataatcgcctagccggggacttgacaggaataaagtggagaaatctgaagaatttagtggttcttgatctctccaacacaggcttaaaaggggagattcctggttcaatcttggagctcaagaaactgaggtttttgggtttgagcaacaacaatctcggaggcaaactcattccacaaatggaaaccgaaatgcctagtctcagcgcgctttacgtgaatggaaataacatcagcggagagttggaattctctaggtacttttatgagagaatgggaaggatacttggtgtttgggggaaccctaatctgtgttacaacggagatgagaccaagaaccttagcgatcatgttcctttcggagttaaccaatgtaagagaattaaggcagataaatattagaaccctcgttctgaatcaaagggtttgtgataacaaaaacttggaatgatacaaagctgtggtcttttcaattttgttattgcatcttatttctatagc

SEQ ID NO: 2200 - protein, 1410 aa, Arabidopsis thaliana
  misc_feature: PFam Name: LRR_1; PFam Description: Leucine Rich Repeat
  misc_feature: GI Number: 15230865; NR Description: leucine rich repeat
  misc_feature: GI Number: 34894182; NR Description: P0439B06.12 [Oryza
  misc_feature: GI Number: 34910824; NR Description: putative Hcr2-0B [Oryza sativa (japonica cultivar-group)] >gi|12328502|dbj|BAB21161.1| putative Hcr2-0B [Oryza sativa (japonica cultivar-group)] >gi|15289814|dbj|BAB63512.1| putative Hcr2-0B [Oryza sativa
  misc_feature: GI Number: 51535694; NR Description: leucine-rich repeat protein-like [Oryza sativa (japonica cultivar-group)] >gi|51535491|dbj|BAD37387.1| leucine-rich repeat protein-like
  misc_feature: GI Number: 3894387; NR Description: Hcr2-0B [Lycopersicon
ATTATAGTCTCGATGAAGATGCTGAGACTTAGAAAGAAGCAACATTTGGTGTTTCTACTATGCGTGTGGTGTTTGGTGGTGGATTGGAGCAAAGCAGAAACAGAGGAAAGTGATGGAAGTCCCATGGAGAAAACAGAGCAAGCTGCTCTATACTCTACCATTCAAGGCTTTGTTGGTGAATCTTGGAATGGCTCTTATCTTTATCCTGACCCTTGTGGCTGGACTCCTATCCAGGGTGTGACTTGTGATATCTATGATGAGCTTTGGTATGTAACTGCTCTAAGCTTTGGGACTATGAAAGACAACTCTCTTGCTTGTTCTGAAAGTCCAGTGATCAGACCACAACTCTTTGAGCTCAAGCACCTCAAGTCTCTCTCTCTTTTCAACTGCTTCACAACGCCTAACCGATATCTAGCTTCAATCTCCGATGAAAAGTGGTTGGATCTCTCTAAAAGCTTGGAGAGACTTGAGATCAGATCAAACCCGGGACTGATAGGTGAACTCCCTTCTGTCATCACTAACCTCACCAACCTTCAATCTCTGGTGGTGCTAGAAAACAAGTTAACAGGTCCATTGCCAGTGAATTTGGCCAAGTTAACCAGATTGAGACGTTTAGTACTGTCTGGAAACCGGTTCACAGGGAGAATACCTGAGGTCTACGGGTTAACCGGATTGTTGATATTGGATGTGAGCAGGAATTTCTTATCTGGGGCGTTGCCTTTAAGCGTTGGAGGATTGTATTCTCTGCTGAAACTTGATCTTAGTAACAATTACTTGGAAGGAAAGTTACCTAGAGAGCTAGAGTCCTTGAAGAATCTCACTCTATTGGACTTGAGAAACAACAGATTATCAGGTGGGTTGAGTAAAGAGATCCAAGAGATGACTTCTTTGGTAGAACTGGTTCTGTCCAATAATCGCCTAGCCGGGGACTTGACAGGAATAAAGTGGAGAAATCTGAAGAATTTAGTGGTTCTTGATCTCTCCAACACAGGCTTAAAAGGGGAGATTCCTGGTTCAATCTTGGAGCTCAAGAAACTGAGGTTTTTGGGTTTGAGCAACAACAATCTCGGAGGCAAACTCATTCCACAAATGGAAACCGAAATGCCTAGTCTCAGCGCGCTTTACGTGAATGGAAATAACATCAGCGGAGAGTTGGAATTCTCTAGGTACTTTTATGAGAGAATGGGAAGGATACTTGGTGTTTGGGGGAACCCTAATCTGTGTTACAACGGAGATGAGACCAAGAACCTTAGCGATCATGTTCCTTTCGGAGTTAACCAATGTAAGAGAATTAAGGCAGATAAATATTAGAACCCTCGTTCTGAATCAAAGGGTTTGTGATAACAAAAACTTGGAATGATACAAAGCTGTGGTCTTTTCAATTTTGTTATTGCATCTTATTTCTATAGC

SEQ ID NO: 2201 - DNA, 1211 bp, Arabidopsis thaliana
  misc_feature (1)..(1211): Ceres cDNA ID no. 13495856
  misc_feature (1)..(1211): Ceres CLONE  ID no. 11983
  misc_feature (1)..(1211): Also known as  Ceres CDNA ID no. 23380852
aaaatttcgcaaactaattttttcactttcttcttcgttgatctctctgaaagcttctcttcttcttctcaccatgtctggttatcctccatcaagccaaggttacggttacggcggtaatccaccacctcctcagccaccgtacggatcaaccggcaataaccctcctccgtacggatcatccggcagcaatcctcctcctccgtacggatcatcagcctcctcaccgtacgcagttccctacggagctcagcccgctccttacggtgcaccaccgtcagcaccgtacgcgtctcttccaggagaccataataagccgcacaaagagaaacctcacggcgcctcctacggatctccatctcccggtggctacggtgctcatccatcgtctggaccttccgactacggtggttacggaggagcgccgcagcagtctggacatggaggaggttacggaggagcgccgcagcagtctggacatggaggaggttacggagctcctcctccgcaagcttcttatggaagtccgtttgcgtctctggttccgtcggcgtttcctcccggaacagatccgaacattgtggcttgtttccaagctgcggatcgggacaatagtggattcatcgatgataaggagcttcaaggagctctatcttcgtataatcagagcttcagcataagaactgttcatctccttatgtatctattcaccaacagcaatgtcaggaagattggaccaaaagagtttacttcacttttctttagtcttcagaattggaggtctatctttgagaggtttgataaggacagaagcggtagaatagatacaaacgagctgagagatgcactcatgagccttgggttttctgtttctcctgtgattttggatctgctggtttcaaagtttgacaaaagcggaggcaggaacagggctatcgaatatgacaatttcatcgagtgttgtttgactgtaaaggggctcaccgagaagttcaaggagaaggatacggcgttatcaggctcagctattttcaattacgagaacttcatgctcactgttttaccattcctcgtcgcttgagtgattgttttttttttttttgttgaccaaagagattgttttctaactctattttctttgtgagcttttggatattttatttgttgtctttttatctttctccggtaagattcagacgtgggtcttcttt

SEQ ID NO: 2202 - protein, 1211 aa, Arabidopsis thaliana
  misc_feature: PFam Name: FH2; PFam Description: Formin Homology 2 Domain
  misc_feature: PFam Name: efhand; PFam Description: EF hand
  misc_feature: PFam Name: Drf_FH1; PFam Description: Formin Homology Region 1
  misc_feature: PFam Name: Extensin_2; PFam Description: Extensin-like region
  misc_feature: PFam Name: GRP; PFam Description: Glycine rich protein family
  misc_feature: GI Number: 30681239; NR Description: calcium-binding EF-hand
  misc_feature: GI Number: 31711842; NR Description: At5g04170 [Arabidopsis thaliana] >gi|9955572|emb|CAC05499.1| EF-hand Calcium binding protein-like [Arabidopsis thaliana] >gi|19698991|gb|AAL91231.1| EF-hand calcium binding protein-like [Arabidopsis thaliana]
  misc_feature: GI Number: 30681234; NR Description: calcium-binding EF-hand
  misc_feature: GI Number: 6624721; NR Description: putative cysteine
  misc_feature: GI Number: 37183140; NR Description: PEF [Homo sapiens] >gi|15214839|gb|AAH12561.1| PEF protein with a long N-terminal hydrophobic domain (peflin) [Homo sapiens] >gi|12803861|gb|AAH02773.1| PEF protein with a long N-terminal
AAAATTTCGCAAACTAATTTTTTCACTTTCTTCTTCGTTGATCTCTCTGAAAGCTTCTCTTCTTCTTCTCACCATGTCTGGTTATCCTCCATCAAGCCAAGGTTACGGTTACGGCGGTAATCCACCACCTCCTCAGCCACCGTACGGATCAACCGGCAATAACCCTCCTCCGTACGGATCATCCGGCAGCAATCCTCCTCCTCCGTACGGATCATCAGCCTCCTCACCGTACGCAGTTCCCTACGGAGCTCAGCCCGCTCCTTACGGTGCACCACCGTCAGCACCGTACGCGTCTCTTCCAGGAGACCATAATAAGCCGCACAAAGAGAAACCTCACGGCGCCTCCTACGGATCTCCATCTCCCGGTGGCTACGGTGCTCATCCATCGTCTGGACCTTCCGACTACGGTGGTTACGGAGGAGCGCCGCAGCAGTCTGGACATGGAGGAGGTTACGGAGGAGCGCCGCAGCAGTCTGGACATGGAGGAGGTTACGGAGCTCCTCCTCCGCAAGCTTCTTATGGAAGTCCGTTTGCGTCTCTGGTTCCGTCGGCGTTTCCTCCCGGAACAGATCCGAACATTGTGGCTTGTTTCCAAGCTGCGGATCGGGACAATAGTGGATTCATCGATGATAAGGAGCTTCAAGGAGCTCTATCTTCGTATAATCAGAGCTTCAGCATAAGAACTGTTCATCTCCTTATGTATCTATTCACCAACAGCAATGTCAGGAAGATTGGACCAAAAGAGTTTACTTCACTTTTCTTTAGTCTTCAGAATTGGAGGTCTATCTTTGAGAGGTTTGATAAGGACAGAAGCGGTAGAATAGATACAAACGAGCTGAGAGATGCACTCATGAGCCTTGGGTTTTCTGTTTCTCCTGTGATTTTGGATCTGCTGGTTTCAAAGTTTGACAAAAGCGGAGGCAGGAACAGGGCTATCGAATATGACAATTTCATCGAGTGTTGTTTGACTGTAAAGGGGCTCACCGAGAAGTTCAAGGAGAAGGATACGGCGTTATCAGGCTCAGCTATTTTCAATTACGAGAACTTCATGCTCACTGTTTTACCATTCCTCGTCGCTTGAGTGATTGTTTTTTTTTTTTTTGTTGACCAAAGAGATTGTTTTCTAACTCTATTTTCTTTGTGAGCTTTTGGATATTTTATTTGTTGTCTTTTTATCTTTCTCCGGTAAGATTCAGACGTGGGTCTTCTTT

SEQ ID NO: 2203 - DNA, 1135 bp, Zea mays
  misc_feature (1)..(1135): Ceres cDNA ID no. 13496182
  misc_feature (1)..(1135): Ceres CLONE  ID no. 325894
  misc_feature (1)..(1135): Also known as  Ceres CDNA ID no. 23792236
gtacgacaggctgtaccgaggttcagttcggtagtgtagttgtaggttgcgatcgcgaggcggctgctggcggcggtcgccatagtagtcgtggccgccgcgctcgcgtgcggcgcgggcgcgcagctctcggcggggttctactcgtcgagctgccccgccgtgcacagcatcgtgcgccaggccatgtcgcaggccgtcacgaacaacacgcgcagcgccgccgccgtgctccgcgtcttcttccacgactgcttcgtcaatggctgcgacgcctcgctgctgctggacgacacgcccacgacgcccggcgagaagggcgccggccccaacgccggcggctccaccgtcggcttcgacctcatcgacaccatcaaggcgcaggtcgaggccgcctgccccgccaccgtctcctgcgccgacatcctggcgctcaccgcgcgcgacggcgtcaacctgctcggcggcccgagctgggccgtgccgctgggccggcgcgacgcgacgttccccaacagcacgggcgcggcgacggacctcccgggcccggactccgacctggccggcctggtggccgggttcgccgccaagggcctgagcccgcgcgacctcgcggcgctgtcgggcgcgcacacggtggggatggcgcgctgcgccagcttccgcacccgcgtctactgcgacgacaacgtgagcccggcgttcgccgcgcagcagcgccaggcctgcccgtcggccgacgccgacgacgcgctcgcgccgctcgactcgctcacccccgaccagttcgacaacggctactaccggagcctcatggccggcgccggcctgctgcactcggaccaggagctcttcagcaacggcgcactcgactcgctcgtgcgcctctacggcaccaacgccgacgccttctcgtcggacttcgccgcgtccatggtcaagctcggcaacatcggcccgctcacgggttccgcgggggaggtcaggctcaactgcaggacggtgaattcgaattcgtgacttcaggacggtgaatgccaccatttttaattctttttccctacaaggagttgtagaatttgcattccttcaacgatttcgaatttcgaatttgctgtgagtcagctgaagtggc

SEQ ID NO: 2204 - protein, 1135 aa, Zea mays
  misc_feature: PFam Name: peroxidase; PFam Description: Peroxidase
  misc_feature: PFam Name: Peptidase_S8; PFam Description: Subtilase family
  misc_feature: PFam Name: APC_basic; PFam Description: APC basic domain
  misc_feature: PFam Name: Mucin; PFam Description: Mucin-like glycoprotein
  misc_feature: PFam Name: Cation_efflux; PFam Description: Cation efflux family
  misc_feature: GI Number: 50252840; NR Description: putative bacterial-induced peroxidase precursor [Oryza sativa (japonica cultivar-group)] >gi|50251694|dbj|BAD27599.1| putative bacterial-induced peroxidase precursor [Oryza sativa (japonica
  misc_feature: GI Number: 55700919; NR Description: TPA: class III
  misc_feature: GI Number: 55700921; NR Description: TPA: class III peroxidase 27 precursor [Oryza sativa (japonica cultivar-group)] gi|50251693|dbj|BAD27598.1| putative bacterial-induced peroxidase
  misc_feature: GI Number: 5453379; NR Description: bacterial-induced
  misc_feature: GI Number: 55701039; NR Description: TPA: class III peroxidase 86 precursor [Oryza sativa (japonica cultivar-group)] gi|53792947|dbj|BAD54122.1| putative bacterial-induced peroxidase
GTACGACAGGCTGTACCGAGGTTCAGTTCGGTAGTGTAGTTGTAGGTTGCGATCGCGAGGCGGCTGCTGGCGGCGGTCGCCATAGTAGTCGTGGCCGCCGCGCTCGCGTGCGGCGCGGGCGCGCAGCTCTCGGCGGGGTTCTACTCGTCGAGCTGCCCCGCCGTGCACAGCATCGTGCGCCAGGCCATGTCGCAGGCCGTCACGAACAACACGCGCAGCGCCGCCGCCGTGCTCCGCGTCTTCTTCCACGACTGCTTCGTCAATGGCTGCGACGCCTCGCTGCTGCTGGACGACACGCCCACGACGCCCGGCGAGAAGGGCGCCGGCCCCAACGCCGGCGGCTCCACCGTCGGCTTCGACCTCATCGACACCATCAAGGCGCAGGTCGAGGCCGCCTGCCCCGCCACCGTCTCCTGCGCCGACATCCTGGCGCTCACCGCGCGCGACGGCGTCAACCTGCTCGGCGGCCCGAGCTGGGCCGTGCCGCTGGGCCGGCGCGACGCGACGTTCCCCAACAGCACGGGCGCGGCGACGGACCTCCCGGGCCCGGACTCCGACCTGGCCGGCCTGGTGGCCGGGTTCGCCGCCAAGGGCCTGAGCCCGCGCGACCTCGCGGCGCTGTCGGGCGCGCACACGGTGGGGATGGCGCGCTGCGCCAGCTTCCGCACCCGCGTCTACTGCGACGACAACGTGAGCCCGGCGTTCGCCGCGCAGCAGCGCCAGGCCTGCCCGTCGGCCGACGCCGACGACGCGCTCGCGCCGCTCGACTCGCTCACCCCCGACCAGTTCGACAACGGCTACTACCGGAGCCTCATGGCCGGCGCCGGCCTGCTGCACTCGGACCAGGAGCTCTTCAGCAACGGCGCACTCGACTCGCTCGTGCGCCTCTACGGCACCAACGCCGACGCCTTCTCGTCGGACTTCGCCGCGTCCATGGTCAAGCTCGGCAACATCGGCCCGCTCACGGGTTCCGCGGGGGAGGTCAGGCTCAACTGCAGGACGGTGAATTCGAATTCGTGACTTCAGGACGGTGAATGCCACCATTTTTAATTCTTTTTCCCTACAAGGAGTTGTAGAATTTGCATTCCTTCAACGATTTCGAATTTCGAATTTGCTGTGAGTCAGCTGAAGTGGC

SEQ ID NO: 2205 - DNA, 1485 bp, Zea mays
  misc_feature (1)..(1485): Ceres cDNA ID no. 13496204
  misc_feature (1)..(1485): Ceres CLONE  ID no. 407782
  misc_feature (1)..(1485): Also known as  Ceres CDNA ID no. 23809237
tagaacatcctaatcaaaaaaaaagctatcgcttatcatgctaggctaggcagctttgttgagaaggagcacgggggaagcccggcaagatcactacacgtggcatgtatgtccaaaactccaaatgccgagtagacagtggcggcggtagagagcgctgttaccttgcggggtgacgggggcaccttcttcggcgcggctgcagctgcagcatccgccgccgcgccggacgcggaggccgtgctggcgtaccgctcgggcgccgcgccgcgccgcggaaagccgcgaaggagggcgttgcggagggtgcgtcgccacgcgagtgcggtggaagatgacatcgggaacgcgaggggagaccaggcgcgggaagggcgggaggactgtgaagagcgcgaggagggcagcggcggcggcggcggcgctgatgctgatgctggtgcaggggctgatgagccggattcccgttcggcgtggccgcgtggggagcaagcagaagtgcagaactgcacaaggagagggcccacataaccatttctatgatattgcgcgtgtctcagtgtctcggcccagtttttcatgggctgacccggttatgtggccttgttagttttcgcctaatttcaaataacagcaatttcttagtggcccgtacactctgcagcagtgcggtgcgggcgtgcggcctccctttttttctccagttcctccggcggcggcgtgcttggcggtgcgccaggtgcccagatctccaccatcttagtcgccggcgacgagcatcaccaggttcccgatgaccatggcgcagcgcacgatgtgcctgcttcggcggtccattgggtttacagcgccgcaggcacagagagccctgagtaccactgccgcaccagcggcggagggtgcggccgtggctgaagctacggcgaaggaggcgaagaggaggaggaagaatctgtttgacgtagtgcagttcctgccagagtggggcattggatacaaggttgccaagaccacctggcgtgacgtctcctatcagatcaccaagatcaacctgtacaaggatggtcggcatggaaaggcgtgggagcttcggtacaaggcaggtgtgcaagctgcagacaccccaactaggatcagcggtgttaacaaacgtgggtggaagtacataaaagaatcacagaagaaactacaagaagcccccaaagtagacgtagctgttgctgctgcctagttcgtagttacatgcatgtttgttgtaagatgattcggtaaatctttagatggctgttgccagggtgagaacagggaaccacttttttttggatcgactctatacttttttgtcgatgacgactgaacctctctgcaacatgtccagtttcttttcttttccttatggaacgaacctttaccgtaatgtactgatgcagaagaactgcgttgattgtggcgatctagttttcattcaaacgcaagccttgtttc

SEQ ID NO: 2206 - protein, 1485 aa, Zea mays
TAGAACATCCTAATCAAAAAAAAAGCTATCGCTTATCATGCTAGGCTAGGCAGCTTTGTTGAGAAGGAGCACGGGGGAAGCCCGGCAAGATCACTACACGTGGCATGTATGTCCAAAACTCCAAATGCCGAGTAGACAGTGGCGGCGGTAGAGAGCGCTGTTACCTTGCGGGGTGACGGGGGCACCTTCTTCGGCGCGGCTGCAGCTGCAGCATCCGCCGCCGCGCCGGACGCGGAGGCCGTGCTGGCGTACCGCTCGGGCGCCGCGCCGCGCCGCGGAAAGCCGCGAAGGAGGGCGTTGCGGAGGGTGCGTCGCCACGCGAGTGCGGTGGAAGATGACATCGGGAACGCGAGGGGAGACCAGGCGCGGGAAGGGCGGGAGGACTGTGAAGAGCGCGAGGAGGGCAGCGGCGGCGGCGGCGGCGCTGATGCTGATGCTGGTGCAGGGGCTGATGAGCCGGATTCCCGTTCGGCGTGGCCGCGTGGGGAGCAAGCAGAAGTGCAGAACTGCACAAGGAGAGGGCCCACATAACCATTTCTATGATATTGCGCGTGTCTCAGTGTCTCGGCCCAGTTTTTCATGGGCTGACCCGGTTATGTGGCCTTGTTAGTTTTCGCCTAATTTCAAATAACAGCAATTTCTTAGTGGCCCGTACACTCTGCAGCAGTGCGGTGCGGGCGTGCGGCCTCCCTTTTTTTCTCCAGTTCCTCCGGCGGCGGCGTGCTTGGCGGTGCGCCAGGTGCCCAGATCTCCACCATCTTAGTCGCCGGCGACGAGCATCACCAGGTTCCCGATGACCATGGCGCAGCGCACGATGTGCCTGCTTCGGCGGTCCATTGGGTTTACAGCGCCGCAGGCACAGAGAGCCCTGAGTACCACTGCCGCACCAGCGGCGGAGGGTGCGGCCGTGGCTGAAGCTACGGCGAAGGAGGCGAAGAGGAGGAGGAAGAATCTGTTTGACGTAGTGCAGTTCCTGCCAGAGTGGGGCATTGGATACAAGGTTGCCAAGACCACCTGGCGTGACGTCTCCTATCAGATCACCAAGATCAACCTGTACAAGGATGGTCGGCATGGAAAGGCGTGGGAGCTTCGGTACAAGGCAGGTGTGCAAGCTGCAGACACCCCAACTAGGATCAGCGGTGTTAACAAACGTGGGTGGAAGTACATAAAAGAATCACAGAAGAAACTACAAGAAGCCCCCAAAGTAGACGTAGCTGTTGCTGCTGCCTAGTTCGTAGTTACATGCATGTTTGTTGTAAGATGATTCGGTAAATCTTTAGATGGCTGTTGCCAGGGTGAGAACAGGGAACCACTTTTTTTTGGATCGACTCTATACTTTTTTGTCGATGACGACTGAACCTCTCTGCAACATGTCCAGTTTCTTTTCTTTTCCTTATGGAACGAACCTTTACCGTAATGTACTGATGCAGAAGAACTGCGTTGATTGTGGCGATCTAGTTTTCATTCAAACGCAAGCCTTGTTTC

SEQ ID NO: 2207 - DNA, 1566 bp, Arabidopsis thaliana
  misc_feature (1)..(1566): Ceres cDNA ID no. 13497116
  misc_feature (1)..(1566): Ceres CLONE  ID no. 113990
  misc_feature (1)..(1566): Also known as  Ceres CDNA ID no. 23384441
gtattgtgttgttggagactgaaccatcaacgctttttcgacacttcttcttcttcctcctttctctcttcatgcaaaatcacagttacaagaaataaacaaaagattataaatcaaaacataaagagacaaaaatgagtgatggtcgagttaacgcagatcctcaacaagaagagaacatggttaaaccaccggttaagagatctctcactctcctcatcgtgacttacttttttctcttcttcggctctatcgcttcgagccttctcgcgaagtactatttcgtctacggtggctcgagccggtgggtctccacgtgggttcaatctgctggcttccctctcctcctcatcctaatctacttccctcactacgttctcaaaaccaccactcgccgtcctttcacgcgcttcacgctccgccatctcatcttctccgtgttgatcgggcttgttctcggtttcaacaacttcctcttctcatggggaacctcgtaccttccggtgtccacgtcatcgcttctcctctcgacacaactcgtcttcactctcattttgtctaggatcatagtgaaacagaagatcactttctcaaacctcaactgcgttgtcctgttgacgttaagctctgttttgttggctcttgattcgagtaaagataaaccgtccggtttaaccaaaaccaagtatttcatcgggtatgtatccacgatcggagccggtttactcttcgctctttacctccccgtgacggagaagctataccgtaccgtttattgttacgcgatggtcatggaggtgcaactggtgatggaattcgcagcgacggttttcgcgacaatcggtatggcttgcgaaggcgggtttaaggaaatggttaaggaagcgaaccatgttttcaccaaaggaccaacattttattggacgtttgcgatactagcaaatgtggtgacgtggcagctctctttcgcagccacgtcagggatggtttacttgacgtcaggtatcaccggaggtatctgcatgacggcgttgctcgcgatgaatgtgataggaggtgtggtggcttacggtgacgtgtttggtggagtgaagattgtgtcgacggtgctatgtatttggggattctcatcttacacatacgggatgtatatgaagatgaagaaggaggagaaggagaagggagaatattccggcgtaaagacgacggaagacagcggagagatggaggtggaaatgggaaatgttaaagatgacgtggcggcggcggatgatagggcttgaagatatctgtgtgattgagacggccgttatgattattattaggaaggaagccaacaaaaaaaaaaaaagtagtagtatctttttgtgttctttctttttctcaccttatgtttttttagtaatgcatttgcttttgtttttcttgtttttttaggttgttttgtttttccttttctggttatttttatgaattatcctcttatcatggccacaactaatgatgttgtacactttttaagtgtggattttccaatgtcggttgataagtatgtatttttctgtt

SEQ ID NO: 2208 - protein, 1566 aa, Arabidopsis thaliana
  misc_feature: GI Number: 34911172; NR Description: putative purine permease [Oryza sativa (japonica cultivar-group)] >gi|20161112|dbj|BAB90042.1| putative purine permease [Oryza sativa (japonica cultivar-group)] >gi|21644687|dbj|BAC01243.1|
  misc_feature: GI Number: 50900308; NR Description: putative purine permease [Oryza sativa (japonica cultivar-group)] >gi|47497669|dbj|BAD19736.1| putative purine permease [Oryza sativa
  misc_feature: GI Number: 50900310; NR Description: putative purine permease [Oryza sativa (japonica cultivar-group)] >gi|47497670|dbj|BAD19737.1| putative purine permease [Oryza sativa
  misc_feature: GI Number: 9795614; NR Description: purine permease [Arabidopsis thaliana] >gi|26450405|dbj|BAC42317.1| putative purine permease [Arabidopsis thaliana] >gi|28973199|gb|AAO63924.1| putative purine permease [Arabidopsis thaliana]
  misc_feature: GI Number: 7620007; NR Description: purine permease
GTATTGTGTTGTTGGAGACTGAACCATCAACGCTTTTTCGACACTTCTTCTTCTTCCTCCTTTCTCTCTTCATGCAAAATCACAGTTACAAGAAATAAACAAAAGATTATAAATCAAAACATAAAGAGACAAAAATGAGTGATGGTCGAGTTAACGCAGATCCTCAACAAGAAGAGAACATGGTTAAACCACCGGTTAAGAGATCTCTCACTCTCCTCATCGTGACTTACTTTTTTCTCTTCTTCGGCTCTATCGCTTCGAGCCTTCTCGCGAAGTACTATTTCGTCTACGGTGGCTCGAGCCGGTGGGTCTCCACGTGGGTTCAATCTGCTGGCTTCCCTCTCCTCCTCATCCTAATCTACTTCCCTCACTACGTTCTCAAAACCACCACTCGCCGTCCTTTCACGCGCTTCACGCTCCGCCATCTCATCTTCTCCGTGTTGATCGGGCTTGTTCTCGGTTTCAACAACTTCCTCTTCTCATGGGGAACCTCGTACCTTCCGGTGTCCACGTCATCGCTTCTCCTCTCGACACAACTCGTCTTCACTCTCATTTTGTCTAGGATCATAGTGAAACAGAAGATCACTTTCTCAAACCTCAACTGCGTTGTCCTGTTGACGTTAAGCTCTGTTTTGTTGGCTCTTGATTCGAGTAAAGATAAACCGTCCGGTTTAACCAAAACCAAGTATTTCATCGGGTATGTATCCACGATCGGAGCCGGTTTACTCTTCGCTCTTTACCTCCCCGTGACGGAGAAGCTATACCGTACCGTTTATTGTTACGCGATGGTCATGGAGGTGCAACTGGTGATGGAATTCGCAGCGACGGTTTTCGCGACAATCGGTATGGCTTGCGAAGGCGGGTTTAAGGAAATGGTTAAGGAAGCGAACCATGTTTTCACCAAAGGACCAACATTTTATTGGACGTTTGCGATACTAGCAAATGTGGTGACGTGGCAGCTCTCTTTCGCAGCCACGTCAGGGATGGTTTACTTGACGTCAGGTATCACCGGAGGTATCTGCATGACGGCGTTGCTCGCGATGAATGTGATAGGAGGTGTGGTGGCTTACGGTGACGTGTTTGGTGGAGTGAAGATTGTGTCGACGGTGCTATGTATTTGGGGATTCTCATCTTACACATACGGGATGTATATGAAGATGAAGAAGGAGGAGAAGGAGAAGGGAGAATATTCCGGCGTAAAGACGACGGAAGACAGCGGAGAGATGGAGGTGGAAATGGGAAATGTTAAAGATGACGTGGCGGCGGCGGATGATAGGGCTTGAAGATATCTGTGTGATTGAGACGGCCGTTATGATTATTATTAGGAAGGAAGCCAACAAAAAAAAAAAAAGTAGTAGTATCTTTTTGTGTTCTTTCTTTTTCTCACCTTATGTTTTTTTAGTAATGCATTTGCTTTTGTTTTTCTTGTTTTTTTAGGTTGTTTTGTTTTTCCTTTTCTGGTTATTTTTATGAATTATCCTCTTATCATGGCCACAACTAATGATGTTGTACACTTTTTAAGTGTGGATTTTCCAATGTCGGTTGATAAGTATGTATTTTTCTGTT

SEQ ID NO: 2209 - DNA, 1411 bp, Arabidopsis thaliana
  misc_feature (1)..(1411): Ceres cDNA ID no. 13497337
  misc_feature (1)..(1411): Ceres CLONE  ID no. 113014
  misc_feature (1)..(1411): Also known as  Ceres CDNA ID no. 23385245
actaccatcgtcgtctccgcgagttcttctctgcgtttaagccatagataacaaaccaaactaaaaaaaaaaagtttctccttttatcattccttctcttcccttgtataggtgtgatcctcttcaaggggatttctctggcgggtcatacattcgcaccgatcaaagtcggattggtctttcttaacgcaatcttgacccgattcaaaaaatttctgggtttgttagtgaatagataagaagataaatgggagctccgttagtgtgccacgggcattctcgtcccgtcgtcgatgtggcttatagtccggtgactccagatgggttctttctcattagcgccagcaaagattcgaatccgatgttgaggaatggagagactggtgactggattgggacttttgaaggacataagggagcagtttggagttgcagccttgataaaaatgctattcgtgctgcctcagcttctgctgatttcactgcgaaaatatggaatgcattgacaggagatgaattgcactcctttgaacacaagcacattgttcgtgcatgtgccttttctgaggacactcaccgtttactcactggtggaatggagaaaatacttcggatattcgatttgaatcggccagacgcacctccaaaagaagtcgggaattcccctggttcaattagaactgtcgaatggcttcatagtgataatacaatcttaagctcttgcacagataccggtgacattaggttatgggacataagaagtgacaagattgttcatacattagaaacaaagtccccagttactagtgctgaagtaagtcaggatgggcgatacatcactactgctgatggatctagtgttaagttttgggacgctaaaaattttggattgctgaagagctatgacatgccttgcaatgttgaatcggcatcgttggaaccgaaacacggtaacactttcattgctggaggagaagatatgtgggtgcacaggtttgatttccagactggagaagagattgggtgtaacaagggtcatcacgggccagtgcactgcgtgaggtatgcgccaggaggggagtcatacacctcaggctcagaagacggaacggtcagaatatgggtggtgggttcggtaaaccatcctgaggagagcaatctaagcggccacgtgaagcttgtggcagaggaggttgtgcgtaaagctgaaagtctccgtatcagtgagaaagccgcagaagctaaatgaaacaccatcgttagcttatgatatcacatagattcatagttgtttttgcatcattataagatgtgacaaaggggttttgccttttaaaagtctctcagaccgaataaaacgaaataatcttcaactatacttgagtgaatagtgaatctaatccaaattttg

SEQ ID NO: 2210 - protein, 1411 aa, Arabidopsis thaliana
  misc_feature: PFam Name: WD40; PFam Description: WD domain, G-beta repeat
  misc_feature: GI Number: 30725304; NR Description: At1g52730 [Arabidopsis thaliana] >gi|5903032|gb|AAD55591.1| Similar to gb|AJ010025 unr-interacting protein from Homo sapiens and contains 3 PF|00400
  misc_feature: GI Number: 50725469; NR Description: putative WD-40 repeat
  misc_feature: GI Number: 50906147; NR Description: putative serine-threonine kinase receptor-associated protein [Oryza sativa (japonica cultivar-group)] >gi|51536270|dbj|BAD38438.1| putative serine-threonine kinase receptor-associated protein [Oryza sativa
  misc_feature: GI Number: 51895969; NR Description: MGC86380 protein
  misc_feature: GI Number: 41053501; NR Description: serine/threonine kinase receptor associated protein [Danio rerio] >gi|41107550|gb|AAH65428.1| Serine/threonine kinase receptor
ACTACCATCGTCGTCTCCGCGAGTTCTTCTCTGCGTTTAAGCCATAGATAACAAACCAAACTAAAAAAAAAAAGTTTCTCCTTTTATCATTCCTTCTCTTCCCTTGTATAGGTGTGATCCTCTTCAAGGGGATTTCTCTGGCGGGTCATACATTCGCACCGATCAAAGTCGGATTGGTCTTTCTTAACGCAATCTTGACCCGATTCAAAAAATTTCTGGGTTTGTTAGTGAATAGATAAGAAGATAAATGGGAGCTCCGTTAGTGTGCCACGGGCATTCTCGTCCCGTCGTCGATGTGGCTTATAGTCCGGTGACTCCAGATGGGTTCTTTCTCATTAGCGCCAGCAAAGATTCGAATCCGATGTTGAGGAATGGAGAGACTGGTGACTGGATTGGGACTTTTGAAGGACATAAGGGAGCAGTTTGGAGTTGCAGCCTTGATAAAAATGCTATTCGTGCTGCCTCAGCTTCTGCTGATTTCACTGCGAAAATATGGAATGCATTGACAGGAGATGAATTGCACTCCTTTGAACACAAGCACATTGTTCGTGCATGTGCCTTTTCTGAGGACACTCACCGTTTACTCACTGGTGGAATGGAGAAAATACTTCGGATATTCGATTTGAATCGGCCAGACGCACCTCCAAAAGAAGTCGGGAATTCCCCTGGTTCAATTAGAACTGTCGAATGGCTTCATAGTGATAATACAATCTTAAGCTCTTGCACAGATACCGGTGACATTAGGTTATGGGACATAAGAAGTGACAAGATTGTTCATACATTAGAAACAAAGTCCCCAGTTACTAGTGCTGAAGTAAGTCAGGATGGGCGATACATCACTACTGCTGATGGATCTAGTGTTAAGTTTTGGGACGCTAAAAATTTTGGATTGCTGAAGAGCTATGACATGCCTTGCAATGTTGAATCGGCATCGTTGGAACCGAAACACGGTAACACTTTCATTGCTGGAGGAGAAGATATGTGGGTGCACAGGTTTGATTTCCAGACTGGAGAAGAGATTGGGTGTAACAAGGGTCATCACGGGCCAGTGCACTGCGTGAGGTATGCGCCAGGAGGGGAGTCATACACCTCAGGCTCAGAAGACGGAACGGTCAGAATATGGGTGGTGGGTTCGGTAAACCATCCTGAGGAGAGCAATCTAAGCGGCCACGTGAAGCTTGTGGCAGAGGAGGTTGTGCGTAAAGCTGAAAGTCTCCGTATCAGTGAGAAAGCCGCAGAAGCTAAATGAAACACCATCGTTAGCTTATGATATCACATAGATTCATAGTTGTTTTTGCATCATTATAAGATGTGACAAAGGGGTTTTGCCTTTTAAAAGTCTCTCAGACCGAATAAAACGAAATAATCTTCAACTATACTTGAGTGAATAGTGAATCTAATCCAAATTTTG

SEQ ID NO: 2211 - DNA, 1685 bp, Arabidopsis thaliana
  misc_feature (1)..(1685): Ceres cDNA ID no. 13497411
  misc_feature (1)..(1685): Ceres CLONE  ID no. 37462
  misc_feature (1)..(1685): Also known as  Ceres CDNA ID no. 23385430
ctcctatttctctcttctctctctctttaagtgagcttcgccgttaaactttctccggtaccgggaaattaacgaagaaagcgaaaagtcactgttacactaatatcacaaatctctctctgtctctctctctctctttgtcgaagtcgtgcgtgatgctagttacggtggtgaagcagcggttagtgtactctcgccggagaaattggttatgaccggaatctcacctccgtgatcgaagaaactgttttcgtttttttatcgttacgaagaaatggaaaaacaggcgaagctaacgaggacacagtcgtcgttactccggtcatcgtcgaatctccgttcgtcatatcaaagcttatcttcaatcgtcgaaggcgagcaagatctagaagccggagagaaagaagagaaacagagaagaaaaccacctaaaccattcggttcaccaaatcctaaaaccggtttaaccagaatcaatcccggtttagctttcacaatggtatctctctctttcctaagtctctcatcgttcttcttcttcgtcgtcttctcacaaaccgatgagattctcacatcggagaatcttttactagctttaatcttcgtcgctgtagctctcttcttcgcttccaagaacatctctctactaaaccaaaccgtaatcgcaatcaaaaacttagggttccaaaacagagactcgaaatcaaaaccggtacaatggtacatcggagacgattcaaaaccggagaagaaggtaatcaagagattcgttaaagaaggagttcaattctacagtaatggagatttctacgaaggtgaatttaacaaagggaagtgtaacggaagtggtgtgtattactatttcgtgagaggacgttatgaaggagattggctagatgggagatatgatggtcatgggattgagagttgggctagaggaagtagatataaaggtcaatataggcaaggtcttagacatggttttggtgtttatagattctacactggtgattgttatgctggtgagtggtttaatggtcaaagccatggttttggtgttcaatcttgttctgatggtagctcttaccttggtgagtctagatttggtgttaagcatggtcttggttcttaccatttcagaaatggagataagtatgcaggagagtactttggagacaagattcatgggtttggtgtgtatcgatttgctaatggacactgttatgaaggagcatggcatgaaggtcgtaagcaagggtttggtgcttactcgtttagaaatggtgatgctaaatctggtgaatgggattcaggggttcttgtgacttcacttcctcttacgagtgagccagtttcaagagctgttcaggcggctcgagaaacagcgaataaggcagtgaatcggagacgagtagatgagcaggtgagccgagctgtggctgcagctaataaggctgctacggctgcaagagtggctgctgtgagagccgttcagaatcaaatggatggtaaattttgtcaaagttgaaaaaaggaaaatgtaaaaaatcttttttttaccggtttctctgtaaccctgaatcgaaagtttgtttcagaggtttgtaacagagagttaattttcgatctttttactaatgtaacaaaactgtaaatagttgaagaagaagctttgtttttgttgt

SEQ ID NO: 2212 - protein, 1685 aa, Arabidopsis thaliana
  misc_feature: PFam Name: MORN; PFam Description: MORN repeat
  misc_feature: GI Number: 21593251; NR Description: phosphatidylinositol-4-phosphate 5-kinase, putative [Arabidopsis
  misc_feature: GI Number: 23297433; NR Description: putative phosphatidylinositol-4-phosphate 5-kinase [Arabidopsis thaliana] >gi|13878045|gb|AAK44100.1| putative phosphatidylinositol-4-phosphate 5-kinase [Arabidopsis thaliana]
  misc_feature: GI Number: 51535948; NR Description: 1-phosphatidylinositol-4-phosphate 5-kinase-like protein [Oryza
  misc_feature: GI Number: 37536922; NR Description: putative phosphatidylinositol-4-phosphate 5-kinase [Oryza sativa (japonica cultivar-group)] >gi|12597886|gb|AAG60194.1| putative phosphatidylinositol-4-phosphate 5-kinase [Oryza sativa]
  misc_feature: GI Number: 21928129; NR Description: AT4g17080/dl4570w [Arabidopsis thaliana] >gi|27764944|gb|AAO23593.1|
CTCCTATTTCTCTCTTCTCTCTCTCTTTAAGTGAGCTTCGCCGTTAAACTTTCTCCGGTACCGGGAAATTAACGAAGAAAGCGAAAAGTCACTGTTACACTAATATCACAAATCTCTCTCTGTCTCTCTCTCTCTCTTTGTCGAAGTCGTGCGTGATGCTAGTTACGGTGGTGAAGCAGCGGTTAGTGTACTCTCGCCGGAGAAATTGGTTATGACCGGAATCTCACCTCCGTGATCGAAGAAACTGTTTTCGTTTTTTTATCGTTACGAAGAAATGGAAAAACAGGCGAAGCTAACGAGGACACAGTCGTCGTTACTCCGGTCATCGTCGAATCTCCGTTCGTCATATCAAAGCTTATCTTCAATCGTCGAAGGCGAGCAAGATCTAGAAGCCGGAGAGAAAGAAGAGAAACAGAGAAGAAAACCACCTAAACCATTCGGTTCACCAAATCCTAAAACCGGTTTAACCAGAATCAATCCCGGTTTAGCTTTCACAATGGTATCTCTCTCTTTCCTAAGTCTCTCATCGTTCTTCTTCTTCGTCGTCTTCTCACAAACCGATGAGATTCTCACATCGGAGAATCTTTTACTAGCTTTAATCTTCGTCGCTGTAGCTCTCTTCTTCGCTTCCAAGAACATCTCTCTACTAAACCAAACCGTAATCGCAATCAAAAACTTAGGGTTCCAAAACAGAGACTCGAAATCAAAACCGGTACAATGGTACATCGGAGACGATTCAAAACCGGAGAAGAAGGTAATCAAGAGATTCGTTAAAGAAGGAGTTCAATTCTACAGTAATGGAGATTTCTACGAAGGTGAATTTAACAAAGGGAAGTGTAACGGAAGTGGTGTGTATTACTATTTCGTGAGAGGACGTTATGAAGGAGATTGGCTAGATGGGAGATATGATGGTCATGGGATTGAGAGTTGGGCTAGAGGAAGTAGATATAAAGGTCAATATAGGCAAGGTCTTAGACATGGTTTTGGTGTTTATAGATTCTACACTGGTGATTGTTATGCTGGTGAGTGGTTTAATGGTCAAAGCCATGGTTTTGGTGTTCAATCTTGTTCTGATGGTAGCTCTTACCTTGGTGAGTCTAGATTTGGTGTTAAGCATGGTCTTGGTTCTTACCATTTCAGAAATGGAGATAAGTATGCAGGAGAGTACTTTGGAGACAAGATTCATGGGTTTGGTGTGTATCGATTTGCTAATGGACACTGTTATGAAGGAGCATGGCATGAAGGTCGTAAGCAAGGGTTTGGTGCTTACTCGTTTAGAAATGGTGATGCTAAATCTGGTGAATGGGATTCAGGGGTTCTTGTGACTTCACTTCCTCTTACGAGTGAGCCAGTTTCAAGAGCTGTTCAGGCGGCTCGAGAAACAGCGAATAAGGCAGTGAATCGGAGACGAGTAGATGAGCAGGTGAGCCGAGCTGTGGCTGCAGCTAATAAGGCTGCTACGGCTGCAAGAGTGGCTGCTGTGAGAGCCGTTCAGAATCAAATGGATGGTAAATTTTGTCAAAGTTGAAAAAAGGAAAATGTAAAAAATCTTTTTTTTACCGGTTTCTCTGTAACCCTGAATCGAAAGTTTGTTTCAGAGGTTTGTAACAGAGAGTTAATTTTCGATCTTTTTACTAATGTAACAAAACTGTAAATAGTTGAAGAAGAAGCTTTGTTTTTGTTGT

SEQ ID NO: 2213 - DNA, 1703 bp, Arabidopsis thaliana
  misc_feature (1)..(1703): Ceres cDNA ID no. 13497429
  misc_feature (1)..(1703): Ceres CLONE  ID no. 108414
  misc_feature (1)..(1703): Also known as  Ceres CDNA ID no. 23385514
  misc_feature (177)..(177): n is a, c, t, g, unknown, or other
aagattcgttttctcttttatcactcccctcggcgatctctcttcttgctccggcagggtttttctgctgctccttgcttgtccggactctagcttgcctgtaactgttaagagattacaatgggggactccgataatgctataccattttccagaaagagaactgctctgaaagantgtctcgtgacaatcctggtcttgatgatgatgatgaagacacttctgcactcgagagtggtaccttcaacactgctagtaaggaggtgttggcaagcagaagaattatcagagttaggcgcacagatcgatctgctactgcaccaccagcttctaatccatttactggaattcgtttggttccttttactgctcctgctccttctactgctgctgcagaaacgactaaacctctgtctgcgggaaaacaagagacactggctgatggaaggtctgatgctaccaaggaaactgatggtgacagtaaagaaaagagtgacgcaattgatgctgtaggaaaacaagagacacagggtgatgaaatatctgctaagaccaaggatattattgatggtggagagaaagagatgagtgaggcagttaatttccgtagagggtggtggagctgtaaacaagaatgaagacgagattaagacaacgatggttactgaagttgctgctggggaagagactgtaaaagatgacaacaacaatagcaacactgttgagggaagtgactgtgttgtcaaggatacaggtggtaatcagactgagaaagaaggaaaagagtgcgatggaaatgaagacacagagaaaaatggagatagtggagccttgagctccttccaccagcactcaagtagcaaaaacgcattcacaggacttgctagcacagggttctctgcttcttcgttctcgttcggtttggttccacaagaaggttcgactgggtctggttctgaacagtcatccttcagttttggccaagcaaacaatggaaactcttccctgtttggtgcatccgttgctacttccattaccacgaagagcacggaaactactactgccttcccatcaaagcaagatgtttcagtggaaacaggagaagagaacgaaaaagcagccttcacagctgactcagtaatgttcgaatatcttgagggaggatggaaagagcgtgggaaaggagaactcaaggtgaatatatcaacgactgaaaacagaaaagccaggttagtagtgagatcaaaaggaaactacaggttgatcttaaacgcaagtctttacccggaaatgaaactggctaaaatggacaagaaaggaatcacatttgcttgtgtgaatagtgtaagtgacgccaaggatggtctctctacattggcactgaagttcaaggacccaacagtggtggaagagttccgagcagttatcgaagaacataaagacagtaaaccttccgttgcagaagcagcagctcctttgaagacacctgagaactcaccgagtgctgaagatgcttgaaggttaaaaactttgaaacaactcgtcgtctagtatccttgtgttctatttgtctatgttgtttgaagttcaaatttggcagagagaatagagagactatatagatcacttgaactccttatgggtctcttatgaatgaatattcgaagttactgtttttaacataatctatcatataactcagc

SEQ ID NO: 2214 - protein, 1703 aa, Arabidopsis thaliana
  misc_feature: PFam Name: Ran_BP1; PFam Description: RanBP1 domain
  misc_feature: GI Number: 21536684; NR Description: unknown [Arabidopsis thaliana]
  misc_feature: GI Number: 66853052; NR Description: brefeldin A resistance
  misc_feature: GI Number: 31205915; NR Description: ENSANGP00000010912 [Anopheles gambiae] >gi|21295390|gb|EAA07535.1| ENSANGP00000010912
  misc_feature: GI Number: 31209707; NR Description: ENSANGP00000012245 [Anopheles gambiae] >gi|30176849|gb|EAA09279.2| ENSANGP00000012245
AAGATTCGTTTTCTCTTTTATCACTCCCCTCGGCGATCTCTCTTCTTGCTCCGGCAGGGTTTTTCTGCTGCTCCTTGCTTGTCCGGACTCTAGCTTGCCTGTAACTGTTAAGAGATTACAATGGGGGACTCCGATAATGCTATACCATTTTCCAGAAAGAGAACTGCTCTGAAAGANTGTCTCGTGACAATCCTGGTCTTGATGATGATGATGAAGACACTTCTGCACTCGAGAGTGGTACCTTCAACACTGCTAGTAAGGAGGTGTTGGCAAGCAGAAGAATTATCAGAGTTAGGCGCACAGATCGATCTGCTACTGCACCACCAGCTTCTAATCCATTTACTGGAATTCGTTTGGTTCCTTTTACTGCTCCTGCTCCTTCTACTGCTGCTGCAGAAACGACTAAACCTCTGTCTGCGGGAAAACAAGAGACACTGGCTGATGGAAGGTCTGATGCTACCAAGGAAACTGATGGTGACAGTAAAGAAAAGAGTGACGCAATTGATGCTGTAGGAAAACAAGAGACACAGGGTGATGAAATATCTGCTAAGACCAAGGATATTATTGATGGTGGAGAGAAAGAGATGAGTGAGGCAGTTAATTTCCGTAGAGGGTGGTGGAGCTGTAAACAAGAATGAAGACGAGATTAAGACAACGATGGTTACTGAAGTTGCTGCTGGGGAAGAGACTGTAAAAGATGACAACAACAATAGCAACACTGTTGAGGGAAGTGACTGTGTTGTCAAGGATACAGGTGGTAATCAGACTGAGAAAGAAGGAAAAGAGTGCGATGGAAATGAAGACACAGAGAAAAATGGAGATAGTGGAGCCTTGAGCTCCTTCCACCAGCACTCAAGTAGCAAAAACGCATTCACAGGACTTGCTAGCACAGGGTTCTCTGCTTCTTCGTTCTCGTTCGGTTTGGTTCCACAAGAAGGTTCGACTGGGTCTGGTTCTGAACAGTCATCCTTCAGTTTTGGCCAAGCAAACAATGGAAACTCTTCCCTGTTTGGTGCATCCGTTGCTACTTCCATTACCACGAAGAGCACGGAAACTACTACTGCCTTCCCATCAAAGCAAGATGTTTCAGTGGAAACAGGAGAAGAGAACGAAAAAGCAGCCTTCACAGCTGACTCAGTAATGTTCGAATATCTTGAGGGAGGATGGAAAGAGCGTGGGAAAGGAGAACTCAAGGTGAATATATCAACGACTGAAAACAGAAAAGCCAGGTTAGTAGTGAGATCAAAAGGAAACTACAGGTTGATCTTAAACGCAAGTCTTTACCCGGAAATGAAACTGGCTAAAATGGACAAGAAAGGAATCACATTTGCTTGTGTGAATAGTGTAAGTGACGCCAAGGATGGTCTCTCTACATTGGCACTGAAGTTCAAGGACCCAACAGTGGTGGAAGAGTTCCGAGCAGTTATCGAAGAACATAAAGACAGTAAACCTTCCGTTGCAGAAGCAGCAGCTCCTTTGAAGACACCTGAGAACTCACCGAGTGCTGAAGATGCTTGAAGGTTAAAAACTTTGAAACAACTCGTCGTCTAGTATCCTTGTGTTCTATTTGTCTATGTTGTTTGAAGTTCAAATTTGGCAGAGAGAATAGAGAGACTATATAGATCACTTGAACTCCTTATGGGTCTCTTATGAATGAATATTCGAAGTTACTGTTTTTAACATAATCTATCATATAACTCAGC

SEQ ID NO: 2215 - DNA, 1060 bp, Arabidopsis thaliana
  misc_feature (1)..(1060): Ceres cDNA ID no. 13497491
  misc_feature (1)..(1060): Ceres CLONE  ID no. 13300
  misc_feature (1)..(1060): Also known as  Ceres CDNA ID no. 23385672
atcaccattgctttgttttgttcgtcaaatataatcaattttaaatttcttctcttctcttcaaacgaatcgcctttttcgataatctctttgcatcgatttcatcatggctactcaaacggatctcgctcagcccaagcttgatatgaccaaggaggagaaagagaggttgaagtatttgcaattcgtgcaagctgctgctgtggaagctctgcttcgctttgctcttatttacgctaaggcaaaggacaagtctggtcctttgaaacctggtgttgaatctgttgaaggagctgtcaagactgtcgttggtcctgtctacgagaaataccacgacgtccctgttgaggtccttaaatacatggaccagaaggttgatatgtctgtgactgagcttgaccgtcgtgtcccaccagtcgtcaagcaagtgtctgcccaagccatctccgctgctcagatagcacccattgtggcacgtgcgttggcctctgaggttcgacgtgctggtgttgttgaaaccgcttctggaatggctaaatccgtctactccaagtacgagcctgctgctaaggagttgtatgcaaactatgagccaaaagcagagcagtgtgccgtttcagcttggaagaagcttaaccagcttcctctattcccaaggctggctcaagttgctgtaccaacagctgctttctgctctgagaagtacaatgatactgtggttaaggctgcagagaaagggtacagagtcacatcgtacatgccattggttccaacagagaggatctcaaaaatcttcgctgaggagaaagctgagaccgagcctttggagttccatccacttgattgatatgggtgttttgttagtgtgattttttgttttgttgggattaaggtgaaccggatcttggttagcgattgatctctggttctcgttcttttttttctttgtcatgaacttttgttgtttcgtttaataatcaaaagttgtataatctaagtttgggattaccaccctattgagtattgagtgataaaaaaaaagttgcgtgaattatcgccc

SEQ ID NO: 2216 - protein, 1060 aa, Arabidopsis thaliana
  misc_feature: PFam Name: REF; PFam Description: Rubber elongation factor
  misc_feature: GI Number: 7596762; NR Description: stress related protein, putative [Arabidopsis thaliana] >gi|21537353|gb|AAM61694.1| stress related protein, putative [Arabidopsis thaliana] >gi|17380640|gb|AAL36083.1| AT3g05500/F22F7_5 [Arabidopsis
  misc_feature: GI Number: 5802955; NR Description: stress related protein [Vitis riparia] >gi|15214303|sp|Q9SW70|SRP_VITRI Stress-related
  misc_feature: GI Number: 37622210; NR Description: small rubber particle
  misc_feature: GI Number: 29367349; NR Description: stress-related
  misc_feature: GI Number: 33332330; NR Description: rubber synthesis protein
ATCACCATTGCTTTGTTTTGTTCGTCAAATATAATCAATTTTAAATTTCTTCTCTTCTCTTCAAACGAATCGCCTTTTTCGATAATCTCTTTGCATCGATTTCATCATGGCTACTCAAACGGATCTCGCTCAGCCCAAGCTTGATATGACCAAGGAGGAGAAAGAGAGGTTGAAGTATTTGCAATTCGTGCAAGCTGCTGCTGTGGAAGCTCTGCTTCGCTTTGCTCTTATTTACGCTAAGGCAAAGGACAAGTCTGGTCCTTTGAAACCTGGTGTTGAATCTGTTGAAGGAGCTGTCAAGACTGTCGTTGGTCCTGTCTACGAGAAATACCACGACGTCCCTGTTGAGGTCCTTAAATACATGGACCAGAAGGTTGATATGTCTGTGACTGAGCTTGACCGTCGTGTCCCACCAGTCGTCAAGCAAGTGTCTGCCCAAGCCATCTCCGCTGCTCAGATAGCACCCATTGTGGCACGTGCGTTGGCCTCTGAGGTTCGACGTGCTGGTGTTGTTGAAACCGCTTCTGGAATGGCTAAATCCGTCTACTCCAAGTACGAGCCTGCTGCTAAGGAGTTGTATGCAAACTATGAGCCAAAAGCAGAGCAGTGTGCCGTTTCAGCTTGGAAGAAGCTTAACCAGCTTCCTCTATTCCCAAGGCTGGCTCAAGTTGCTGTACCAACAGCTGCTTTCTGCTCTGAGAAGTACAATGATACTGTGGTTAAGGCTGCAGAGAAAGGGTACAGAGTCACATCGTACATGCCATTGGTTCCAACAGAGAGGATCTCAAAAATCTTCGCTGAGGAGAAAGCTGAGACCGAGCCTTTGGAGTTCCATCCACTTGATTGATATGGGTGTTTTGTTAGTGTGATTTTTTGTTTTGTTGGGATTAAGGTGAACCGGATCTTGGTTAGCGATTGATCTCTGGTTCTCGTTCTTTTTTTTCTTTGTCATGAACTTTTGTTGTTTCGTTTAATAATCAAAAGTTGTATAATCTAAGTTTGGGATTACCACCCTATTGAGTATTGAGTGATAAAAAAAAAGTTGCGTGAATTATCGCCC

SEQ ID NO: 2217 - DNA, 1164 bp, Arabidopsis thaliana
  misc_feature (1)..(1164): Ceres cDNA ID no. 13497612
  misc_feature (1)..(1164): Ceres CLONE  ID no. 32833
  misc_feature (1)..(1164): Also known as  Ceres CDNA ID no. 23386138
catcgctgtctggaagagctcggttcgagtcatcgctgtctggaacagcgatgactcgagaaccgatctcctccctctctctcttaaccactaagcaaaaatcccatctttctatataaacctctctcccaactctgctacttcccaccgtaaatcgtttctgggttcttaagaataacatggcctcgtcatcatcatcatcttatagattccaatctgggtcttaccctctttcgtcaagtccttctcttgggaatttcgtcgaacgcattaaagacgcttgtcatttccttgtctctgctgttttgggtaccattatctccgcgatcttgaccttcttcttcgcactagtgggcacattgctaggggcacttacaggagctttgataggtcaagaaactgagagtggtttcattagaggagcagcaattggagccatttcgggagctgttttctctatcgaggtctttgaatcatctctggatctctggaaatccgatgagtcgggtttcggatgttttctctacttgattgatgtcattgttagtcttctaagcgggagacttgtacgagagcgcattggtcctgcaatgctaagtgcagtgcaaagtcaaatgggagctgtggatacagcttttgatgatcacacaagcctttttgatacaggaggctcaaaaggattgacaggagaccttgttgagaaaatcccaaagatgacaatcactggcaacaataacactgatgcttctgagaacacagactcatgttctgtttgtcttcaggatttccagctcggtgaaacagttagaagcttgcctcattgtcatcacatgtttcacttaccttgcatagacaattggctccttagacacggttcttgcccgatgtgtagacgtgatatttaatctcttcatctctccatcgtccgtctctcataatgcagtttaacctcgcagttcagatatttctacagctcgtacatcaagagtctgctctgctcttcttccctcctccttgagtttcatgtaaattccagttcttttggctgtttacaattacgatacctctcttactctttcagagtcattgtaggactcctagttctctaatgtacaaagaaacacaaaaatagagtttttgttttatctaattctttactctggc

SEQ ID NO: 2218 - protein, 1164 aa, Arabidopsis thaliana
  misc_feature: PFam Name: zf-C3HC4; PFam Description: Zinc finger, C3HC4
  misc_feature: GI Number: 27524904; NR Description: NEP1-interacting protein 2 [Arabidopsis thaliana] >gi|30680091|ref|NP_179364.2| zinc finger
  misc_feature: GI Number: 27524902; NR Description: NEP1-interacting protein
  misc_feature: GI Number: 50937111; NR Description: putative NEP1-interacting protein 2 [Oryza sativa (japonica cultivar-group)] >gi|33146606|dbj|BAC79837.1| putative NEP1-interacting protein 2 [Oryza sativa (japonica cultivar-group)] [Oryza sativa (japonica
  misc_feature: GI Number: 50912679; NR Description: putative NEP1-interacting protein [Oryza sativa (japonica cultivar-group)] >gi|46390630|dbj|BAD16113.1| putative NEP1-interacting protein
  misc_feature: GI Number: 17065626; NR Description: putative RING zinc finger protein [Arabidopsis thaliana] >gi|13877953|gb|AAK44054.1| putative RING zinc finger protein [Arabidopsis thaliana] >gi|4914367|gb|AAD32903.1| putative RING zinc finger protein
CATCGCTGTCTGGAAGAGCTCGGTTCGAGTCATCGCTGTCTGGAACAGCGATGACTCGAGAACCGATCTCCTCCCTCTCTCTCTTAACCACTAAGCAAAAATCCCATCTTTCTATATAAACCTCTCTCCCAACTCTGCTACTTCCCACCGTAAATCGTTTCTGGGTTCTTAAGAATAACATGGCCTCGTCATCATCATCATCTTATAGATTCCAATCTGGGTCTTACCCTCTTTCGTCAAGTCCTTCTCTTGGGAATTTCGTCGAACGCATTAAAGACGCTTGTCATTTCCTTGTCTCTGCTGTTTTGGGTACCATTATCTCCGCGATCTTGACCTTCTTCTTCGCACTAGTGGGCACATTGCTAGGGGCACTTACAGGAGCTTTGATAGGTCAAGAAACTGAGAGTGGTTTCATTAGAGGAGCAGCAATTGGAGCCATTTCGGGAGCTGTTTTCTCTATCGAGGTCTTTGAATCATCTCTGGATCTCTGGAAATCCGATGAGTCGGGTTTCGGATGTTTTCTCTACTTGATTGATGTCATTGTTAGTCTTCTAAGCGGGAGACTTGTACGAGAGCGCATTGGTCCTGCAATGCTAAGTGCAGTGCAAAGTCAAATGGGAGCTGTGGATACAGCTTTTGATGATCACACAAGCCTTTTTGATACAGGAGGCTCAAAAGGATTGACAGGAGACCTTGTTGAGAAAATCCCAAAGATGACAATCACTGGCAACAATAACACTGATGCTTCTGAGAACACAGACTCATGTTCTGTTTGTCTTCAGGATTTCCAGCTCGGTGAAACAGTTAGAAGCTTGCCTCATTGTCATCACATGTTTCACTTACCTTGCATAGACAATTGGCTCCTTAGACACGGTTCTTGCCCGATGTGTAGACGTGATATTTAATCTCTTCATCTCTCCATCGTCCGTCTCTCATAATGCAGTTTAACCTCGCAGTTCAGATATTTCTACAGCTCGTACATCAAGAGTCTGCTCTGCTCTTCTTCCCTCCTCCTTGAGTTTCATGTAAATTCCAGTTCTTTTGGCTGTTTACAATTACGATACCTCTCTTACTCTTTCAGAGTCATTGTAGGACTCCTAGTTCTCTAATGTACAAAGAAACACAAAAATAGAGTTTTTGTTTTATCTAATTCTTTACTCTGGC

SEQ ID NO: 2219 - DNA, 1474 bp, Arabidopsis thaliana
  misc_feature (1)..(1474): Ceres cDNA ID no. 13497738
  misc_feature (1)..(1474): Ceres CLONE  ID no. 22008
  misc_feature (1)..(1474): Also known as  Ceres CDNA ID no. 23386584
atgtcggtcacagcgggagtgagtgaatctgcaattgctgtaagggagaaactaaaaggtggtattggacagactaaagtgcgaaggtattggccaggaaaagctccggagtgggctgaggaagctgaagaagatgatgatgttaggatgcagaaggtttctgttttggatagagcttttccaaagaatgatgatttgggtgttgctaggaaggatgatccaaggctgcgccgtttagctaagactaaagttgaaaaccgtgacgaagttagagctgatcatcggcggataagacaggctgagattatttatacggaagaagaagaatcgaggaatcaagagaatagagacgaggacgatgatgaagatgccttggaagagagaagaagaagaattagagagaaaaatcttagaagagcgcaagaggaggctgctttacttcctttagaagaagaagatgagatacaagaggaagaagaggaggaggaggagtctgagtacgagactgattcggaagatgatatgcctggtattgccatgattaagcctgtttttgtaccgaaagctgagagagatacaattgcagagcgagagaggcttgaggctgaagaagaagctcttgaagaattagcaaagagaaaattggagcaaagaaaattagagacaaagcaaatagtggttgaggaagttaggaaagatgaagagatacggaagaacattctattggaggaagcaaatattggagatgtggaaactgatgatgaactcaatgaagctgaggagtatgaagtttggaagacaagagagattggtaggatcaagagagaaagagatgcaagggaagctatgctgagagagagggaagaaatagagaagttgaggaatatgacagagcaggagaggagagattgggagaggaagaatccgaaacctttgtcagctcaaccgaaaaagaaatggaactttatgcagaaatattaccacaagggtgccttcttccaggcagatcctgatgatgaggcaggttctgctggaaccgatggtatatttcagcgcgacttctctgctccaactggagaagataggttggacaaatcgattctccccaaagttatgcaagtcaagcactttggtcgtagtggaagaactaaatggactcaccttgtcaatgaggacacaacagattggagtaacccgtggacttccaatgatcctctacgtgaaaaatacaacaagaaaatggcaggcatggatgctcctatcgcaaaaccaaaagggagcaagaagatgaaagattgggagtcttaaaccgcaccaacatttagtttgtttgtttttaaaatccaatgatgcagcagtggtatgtggtagtaaaaaaacatcgtaacatcttactcagttatgtctctgagtcctctaaatcctagtaattaaaaatattgctcaaaagaatgaagacctaacataattcatt

SEQ ID NO: 2220 - protein, 1474 aa, Arabidopsis thaliana
  misc_feature: PFam Name: MFAP1_C; PFam Description:
  misc_feature: PFam Name: Caldesmon; PFam Description: Caldesmon
  misc_feature: PFam Name: E-MAP-115; PFam Description: E-MAP-115 family
  misc_feature: PFam Name: Plasmodium_HRP; PFam Description: Plasmodium
  misc_feature: PFam Name: TolA; PFam Description: TolA protein
  misc_feature: GI Number: 50251322; NR Description: putative MFAP1 protein
  misc_feature: GI Number: 7267500; NR Description: putative microfibril-associated protein [Arabidopsis thaliana] >gi|2565010|gb|AAB81880.1| putative microfibril-associated protein [Arabidopsis thaliana] >gi|7487954|pir||T01826
  misc_feature: GI Number: 48104934; NR Description: similar to
  misc_feature: GI Number: 66551430; NR Description: PREDICTED: similar to
  misc_feature: GI Number: 539502; NR Description: microfibril-associated protein - chicken >gi|1709011|sp|P55080|MFA1_CHICK MICROFIBRILLAR-ASSOCIATED PROTEIN 1 (ASSOCIATED MICROFIBRIL
ATGTCGGTCACAGCGGGAGTGAGTGAATCTGCAATTGCTGTAAGGGAGAAACTAAAAGGTGGTATTGGACAGACTAAAGTGCGAAGGTATTGGCCAGGAAAAGCTCCGGAGTGGGCTGAGGAAGCTGAAGAAGATGATGATGTTAGGATGCAGAAGGTTTCTGTTTTGGATAGAGCTTTTCCAAAGAATGATGATTTGGGTGTTGCTAGGAAGGATGATCCAAGGCTGCGCCGTTTAGCTAAGACTAAAGTTGAAAACCGTGACGAAGTTAGAGCTGATCATCGGCGGATAAGACAGGCTGAGATTATTTATACGGAAGAAGAAGAATCGAGGAATCAAGAGAATAGAGACGAGGACGATGATGAAGATGCCTTGGAAGAGAGAAGAAGAAGAATTAGAGAGAAAAATCTTAGAAGAGCGCAAGAGGAGGCTGCTTTACTTCCTTTAGAAGAAGAAGATGAGATACAAGAGGAAGAAGAGGAGGAGGAGGAGTCTGAGTACGAGACTGATTCGGAAGATGATATGCCTGGTATTGCCATGATTAAGCCTGTTTTTGTACCGAAAGCTGAGAGAGATACAATTGCAGAGCGAGAGAGGCTTGAGGCTGAAGAAGAAGCTCTTGAAGAATTAGCAAAGAGAAAATTGGAGCAAAGAAAATTAGAGACAAAGCAAATAGTGGTTGAGGAAGTTAGGAAAGATGAAGAGATACGGAAGAACATTCTATTGGAGGAAGCAAATATTGGAGATGTGGAAACTGATGATGAACTCAATGAAGCTGAGGAGTATGAAGTTTGGAAGACAAGAGAGATTGGTAGGATCAAGAGAGAAAGAGATGCAAGGGAAGCTATGCTGAGAGAGAGGGAAGAAATAGAGAAGTTGAGGAATATGACAGAGCAGGAGAGGAGAGATTGGGAGAGGAAGAATCCGAAACCTTTGTCAGCTCAACCGAAAAAGAAATGGAACTTTATGCAGAAATATTACCACAAGGGTGCCTTCTTCCAGGCAGATCCTGATGATGAGGCAGGTTCTGCTGGAACCGATGGTATATTTCAGCGCGACTTCTCTGCTCCAACTGGAGAAGATAGGTTGGACAAATCGATTCTCCCCAAAGTTATGCAAGTCAAGCACTTTGGTCGTAGTGGAAGAACTAAATGGACTCACCTTGTCAATGAGGACACAACAGATTGGAGTAACCCGTGGACTTCCAATGATCCTCTACGTGAAAAATACAACAAGAAAATGGCAGGCATGGATGCTCCTATCGCAAAACCAAAAGGGAGCAAGAAGATGAAAGATTGGGAGTCTTAAACCGCACCAACATTTAGTTTGTTTGTTTTTAAAATCCAATGATGCAGCAGTGGTATGTGGTAGTAAAAAAACATCGTAACATCTTACTCAGTTATGTCTCTGAGTCCTCTAAATCCTAGTAATTAAAAATATTGCTCAAAAGAATGAAGACCTAACATAATTCATT

SEQ ID NO: 2221 - DNA, 1630 bp, Zea mays
  misc_feature (1)..(1630): Ceres cDNA ID no. 13498060
  misc_feature (1)..(1630): Ceres CLONE  ID no. 216901
  misc_feature (1)..(1630): Also known as  Ceres CDNA ID no. 23741068
  misc_feature (60)..(60): n is a, c, t, g, unknown, or other
  misc_feature (61)..(61): n is a, c, t, g, unknown, or other
aataatggccggcgcccaagaagctggcgacgccctggtcatcagccgtgcgcgcggcgnntgctggtgttcccgctgcccttccagggccacatcgacccgatgctgcacctggcgggcgtgctccacgcgcggggcctcgcggtgaccgtgctccacacgcgcttcaacgcgttggaccccgcgcggcacccggagttccagttcgtggccgtccccgacggcacgcccgccgacgtcgccgccatggggaggatcatcgacatcatcctggccatgaacgccgccatggaggcgtcgccggccgtcggggaggcgctgcgggcgtccgcggtcgcggggcaggacgggcggccccgcgcctcgtgcctcttcgtcgacgccaacctcctcgccgtgcacagggcggccagggcgctcggactgcccacgctggtgctgcgcaccgggagcgccgcctgcctcggctgcttcctggcctaccccatgctccacgaaaagggctatctgcctccgcaagagtcgcagctgtgcacgccggtgccggagctgccaccactccgagtgaaggacctgatctactcgaagcacagcgaccacgagctgatgcgcaaagtcctcgcccggggcagcgaaacagtgagagattgctccggcgtcgtcatcaacacagccgaggcactggaggcagccgagctagggaggctccgcgacgagctggtccacctcccggtggtgctcgccgccggcccactccacaagctctcctcctccaggggcgccgggagcagcttgctcgccccggaccacagctgcatcgagtggctggacgcgcagcggcccgggtcggtgctgtacgtgagcttcgggagcctggcggccatggactcgagcgagctccgggaggtggcatggggtctggcggagtgcggccaccccttcctatgggtcgtccggcccaacatggtacgaggctgcgacgtcgacagcgcgcggcagctgccggatggtttcgaggacgccgtcaagggcagaggcgtggtggtccgctgggccccgcagcaggaggtgctggcccaccgcgcagtgggtgggttctggagccactgcgggtggaactcgactctggaggcggtcagcgagggggtcccgatgatctgcaggccggacgccgtggaccagatgatgaacacgaggtacttgcaggacgtctggggcgtcggcttcgagctccaaggggagctggagagggggaagatcaaggacgcggttaggaagttgatgggtgagcgggagggagctgagatgagaagagcagcgcaagagctttgcgcgaaactagcaggctgcttggagagcactgggtcttctcaggttgccattgacaagttggttagctacattctgtctctgtgaatcttctgttctatggcgtatgtgtgttccgctgggttagcattggcagcagcttaacagctggtactcttatatggacaattattcctgtcaattatatgtagtgttctctttctctagctattttttaatttctctacacaccagcttctgatttcgttttaccgccttccatatcggagatattataaacctgactccctttcaagctctc

SEQ ID NO: 2222 - protein, 1630 aa, Zea mays
  misc_feature: PFam Name: UDPGT; PFam Description: UDP-glucoronosyl and
  misc_feature: PFam Name: Peptidase_S8; PFam Description: Subtilase family
  misc_feature: PFam Name: Glyco_hydro_1; PFam Description: Glycosyl
  misc_feature: PFam Name: Pkinase; PFam Description: Protein kinase domain
  misc_feature: GI Number: 50935389; NR Description: putative UDP-glucosyltransferase [Oryza sativa (japonica cultivar-group)] >gi|33146633|dbj|BAC79921.1| putative UDP-glucosyltransferase
  misc_feature: GI Number: 34900682; NR Description: putative UDP-glucosyltransferase [Oryza sativa (japonica cultivar-group)] >gi|22831219|dbj|BAC16077.1| putative UDP-glucosyltransferase
  misc_feature: GI Number: 50935387; NR Description: putative UDP-glucosyltransferase [Oryza sativa (japonica cultivar-group)] >gi|34395172|dbj|BAC83531.1| putative UDP-glucosyltransferase
  misc_feature: GI Number: 34900662; NR Description: putative UDP-glucosyltransferase [Oryza sativa (japonica cultivar-group)] >gi|23237887|dbj|BAC16461.1| putative UDP-glucosyltransferase
  misc_feature: GI Number: 50935391; NR Description: putative UDP-glucosyltransferase [Oryza sativa (japonica cultivar-group)] >gi|33146634|dbj|BAC79922.1| putative UDP-glucosyltransferase
AATAATGGCCGGCGCCCAAGAAGCTGGCGACGCCCTGGTCATCAGCCGTGCGCGCGGCGNNTGCTGGTGTTCCCGCTGCCCTTCCAGGGCCACATCGACCCGATGCTGCACCTGGCGGGCGTGCTCCACGCGCGGGGCCTCGCGGTGACCGTGCTCCACACGCGCTTCAACGCGTTGGACCCCGCGCGGCACCCGGAGTTCCAGTTCGTGGCCGTCCCCGACGGCACGCCCGCCGACGTCGCCGCCATGGGGAGGATCATCGACATCATCCTGGCCATGAACGCCGCCATGGAGGCGTCGCCGGCCGTCGGGGAGGCGCTGCGGGCGTCCGCGGTCGCGGGGCAGGACGGGCGGCCCCGCGCCTCGTGCCTCTTCGTCGACGCCAACCTCCTCGCCGTGCACAGGGCGGCCAGGGCGCTCGGACTGCCCACGCTGGTGCTGCGCACCGGGAGCGCCGCCTGCCTCGGCTGCTTCCTGGCCTACCCCATGCTCCACGAAAAGGGCTATCTGCCTCCGCAAGAGTCGCAGCTGTGCACGCCGGTGCCGGAGCTGCCACCACTCCGAGTGAAGGACCTGATCTACTCGAAGCACAGCGACCACGAGCTGATGCGCAAAGTCCTCGCCCGGGGCAGCGAAACAGTGAGAGATTGCTCCGGCGTCGTCATCAACACAGCCGAGGCACTGGAGGCAGCCGAGCTAGGGAGGCTCCGCGACGAGCTGGTCCACCTCCCGGTGGTGCTCGCCGCCGGCCCACTCCACAAGCTCTCCTCCTCCAGGGGCGCCGGGAGCAGCTTGCTCGCCCCGGACCACAGCTGCATCGAGTGGCTGGACGCGCAGCGGCCCGGGTCGGTGCTGTACGTGAGCTTCGGGAGCCTGGCGGCCATGGACTCGAGCGAGCTCCGGGAGGTGGCATGGGGTCTGGCGGAGTGCGGCCACCCCTTCCTATGGGTCGTCCGGCCCAACATGGTACGAGGCTGCGACGTCGACAGCGCGCGGCAGCTGCCGGATGGTTTCGAGGACGCCGTCAAGGGCAGAGGCGTGGTGGTCCGCTGGGCCCCGCAGCAGGAGGTGCTGGCCCACCGCGCAGTGGGTGGGTTCTGGAGCCACTGCGGGTGGAACTCGACTCTGGAGGCGGTCAGCGAGGGGGTCCCGATGATCTGCAGGCCGGACGCCGTGGACCAGATGATGAACACGAGGTACTTGCAGGACGTCTGGGGCGTCGGCTTCGAGCTCCAAGGGGAGCTGGAGAGGGGGAAGATCAAGGACGCGGTTAGGAAGTTGATGGGTGAGCGGGAGGGAGCTGAGATGAGAAGAGCAGCGCAAGAGCTTTGCGCGAAACTAGCAGGCTGCTTGGAGAGCACTGGGTCTTCTCAGGTTGCCATTGACAAGTTGGTTAGCTACATTCTGTCTCTGTGAATCTTCTGTTCTATGGCGTATGTGTGTTCCGCTGGGTTAGCATTGGCAGCAGCTTAACAGCTGGTACTCTTATATGGACAATTATTCCTGTCAATTATATGTAGTGTTCTCTTTCTCTAGCTATTTTTTAATTTCTCTACACACCAGCTTCTGATTTCGTTTTACCGCCTTCCATATCGGAGATATTATAAACCTGACTCCCTTTCAAGCTCTC

SEQ ID NO: 2223 - DNA, 1713 bp, Zea mays
  misc_feature (1)..(1713): Ceres cDNA ID no. 13498435
  misc_feature (1)..(1713): Ceres CLONE  ID no. 372006
  misc_feature (1)..(1713): Also known as  Ceres CDNA ID no. 23793644
gcacgagaccattacctagaacatcctaatcgaaaagtccgtcgtctcgcgctctcgtttcgtcgctacgctagcttccagtcccgggcttagcaactgtgctgctgttgcactgcacccggcgcacgcagagatgcgccgtgtcgggacgggtgtgaggatgctttgcggcgcggcgctgtcggtgcttctgcttctcgcgggcggcgcggcggcgtcgcactcgcgctcgtcgtgccccgccacgccgccggacgcggggaacacgctgcaggtgtcgcacgcgttcgggccgtgctcgccgctgggccccgggacggcggcgccgtcgtgggcggggttcctggcggaccaggcgtcgcgtgacgcgtcgcggctgctgtacctggactcgctggcggtgcgtggccgcgcccgcgcgtacgcgcccatcgcgtcggggcggcagctgctgcagacgctgacgtacgtggtgcgggccagcctcggcacgccgccgcagcagctgctcctggccgtcgacaccagcaacgacgcctcgtggatcccttgcgccggctgcgcgggctgccccacgtcgtccgcggcgcccttcgacccggccgcgtccgcctcgtaccgcacggtgccctgcgggtcgccgctgtgcgcgcaggcacccaacgcggcgtgcccgcccggcggcaaggcctgcggcttcagcctcacctacgccgactcctcgctgcaggccgcgctgtcgcaggactccctcgccgtcgcaggcaacgccgtgaaggcctacaccttcgggtgcctgcagagggccactggcacggctgcgccgccgcaggggctgctgggtctcggccgcggcccgctgtcgttcctttcgcagaccaaggacatgtacgaggccaccttctcgtactgtctccccagcttcaagtcgctcaacttctctggaacgctccggctcgggcgcaacggccagccgcagcgcatcaagacgacgccgctgctggccaacccgcaccggtcgtcgctctactacgtgaacatgaccggcgtccgcgtgggcaggaaggtggtgcccatcccggcgttcgacccggcgacgggcgcgggcaccgtgctggactctggcaccatgttcacccggctggtggcgccggcgtacgtggccgtgcgggacgaggtccggcgccgcgtcggcgcgcccgtatcctcgctgggagggttcgacacgtgcttcaacaccaccgccgtcgcgtggccgcccatgacgctgctgttcgacggcatgcaggtgacgttgccggaggagaacgtggtcatccacagcacgtacgggaccatcagctgcctggccatggccgcggcgcccgacggcgtcaacaccgtgctcaacgtcatcgccagcatgcagcagcagaaccaccgtgtgctcttcgacgtgcccaacggacgcgtcggcttcgcgcgcgagcgctgcactgccgcttgatcagcttgctcgcgcgcctgcgcgcgggctcggattcgggttatatttagttaaacctacgttctacggttgtggacgtcatgcactgctgtcggagtgggtgattaataatttaactttccttttctttttaatctcgttgctcttcagatttaccatatgtgtttcacattcaccgcgttatgtggtttaggggctgaatgattggggtctaaataatgtactgt

SEQ ID NO: 2224 - protein, 1713 aa, Zea mays
  misc_feature: PFam Name: Asp; PFam Description: Eukaryotic aspartyl protease
  misc_feature: PFam Name: TP2; PFam Description: Nuclear transition protein 2
  misc_feature: GI Number: 50939761; NR Description: nucleoid DNA-binding-like protein [Oryza sativa (japonica cultivar-group)] >gi|22775625|dbj|BAC15479.1| nucleoid DNA-binding-like protein [Oryza sativa (japonica cultivar-group)]
  misc_feature: GI Number: 50904527; NR Description: putative nucleoid DNA-binding-like protein [Oryza sativa (japonica cultivar-group)] >gi|20161865|dbj|BAB90778.1| putative nucleoid DNA-binding-like
  misc_feature: GI Number: 21700851; NR Description: AT3g54400/T12E18_90 [Arabidopsis thaliana] >gi|7288018|emb|CAB81805.1| nucleoid DNA-binding-like protein [Arabidopsis thaliana] >gi|17979257|gb|AAL49945.1| AT3g54400/T12E18_90 [Arabidopsis
  misc_feature: GI Number: 21617933; NR Description: nucleoid
  misc_feature: GI Number: 21553652; NR Description: nucleoid DNA-binding-like protein [Arabidopsis thaliana] >gi|9759559|dbj|BAB11161.1| nucleoid DNA-binding-like protein [Arabidopsis thaliana] >gi|15240680|ref|NP_196320.1| aspartyl
GCACGAGACCATTACCTAGAACATCCTAATCGAAAAGTCCGTCGTCTCGCGCTCTCGTTTCGTCGCTACGCTAGCTTCCAGTCCCGGGCTTAGCAACTGTGCTGCTGTTGCACTGCACCCGGCGCACGCAGAGATGCGCCGTGTCGGGACGGGTGTGAGGATGCTTTGCGGCGCGGCGCTGTCGGTGCTTCTGCTTCTCGCGGGCGGCGCGGCGGCGTCGCACTCGCGCTCGTCGTGCCCCGCCACGCCGCCGGACGCGGGGAACACGCTGCAGGTGTCGCACGCGTTCGGGCCGTGCTCGCCGCTGGGCCCCGGGACGGCGGCGCCGTCGTGGGCGGGGTTCCTGGCGGACCAGGCGTCGCGTGACGCGTCGCGGCTGCTGTACCTGGACTCGCTGGCGGTGCGTGGCCGCGCCCGCGCGTACGCGCCCATCGCGTCGGGGCGGCAGCTGCTGCAGACGCTGACGTACGTGGTGCGGGCCAGCCTCGGCACGCCGCCGCAGCAGCTGCTCCTGGCCGTCGACACCAGCAACGACGCCTCGTGGATCCCTTGCGCCGGCTGCGCGGGCTGCCCCACGTCGTCCGCGGCGCCCTTCGACCCGGCCGCGTCCGCCTCGTACCGCACGGTGCCCTGCGGGTCGCCGCTGTGCGCGCAGGCACCCAACGCGGCGTGCCCGCCCGGCGGCAAGGCCTGCGGCTTCAGCCTCACCTACGCCGACTCCTCGCTGCAGGCCGCGCTGTCGCAGGACTCCCTCGCCGTCGCAGGCAACGCCGTGAAGGCCTACACCTTCGGGTGCCTGCAGAGGGCCACTGGCACGGCTGCGCCGCCGCAGGGGCTGCTGGGTCTCGGCCGCGGCCCGCTGTCGTTCCTTTCGCAGACCAAGGACATGTACGAGGCCACCTTCTCGTACTGTCTCCCCAGCTTCAAGTCGCTCAACTTCTCTGGAACGCTCCGGCTCGGGCGCAACGGCCAGCCGCAGCGCATCAAGACGACGCCGCTGCTGGCCAACCCGCACCGGTCGTCGCTCTACTACGTGAACATGACCGGCGTCCGCGTGGGCAGGAAGGTGGTGCCCATCCCGGCGTTCGACCCGGCGACGGGCGCGGGCACCGTGCTGGACTCTGGCACCATGTTCACCCGGCTGGTGGCGCCGGCGTACGTGGCCGTGCGGGACGAGGTCCGGCGCCGCGTCGGCGCGCCCGTATCCTCGCTGGGAGGGTTCGACACGTGCTTCAACACCACCGCCGTCGCGTGGCCGCCCATGACGCTGCTGTTCGACGGCATGCAGGTGACGTTGCCGGAGGAGAACGTGGTCATCCACAGCACGTACGGGACCATCAGCTGCCTGGCCATGGCCGCGGCGCCCGACGGCGTCAACACCGTGCTCAACGTCATCGCCAGCATGCAGCAGCAGAACCACCGTGTGCTCTTCGACGTGCCCAACGGACGCGTCGGCTTCGCGCGCGAGCGCTGCACTGCCGCTTGATCAGCTTGCTCGCGCGCCTGCGCGCGGGCTCGGATTCGGGTTATATTTAGTTAAACCTACGTTCTACGGTTGTGGACGTCATGCACTGCTGTCGGAGTGGGTGATTAATAATTTAACTTTCCTTTTCTTTTTAATCTCGTTGCTCTTCAGATTTACCATATGTGTTTCACATTCACCGCGTTATGTGGTTTAGGGGCTGAATGATTGGGGTCTAAATAATGTACTGT

SEQ ID NO: 2225 - DNA, 1933 bp, Zea mays
  misc_feature (1)..(1933): Ceres cDNA ID no. 13498561
  misc_feature (1)..(1933): Ceres CLONE  ID no. 298762
  misc_feature (1)..(1933): Also known as  Ceres CDNA ID no. 23761294
acgggaggaggagaggagagagcccaccacccgcgaccgcgaccgcgacctaacccggagacctccctaggctagctcccctcccagaccccaggctctcccacccacctttcccctctccctccctcctccccgtcccacgccgccgcacccccgcctggctgcttgggtggcaatcggccgtagaggaggagggtgtaggagcttgatccgggccacctgccccctgcgccgtcgggatgtacgtgccgccgccgcccaccggcggcgccggcgagcagcctagggtttaccaggtctggcggggaagcaacgaattcttcttgcagggaagattcatatttgggcctgatgtgagatctgtgtttctcactatgttcctcatcatcgcaccagtggttgtcttctgtgtgttcgtcgcaaggcatctcataaatgatttccccgatagctggggaatctcggtgatggtagtagtggttgtcttcaccgtttatgatttgacgctgcttctttgtacctctggtagagatcctggtataatacctcggaatactcatcctcctgaacctgaatccattgatgggatcaatgatacaggtgttcagactccacaacaatttcgtttgcctcgcacaaaggaagttgttgtaaatgggatcagtgtacgggtaaaatactgtgatacttgcatgttgtaccgaccacctcgatgctcacactgttccatttgcaataactgtgtggaacggtttgatcatcactgtccatgggtcggccagtgcataggactgcgtaattatcggttcttctatatgtttgtatcctcgacaacattgctctgcctgtatgtatttgccttctgttgggtgtatgtgatcaagattagagcagcctgagcacttgtcaatctggaaggccttgttgaagacaccagcatcaattgttctgattatctactgttttctttgtgtatggtttgtgggtggtttatctgtcttccatttgtacctgatgggcactaaccagacaacatacgagaatttcaggtatcgctatgaccggcgcgataatccatataacagaggtactctgaacaattttctagagatattctgcaccgctatccccccttcgaagaacaatttccgggcaagggtgacagtagagcaagggctgcagcaaacgcgctcacagtctaggggtttcatgagccccagcatgggcaagccaaccatcggagagcttgagatgggcaggaagccagtagtaccttgggacgagccaaggacggcagctgatatcagggacttggaagcaggtttcgggggcatgtttgacgagaaagagggcagagtagcccacgcatccccagatctgagcagagatctcccagcagagtttgtggaagggcgaactggcatgcactcgaggcagtcaagttgggttcagagaggaggcgatgcgagtgaagcgtcggcggtgcaaatggctactgtccataccgccgaagatagcaaccatgtcccctggagtggcacacgttagcctgacaaaaaggcgggggaaaaaaaggagaggaactacggtgtgtttcggttgtgtctcgaggtgggtgctggtggtgatgtcgtctcgaagtgaactgccatgtgtttattaccacgtgtgccagggcaaggccctggatcattttgtaatccgaaacacaagcttgctgctgtagtctcatgcctggtagatcaccagatccctgctgtggttgttttttttttggtttggcttgttttgttttgcttgcttgtctgtttgggtgtgtgttctcaacaaaatgaagtagccgacgagcctaagctcccgccaggtctggataatgtatatgtatataactatattattagcaggttgcgacgaatgctgtgcttggtttgcc

SEQ ID NO: 2226 - protein, 1933 aa, Zea mays
  misc_feature: PFam Name: zf-DHHC; PFam Description: DHHC zinc finger domain
  misc_feature: GI Number: 50947995; NR Description: putative DHHC-type zinc finger domain-containing protein [Oryza sativa (japonica cultivar-group)] >gi|38175527|dbj|BAD01220.1| putative DHHC-type zinc finger domain-containing protein [Oryza sativa (japonica
  misc_feature: GI Number: 57900122; NR Description: putative zisp [Oryza sativa (japonica cultivar-group)] gi|57899394|dbj|BAD88041.1|
  misc_feature: GI Number: 30688566; NR Description: zinc finger (DHHC type)
  misc_feature: GI Number: 30693084; NR Description: zinc finger (DHHC type)
  misc_feature: GI Number: 50948057; NR Description: putative DHHC-type zinc finger domain-containing protein [Oryza sativa (japonica cultivar-group)] >gi|50725676|dbj|BAD33142.1| putative DHHC-type zinc finger domain-containing protein [Oryza sativa (japonica
ACGGGAGGAGGAGAGGAGAGAGCCCACCACCCGCGACCGCGACCGCGACCTAACCCGGAGACCTCCCTAGGCTAGCTCCCCTCCCAGACCCCAGGCTCTCCCACCCACCTTTCCCCTCTCCCTCCCTCCTCCCCGTCCCACGCCGCCGCACCCCCGCCTGGCTGCTTGGGTGGCAATCGGCCGTAGAGGAGGAGGGTGTAGGAGCTTGATCCGGGCCACCTGCCCCCTGCGCCGTCGGGATGTACGTGCCGCCGCCGCCCACCGGCGGCGCCGGCGAGCAGCCTAGGGTTTACCAGGTCTGGCGGGGAAGCAACGAATTCTTCTTGCAGGGAAGATTCATATTTGGGCCTGATGTGAGATCTGTGTTTCTCACTATGTTCCTCATCATCGCACCAGTGGTTGTCTTCTGTGTGTTCGTCGCAAGGCATCTCATAAATGATTTCCCCGATAGCTGGGGAATCTCGGTGATGGTAGTAGTGGTTGTCTTCACCGTTTATGATTTGACGCTGCTTCTTTGTACCTCTGGTAGAGATCCTGGTATAATACCTCGGAATACTCATCCTCCTGAACCTGAATCCATTGATGGGATCAATGATACAGGTGTTCAGACTCCACAACAATTTCGTTTGCCTCGCACAAAGGAAGTTGTTGTAAATGGGATCAGTGTACGGGTAAAATACTGTGATACTTGCATGTTGTACCGACCACCTCGATGCTCACACTGTTCCATTTGCAATAACTGTGTGGAACGGTTTGATCATCACTGTCCATGGGTCGGCCAGTGCATAGGACTGCGTAATTATCGGTTCTTCTATATGTTTGTATCCTCGACAACATTGCTCTGCCTGTATGTATTTGCCTTCTGTTGGGTGTATGTGATCAAGATTAGAGCAGCCTGAGCACTTGTCAATCTGGAAGGCCTTGTTGAAGACACCAGCATCAATTGTTCTGATTATCTACTGTTTTCTTTGTGTATGGTTTGTGGGTGGTTTATCTGTCTTCCATTTGTACCTGATGGGCACTAACCAGACAACATACGAGAATTTCAGGTATCGCTATGACCGGCGCGATAATCCATATAACAGAGGTACTCTGAACAATTTTCTAGAGATATTCTGCACCGCTATCCCCCCTTCGAAGAACAATTTCCGGGCAAGGGTGACAGTAGAGCAAGGGCTGCAGCAAACGCGCTCACAGTCTAGGGGTTTCATGAGCCCCAGCATGGGCAAGCCAACCATCGGAGAGCTTGAGATGGGCAGGAAGCCAGTAGTACCTTGGGACGAGCCAAGGACGGCAGCTGATATCAGGGACTTGGAAGCAGGTTTCGGGGGCATGTTTGACGAGAAAGAGGGCAGAGTAGCCCACGCATCCCCAGATCTGAGCAGAGATCTCCCAGCAGAGTTTGTGGAAGGGCGAACTGGCATGCACTCGAGGCAGTCAAGTTGGGTTCAGAGAGGAGGCGATGCGAGTGAAGCGTCGGCGGTGCAAATGGCTACTGTCCATACCGCCGAAGATAGCAACCATGTCCCCTGGAGTGGCACACGTTAGCCTGACAAAAAGGCGGGGGAAAAAAAGGAGAGGAACTACGGTGTGTTTCGGTTGTGTCTCGAGGTGGGTGCTGGTGGTGATGTCGTCTCGAAGTGAACTGCCATGTGTTTATTACCACGTGTGCCAGGGCAAGGCCCTGGATCATTTTGTAATCCGAAACACAAGCTTGCTGCTGTAGTCTCATGCCTGGTAGATCACCAGATCCCTGCTGTGGTTGTTTTTTTTTTGGTTTGGCTTGTTTTGTTTTGCTTGCTTGTCTGTTTGGGTGTGTGTTCTCAACAAAATGAAGTAGCCGACGAGCCTAAGCTCCCGCCAGGTCTGGATAATGTATATGTATATAACTATATTATTAGCAGGTTGCGACGAATGCTGTGCTTGGTTTGCC

SEQ ID NO: 2227 - DNA, 1619 bp, Zea mays
  misc_feature (1)..(1619): Ceres cDNA ID no. 13498683
  misc_feature (1)..(1619): Ceres CLONE  ID no. 304908
  misc_feature (1)..(1619): Also known as  Ceres CDNA ID no. 23777859
taatcgaaaaaacaaaactgcaattatctcagtctccttcaaacaactgttttttccattgttagactcaaagcctatccccttcacggagctcgccaagcgctatgggggacgccaacggcggcagtatgcacgttgtgatgctgccatggctggcgttcggccacatcctccccttcacggagctcgccaagcgcatagctaggcagggccaccgggtcaccctcttctccacgccaagaaacacccggcggttaatccgcatccctccagaactcgcggggcatatccgcgtcgtggacatcgcgctgccgcgcgtggagcgcctgccggaggactgcgaggcgagcatagacctgccatccgacgacctccgcccgtacctccgcgtagcctacgacgccgccttcgccgacaaactctcggccatcctgcaggagccgcggccggagaggccggactgggttctcatcgactacgccgcgtactgggcgcccgcggccgcggcgaggcacggcgtgccgtgcgccttcctgagcctgttcggcgccgcgaccctcagtttctatgggcccccggaggggctcatgggacgcggcaagtacgccaggacgaagccggaggacctcaccgtagtacccgactacgtgccgttcccaacaaccgtcgcgcaccgcggcttcgaggcgcgcgagctattcaagccaggccttgtcccggacgactccggcgtgtcggagggccacaggttcggcgtgtccatcggagagagccagatcgtaggcatcaggagcagaacagagctcgagtcggagtggctgcaggtgcttggcaagctctacaagaagccggtgatcccgatcggcctgttccctccgccgcccacgcaagacatcgccggccacgaggcgactttgcggtggctggacagacaggctcagggctccgtcgtgtacgcggccttcggcagcgaggcgaagctgacgagcgcgcagctccaaacaattgcgctaggtttggaggcttccggcctgccgttcctctgggcattcaggccgccaaccgacgccgcaccaggacaaggcacgggcgggttgcccgaaggcttcaaggagcgtgtcaatggccggggattggtctgccgcggctgggtgcctcaacccaggctgttggctcatgaatcggttggtgggtttctgacccacgccggctggaactccatcgccgaaggcctctcgcggggcgtcacgatggtgctgttgccgctgatgttcgatcagggcctcaacgccaggcttcttgtggataagaagatcgggattgaggtggagagggacgaagacgacggcacgttcgcgcccaaagacatcgcggatgctctgaggacggccatggcggagaaccaagacgggactagggtcaaggaactggccgaggtgtttggaaatgacgaggccaatgatcagtgcctgcgagatttcctccggtatctgttagaatacatcaggcagcatcaaggttagttccagtccatttcgaggctaatgttaatgcagaaaagggcaaagaaatggtagtgagtcacgtcacgctatcaaaaaaaaaaaatccttccaggt

SEQ ID NO: 2228 - protein, 1619 aa, Zea mays
  misc_feature: PFam Name: UDPGT; PFam Description: UDP-glucoronosyl and
  misc_feature: PFam Name: Glyco_transf_28; PFam Description:
  misc_feature: GI Number: 34908562; NR Description: putative anthocyanidine rhamnosyl-transferase [Oryza sativa (japonica cultivar-group)] >gi|21644643|dbj|BAC01201.1| putative anthocyanidine
  misc_feature: GI Number: 51705431; NR Description: putative
  misc_feature: GI Number: 17380626; NR Description: At2g22590/T9I22.3 [Arabidopsis thaliana] >gi|15450577|gb|AAK96560.1|
  misc_feature: GI Number: 20149064; NR Description: putative anthocyanidine
  misc_feature: GI Number: 50935013; NR Description: putative UDP-glucosyltransferase [Oryza sativa (japonica cultivar-group)] >gi|34393985|dbj|BAC83833.1| putative UDP-glucosyltransferase
TAATCGAAAAAACAAAACTGCAATTATCTCAGTCTCCTTCAAACAACTGTTTTTTCCATTGTTAGACTCAAAGCCTATCCCCTTCACGGAGCTCGCCAAGCGCTATGGGGGACGCCAACGGCGGCAGTATGCACGTTGTGATGCTGCCATGGCTGGCGTTCGGCCACATCCTCCCCTTCACGGAGCTCGCCAAGCGCATAGCTAGGCAGGGCCACCGGGTCACCCTCTTCTCCACGCCAAGAAACACCCGGCGGTTAATCCGCATCCCTCCAGAACTCGCGGGGCATATCCGCGTCGTGGACATCGCGCTGCCGCGCGTGGAGCGCCTGCCGGAGGACTGCGAGGCGAGCATAGACCTGCCATCCGACGACCTCCGCCCGTACCTCCGCGTAGCCTACGACGCCGCCTTCGCCGACAAACTCTCGGCCATCCTGCAGGAGCCGCGGCCGGAGAGGCCGGACTGGGTTCTCATCGACTACGCCGCGTACTGGGCGCCCGCGGCCGCGGCGAGGCACGGCGTGCCGTGCGCCTTCCTGAGCCTGTTCGGCGCCGCGACCCTCAGTTTCTATGGGCCCCCGGAGGGGCTCATGGGACGCGGCAAGTACGCCAGGACGAAGCCGGAGGACCTCACCGTAGTACCCGACTACGTGCCGTTCCCAACAACCGTCGCGCACCGCGGCTTCGAGGCGCGCGAGCTATTCAAGCCAGGCCTTGTCCCGGACGACTCCGGCGTGTCGGAGGGCCACAGGTTCGGCGTGTCCATCGGAGAGAGCCAGATCGTAGGCATCAGGAGCAGAACAGAGCTCGAGTCGGAGTGGCTGCAGGTGCTTGGCAAGCTCTACAAGAAGCCGGTGATCCCGATCGGCCTGTTCCCTCCGCCGCCCACGCAAGACATCGCCGGCCACGAGGCGACTTTGCGGTGGCTGGACAGACAGGCTCAGGGCTCCGTCGTGTACGCGGCCTTCGGCAGCGAGGCGAAGCTGACGAGCGCGCAGCTCCAAACAATTGCGCTAGGTTTGGAGGCTTCCGGCCTGCCGTTCCTCTGGGCATTCAGGCCGCCAACCGACGCCGCACCAGGACAAGGCACGGGCGGGTTGCCCGAAGGCTTCAAGGAGCGTGTCAATGGCCGGGGATTGGTCTGCCGCGGCTGGGTGCCTCAACCCAGGCTGTTGGCTCATGAATCGGTTGGTGGGTTTCTGACCCACGCCGGCTGGAACTCCATCGCCGAAGGCCTCTCGCGGGGCGTCACGATGGTGCTGTTGCCGCTGATGTTCGATCAGGGCCTCAACGCCAGGCTTCTTGTGGATAAGAAGATCGGGATTGAGGTGGAGAGGGACGAAGACGACGGCACGTTCGCGCCCAAAGACATCGCGGATGCTCTGAGGACGGCCATGGCGGAGAACCAAGACGGGACTAGGGTCAAGGAACTGGCCGAGGTGTTTGGAAATGACGAGGCCAATGATCAGTGCCTGCGAGATTTCCTCCGGTATCTGTTAGAATACATCAGGCAGCATCAAGGTTAGTTCCAGTCCATTTCGAGGCTAATGTTAATGCAGAAAAGGGCAAAGAAATGGTAGTGAGTCACGTCACGCTATCAAAAAAAAAAAATCCTTCCAGGT

SEQ ID NO: 2229 - DNA, 1957 bp, Zea mays
  misc_feature (1)..(1957): Ceres cDNA ID no. 13499394
  misc_feature (1)..(1957): Ceres CLONE  ID no. 393414
  misc_feature (1)..(1957): Also known as  Ceres CDNA ID no. 23813875
  misc_feature (666)..(666): n is a, c, t, g, unknown, or other
  misc_feature (667)..(667): n is a, c, t, g, unknown, or other
  misc_feature (715)..(715): n is a, c, t, g, unknown, or other
  misc_feature (716)..(716): n is a, c, t, g, unknown, or other
atcaaaaaaaggcgggcgagcagagccacgccaaagcgcggggaagcctccaagccgcgggcgatcccgccgaggcgtcgtcgtccaccgcatcctccttgtactcttcgtccctgccgtcagggccgccgcgcgctttatatacagccgacccgcgtgcctgggctcgctgcctgccagcagcaagcaagcgccgaggcggagctcgcgaggcagaggctgacggcgccgatggagtggctggacgagtacgagaagctggtgatccggatgaacacgccccgcgtggtcatcgacaatgccgtctgcccccacggccacgctagtgcaggtggacagcgccaggaagagagggctgctgctggaggccgtgcaggtgctcgccgacctcgacctgtccatcaacaaggcctacatctcctccgacggccgctggttcatggacgtcttccacgtcacagaccgcctcggccgcaagctcaccgacgacagcgtcatcacctacatccagcagtctctcgggacctggaacgagccggcccggccggcggcgctcgagggtctgacggcgctcgagctcacggggcccgaccgcacggggctcctgtccgaggtgttcgccgtgctggccgacctgcagtgcggcgtggtggacgcccgcgcgtnnacgcaccgcggccgcctggcgtgcgtcgccttcctccgcggggagggnnacgccgaccgggtggcgcgcatcctcgcgcgcctcggccacctcgtccgcggtgacggcgaggcaccgggcgccgtggcagccgtgcccgccgccgcggtcgcgcacgtcgaccgccgcctccacgagctcatggccgcggaccacaacaacagcgcgacgccgtacccggccgcggccgcggccgtgtccgtgcagagctgggccgagcgcggctactccgtggtgaccgtgcagtgccgcgaccgccccaagctgctgttcgacgtggtgtgcgcgctccactgcctggactacgtcgtcttccacggcaccgtcgacaccgccgccggcgaccgcgcgcggcaggagttctacatccgcagcgccgacggaagccccatccggtccgaggccgagagggagaggctcgcccagtgcctccaagccgccatagaccggaggtcgctagagggcgtgaggctggagctgtgcacgccggaccggccggggctgctgtccgaggtgacgcggacgttccgcgagaacgggctgctcgtcgcccacgcggaggtgtcgacgaaggggggcctggcctccaacgttttctacgtgaccgacgcggatggcaaggcggcgggccagagcgccatcgacgctgtcagggcgagggtcggcgcggactgcctcgtcgtgggcgaggagccccggccgccgcgcgtgttcccggaggccgggcctggcgaccgtgaccacggcggcggccttgggctggtctacctcggcaacctcgtgaagcggaacctgtacaacctcggcctcatcaagtcgtgctcgtgaagcgtgatgctcggctcggccccaagaaagacacgggcggtttctcaaggagacccacccgccattgacgtactgtgtacgtacaagatcgaggaaccggcgccgacggcatcaactaaacaccgcgacatggagcgccgctcaagcagggtgaaattcgggttgggcatggtgttgtagtcgagaggaaatgtcgtcgtccgtcatcaacaggcaccgacaccatggatggacggacggtcggacactgacgacggctgaggaggggtgattagcaataggaatttgtgtagccatctgccatgtacatagacaaattcgttgttgtcggtaccagtagaagtagcgcgtagccgtgtagtgggtgcattcatcgtatttaacttctgtcatatttacggaacaggcacatcattttttttt

SEQ ID NO: 2230 - protein, 1957 aa, Zea mays
  misc_feature: PFam Name: ACT; PFam Description: ACT domain
  misc_feature: PFam Name: Peptidase_S8; PFam Description: Subtilase family
  misc_feature: PFam Name: Cation_efflux; PFam Description: Cation efflux family
  misc_feature: PFam Name: Pkinase; PFam Description: Protein kinase domain
  misc_feature: PFam Name: HlyD; PFam Description: HlyD family secretion protein
  misc_feature: GI Number: 50940555; NR Description: putative ACT domain-containing protein [Oryza sativa (japonica cultivar-group)] >gi|42407901|dbj|BAD09041.1| putative ACT domain-containing protein [Oryza sativa (japonica
  misc_feature: GI Number: 8778647; NR Description: F5O11.14 [Arabidopsis thaliana] >gi|22138106|gb|AAM93433.1| ACR8 [Arabidopsis thaliana] >gi|25370630|pir||F86258 protein F5O11.14 [imported] - Arabidopsis
  misc_feature: GI Number: 22138104; NR Description: ACR7 [Arabidopsis thaliana] >gi|22328873|ref|NP_194009.2| ACT domain-containing
  misc_feature: GI Number: 20466646; NR Description: translation factor EF-1
  misc_feature: GI Number: 50947955; NR Description: uridylyl transferase-like [Oryza sativa (japonica cultivar-group)] >gi|42761392|dbj|BAD11660.1| uridylyl transferase-like [Oryza
ATCAAAAAAAGGCGGGCGAGCAGAGCCACGCCAAAGCGCGGGGAAGCCTCCAAGCCGCGGGCGATCCCGCCGAGGCGTCGTCGTCCACCGCATCCTCCTTGTACTCTTCGTCCCTGCCGTCAGGGCCGCCGCGCGCTTTATATACAGCCGACCCGCGTGCCTGGGCTCGCTGCCTGCCAGCAGCAAGCAAGCGCCGAGGCGGAGCTCGCGAGGCAGAGGCTGACGGCGCCGATGGAGTGGCTGGACGAGTACGAGAAGCTGGTGATCCGGATGAACACGCCCCGCGTGGTCATCGACAATGCCGTCTGCCCCCACGGCCACGCTAGTGCAGGTGGACAGCGCCAGGAAGAGAGGGCTGCTGCTGGAGGCCGTGCAGGTGCTCGCCGACCTCGACCTGTCCATCAACAAGGCCTACATCTCCTCCGACGGCCGCTGGTTCATGGACGTCTTCCACGTCACAGACCGCCTCGGCCGCAAGCTCACCGACGACAGCGTCATCACCTACATCCAGCAGTCTCTCGGGACCTGGAACGAGCCGGCCCGGCCGGCGGCGCTCGAGGGTCTGACGGCGCTCGAGCTCACGGGGCCCGACCGCACGGGGCTCCTGTCCGAGGTGTTCGCCGTGCTGGCCGACCTGCAGTGCGGCGTGGTGGACGCCCGCGCGTNNACGCACCGCGGCCGCCTGGCGTGCGTCGCCTTCCTCCGCGGGGAGGGNNACGCCGACCGGGTGGCGCGCATCCTCGCGCGCCTCGGCCACCTCGTCCGCGGTGACGGCGAGGCACCGGGCGCCGTGGCAGCCGTGCCCGCCGCCGCGGTCGCGCACGTCGACCGCCGCCTCCACGAGCTCATGGCCGCGGACCACAACAACAGCGCGACGCCGTACCCGGCCGCGGCCGCGGCCGTGTCCGTGCAGAGCTGGGCCGAGCGCGGCTACTCCGTGGTGACCGTGCAGTGCCGCGACCGCCCCAAGCTGCTGTTCGACGTGGTGTGCGCGCTCCACTGCCTGGACTACGTCGTCTTCCACGGCACCGTCGACACCGCCGCCGGCGACCGCGCGCGGCAGGAGTTCTACATCCGCAGCGCCGACGGAAGCCCCATCCGGTCCGAGGCCGAGAGGGAGAGGCTCGCCCAGTGCCTCCAAGCCGCCATAGACCGGAGGTCGCTAGAGGGCGTGAGGCTGGAGCTGTGCACGCCGGACCGGCCGGGGCTGCTGTCCGAGGTGACGCGGACGTTCCGCGAGAACGGGCTGCTCGTCGCCCACGCGGAGGTGTCGACGAAGGGGGGCCTGGCCTCCAACGTTTTCTACGTGACCGACGCGGATGGCAAGGCGGCGGGCCAGAGCGCCATCGACGCTGTCAGGGCGAGGGTCGGCGCGGACTGCCTCGTCGTGGGCGAGGAGCCCCGGCCGCCGCGCGTGTTCCCGGAGGCCGGGCCTGGCGACCGTGACCACGGCGGCGGCCTTGGGCTGGTCTACCTCGGCAACCTCGTGAAGCGGAACCTGTACAACCTCGGCCTCATCAAGTCGTGCTCGTGAAGCGTGATGCTCGGCTCGGCCCCAAGAAAGACACGGGCGGTTTCTCAAGGAGACCCACCCGCCATTGACGTACTGTGTACGTACAAGATCGAGGAACCGGCGCCGACGGCATCAACTAAACACCGCGACATGGAGCGCCGCTCAAGCAGGGTGAAATTCGGGTTGGGCATGGTGTTGTAGTCGAGAGGAAATGTCGTCGTCCGTCATCAACAGGCACCGACACCATGGATGGACGGACGGTCGGACACTGACGACGGCTGAGGAGGGGTGATTAGCAATAGGAATTTGTGTAGCCATCTGCCATGTACATAGACAAATTCGTTGTTGTCGGTACCAGTAGAAGTAGCGCGTAGCCGTGTAGTGGGTGCATTCATCGTATTTAACTTCTGTCATATTTACGGAACAGGCACATCATTTTTTTTT

SEQ ID NO: 2231 - DNA, 910 bp, Arabidopsis thaliana
  misc_feature (1)..(910): Ceres cDNA ID no. 13499473
  misc_feature (1)..(910): Ceres CLONE  ID no. 30185
  misc_feature (1)..(910): Also known as  Ceres CDNA ID no. 23387911
gacctgcaaaaacaacatctctcacattctctctaaactctcttcactgttactcgacaatggctactacttctaactcggtacttttcctaagttctgactcactgattcatcatcatcatcatcaacctctccatctatcttcctccagatctcactctgtttctctcccacccaacaagcgatccaattctctcacgcttcgttgttcaacaaatggcgatagcacctcaaccgaaaaggaaacaccaatcgaactcaaattcccagcatttccaacggtaatggacattaaccaaatcagagagatattgcctcacaggtttccgtttctgctggtagatagagtgatagagtatacgcctggtgtttcagctgtagctattaagaatgtcaccatcaatgacaatttcttccctggccatttccctgaacgaccaatcatgcctggtgttctcatgattgaggcaatggcgcaagtcggaggtatagtaatgctgcagccggaagtaggaggctctcaagataacttcttctttgctggtattgataaagtgagatttcgcaaaccagtgattgcaggagacacgctagtcatgaggatgactcttctcaagttccagaagcggttcgggctcgctaaaatggaaggtaaagcttatgtgggtggtgctctggtgtgtgaaggcgagttcatgatggtttctgctggtagttcttgatctcacccattaatggtctcacttcccacatgtggactcttcttatgcttcttctgttattcgaaaatctagacaagacagctttatgttttcgacatttatatgagctacttttgcccttcgtgtctttattgctgtctccaatttatgaacattcataagatacaaatacagagattttgattttg

SEQ ID NO: 2232 - protein, 910 aa, Arabidopsis thaliana
  misc_feature: PFam Name: FabA; PFam Description: FabA-like domain
  misc_feature: PFam Name: 4HBT; PFam Description: Thioesterase superfamily
  misc_feature: GI Number: 21592599; NR Description: putative
  misc_feature: GI Number: 21928166; NR Description: At2g22230/T26C19.11 [Arabidopsis thaliana] >gi|20198153|gb|AAD23619.2| putative beta-hydroxyacyl-ACP dehydratase [Arabidopsis thaliana] >gi|25090441|gb|AAN72302.1| At2g22230/T26C19.11 [Arabidopsis
  misc_feature: GI Number: 14334124; NR Description: putative 3-keto-acyl-ACP
  misc_feature: GI Number: 25319393; NR Description: probable
  misc_feature: GI Number: 50931539; NR Description: putative beta-hydroxyacyl-ACP dehydratase [Oryza sativa (japonica cultivar-group)] >gi|49328184|gb|AAT58880.1| putative beta-hydroxyacyl-ACP dehydratase [Oryza sativa (japonica
GACCTGCAAAAACAACATCTCTCACATTCTCTCTAAACTCTCTTCACTGTTACTCGACAATGGCTACTACTTCTAACTCGGTACTTTTCCTAAGTTCTGACTCACTGATTCATCATCATCATCATCAACCTCTCCATCTATCTTCCTCCAGATCTCACTCTGTTTCTCTCCCACCCAACAAGCGATCCAATTCTCTCACGCTTCGTTGTTCAACAAATGGCGATAGCACCTCAACCGAAAAGGAAACACCAATCGAACTCAAATTCCCAGCATTTCCAACGGTAATGGACATTAACCAAATCAGAGAGATATTGCCTCACAGGTTTCCGTTTCTGCTGGTAGATAGAGTGATAGAGTATACGCCTGGTGTTTCAGCTGTAGCTATTAAGAATGTCACCATCAATGACAATTTCTTCCCTGGCCATTTCCCTGAACGACCAATCATGCCTGGTGTTCTCATGATTGAGGCAATGGCGCAAGTCGGAGGTATAGTAATGCTGCAGCCGGAAGTAGGAGGCTCTCAAGATAACTTCTTCTTTGCTGGTATTGATAAAGTGAGATTTCGCAAACCAGTGATTGCAGGAGACACGCTAGTCATGAGGATGACTCTTCTCAAGTTCCAGAAGCGGTTCGGGCTCGCTAAAATGGAAGGTAAAGCTTATGTGGGTGGTGCTCTGGTGTGTGAAGGCGAGTTCATGATGGTTTCTGCTGGTAGTTCTTGATCTCACCCATTAATGGTCTCACTTCCCACATGTGGACTCTTCTTATGCTTCTTCTGTTATTCGAAAATCTAGACAAGACAGCTTTATGTTTTCGACATTTATATGAGCTACTTTTGCCCTTCGTGTCTTTATTGCTGTCTCCAATTTATGAACATTCATAAGATACAAATACAGAGATTTTGATTTTG

SEQ ID NO: 2233 - DNA, 1611 bp, Arabidopsis thaliana
  misc_feature (1)..(1611): Ceres cDNA ID no. 13499676
  misc_feature (1)..(1611): Ceres CLONE  ID no. 253849
  misc_feature (1)..(1611): Also known as  Ceres CDNA ID no. 23388617
aaattaaaagtcaatcatatcaaatcccaaatcctcccagatgtttttatcatcttcttcttcctgaagatttgatttcattttcctctctttcagatccctattctcatggcttctggatcttactggtgctatagttgtagccgattcgtttgggtttccgattcaatctcttgccctgattgcgacggtggtttcctcgaactcatccaagagcctctcgatttcacaccttccgattccttcaccaccaccaccaccactcaacatcgcagccccactcgcttccctcctccttcttcttcttcctccaccccatccgcttctatgcacgccgataacagtcccactcctaccatcgttactcgtacacgaagcaatcgatctcctaatccagttattgttctccgtggatctgctgctgctccttcttctgatgttgtttccgaaggtttagatcgatctgcttttcagatgtattacgatgatggtactgattctggtcttagacctttaccaccgagtatgactgagtttttgttaggttctggatttgatcgtttgttagatcagatctctcagatcgagcttaacaccaatcggaatcttcgttcttgtgaacatccaccggcttctaaatcggccattgaagctttgcctctgattgaaatcgatccgactcatctcttatcggattctcaatctcattgcgctgtttgcaaagagaatttcgttttgaaatcatctgctcgcgagatgccttgtaatcacatctatcatcctgattgtattcttccttggcttgcgattcgtaactcttgtccggtttgccgtcatgagctaccggcggaggatctcaccgacggaaccggtgctgctttgactgctgttaccgctactgcagaggaagaggaagactcagctgcggggttaacgatttggaggttaccaggtggaggattcgctgtagggagaatccctggtggttggagaggtggagatagaatgatgccggtggtttacacggaggttgatggtggtagactcggtgatgagagacttccgagaagagtagcttggggttcgagaagaggtggaagagatggtggaggtagtagagagagaggtggtggctttgcgggtcggatcatgaggcttttcggatgttttagtggatcatctggatccattgctgctgctgctgctgcatcatccgggtccgggtccagaattcgggttactcgtagaaccaggtcgttctctatgttcagtacggcgtcgtcttcgtcaaggagacgaaattggctagcgtgattactagaattaccaagctctcttctcaggtgaaaactaaacacgaaagaacacactcttcttctgtttaaatttttcctatgttccttattaagtttttgtctatttcagtgtaatgattatattcattcctaaaatttgaatctatgcgagtaaattgatacaaaattaggtgacatagtgtcttcagtggcaaatttaggaggatatgttactgtgagtctgtgactagataagtgagagtgtagatgaattgaagaatgtactctgaaggagattcatagttgttctatttgt

SEQ ID NO: 2234 - protein, 1611 aa, Arabidopsis thaliana
  misc_feature: PFam Name: zf-C3HC4; PFam Description: Zinc finger, C3HC4
  misc_feature: GI Number: 17380612; NR Description: AT5g59550/f2o15_210 [Arabidopsis thaliana] >gi|15450687|gb|AAK96615.1| AT5g59550/f2o15_210 [Arabidopsis thaliana] >gi|18424254|ref|NP_568910.1| zinc finger (C3HC4-type RING
  misc_feature: GI Number: 50949043; NR Description: putative RING-H2 finger protein [Oryza sativa] >gi|14719329|gb|AAK73147.1| putative RING-H2
  misc_feature: GI Number: 52353630; NR Description: putative ring-H2 finger
  misc_feature: GI Number: 57899217; NR Description: RING-H2 finger
  misc_feature: GI Number: 34906008; NR Description: putative RING-H2 finger protein RHC2a [Oryza sativa (japonica cultivar-group)] >gi|15289983|dbj|BAB63678.1| putative RING-H2 finger protein RHC2a
AAATTAAAAGTCAATCATATCAAATCCCAAATCCTCCCAGATGTTTTTATCATCTTCTTCTTCCTGAAGATTTGATTTCATTTTCCTCTCTTTCAGATCCCTATTCTCATGGCTTCTGGATCTTACTGGTGCTATAGTTGTAGCCGATTCGTTTGGGTTTCCGATTCAATCTCTTGCCCTGATTGCGACGGTGGTTTCCTCGAACTCATCCAAGAGCCTCTCGATTTCACACCTTCCGATTCCTTCACCACCACCACCACCACTCAACATCGCAGCCCCACTCGCTTCCCTCCTCCTTCTTCTTCTTCCTCCACCCCATCCGCTTCTATGCACGCCGATAACAGTCCCACTCCTACCATCGTTACTCGTACACGAAGCAATCGATCTCCTAATCCAGTTATTGTTCTCCGTGGATCTGCTGCTGCTCCTTCTTCTGATGTTGTTTCCGAAGGTTTAGATCGATCTGCTTTTCAGATGTATTACGATGATGGTACTGATTCTGGTCTTAGACCTTTACCACCGAGTATGACTGAGTTTTTGTTAGGTTCTGGATTTGATCGTTTGTTAGATCAGATCTCTCAGATCGAGCTTAACACCAATCGGAATCTTCGTTCTTGTGAACATCCACCGGCTTCTAAATCGGCCATTGAAGCTTTGCCTCTGATTGAAATCGATCCGACTCATCTCTTATCGGATTCTCAATCTCATTGCGCTGTTTGCAAAGAGAATTTCGTTTTGAAATCATCTGCTCGCGAGATGCCTTGTAATCACATCTATCATCCTGATTGTATTCTTCCTTGGCTTGCGATTCGTAACTCTTGTCCGGTTTGCCGTCATGAGCTACCGGCGGAGGATCTCACCGACGGAACCGGTGCTGCTTTGACTGCTGTTACCGCTACTGCAGAGGAAGAGGAAGACTCAGCTGCGGGGTTAACGATTTGGAGGTTACCAGGTGGAGGATTCGCTGTAGGGAGAATCCCTGGTGGTTGGAGAGGTGGAGATAGAATGATGCCGGTGGTTTACACGGAGGTTGATGGTGGTAGACTCGGTGATGAGAGACTTCCGAGAAGAGTAGCTTGGGGTTCGAGAAGAGGTGGAAGAGATGGTGGAGGTAGTAGAGAGAGAGGTGGTGGCTTTGCGGGTCGGATCATGAGGCTTTTCGGATGTTTTAGTGGATCATCTGGATCCATTGCTGCTGCTGCTGCTGCATCATCCGGGTCCGGGTCCAGAATTCGGGTTACTCGTAGAACCAGGTCGTTCTCTATGTTCAGTACGGCGTCGTCTTCGTCAAGGAGACGAAATTGGCTAGCGTGATTACTAGAATTACCAAGCTCTCTTCTCAGGTGAAAACTAAACACGAAAGAACACACTCTTCTTCTGTTTAAATTTTTCCTATGTTCCTTATTAAGTTTTTGTCTATTTCAGTGTAATGATTATATTCATTCCTAAAATTTGAATCTATGCGAGTAAATTGATACAAAATTAGGTGACATAGTGTCTTCAGTGGCAAATTTAGGAGGATATGTTACTGTGAGTCTGTGACTAGATAAGTGAGAGTGTAGATGAATTGAAGAATGTACTCTGAAGGAGATTCATAGTTGTTCTATTTGT

SEQ ID NO: 2235 - DNA, 1486 bp, Arabidopsis thaliana
  misc_feature (1)..(1486): Ceres cDNA ID no. 13499724
  misc_feature (1)..(1486): Ceres CLONE  ID no. 12454
  misc_feature (1)..(1486): Also known as  Ceres CDNA ID no. 23388748
tgaacatcgtcatctctaacaatggcgccttctccgatcatcttctccgttcttcttctcttcatcttctcactctcatcatctgctcaaacacctttccgtcccaaagctctccttctcccagtaacaaaagaccaatctaccctccagtacacaaccgtcatcaaccaacgcacacctctcgtccccgcttccgtcgtcttcgacctcggtggtcgagaactctgggtcgactgcgacaaaggctacgtctcctccacttaccagtctcctcgctgcaactccgccgtctgctcacgtgccggctccacaagctgcggcacatgcttctcccctccgagacctggctgtagtaacaacacttgcggcggcattccggataacaccgttaccggtaccgcaacttccggcgaatttgctttagacgttgtgtctatccagtccactaacggatccaatccgggcagggtcgttaaaatcccaaatttgatcttcgattgtggagcaacgtttcttcttaaaggactcgctaaaggaaccgttggtatggcgggaatgggacgtcacaacatcggtttaccgtcgcaattcgccgccgcgtttagcttccaccgtaaattcgccgtctgtctaacttccggtaaaggcgtcgccttcttcggcaacggaccttacgttttccttcccggaatccagatctcaagtctccaaacgacgccccttctcatcaatccggtcagcactgcttctgcgttttcacaaggtgagaaatcctcagagtactttatcggcgtgacggcgattcaaatcgtcgagaaaacagttccgatcaatccaacgctattgaagattaacgcaagtaccggtatcggaggaaccaaaatcagctccgtcaatccttacacggtgttggagtcatcgatctacaatgcttttacgtcggagttcgttaaacaagcagcggcgaggagcatcaagagagtagcgtcggtgaaaccgttcggcgcgtgtttcagcacgaagaacgtcggcgtgacgcgcctaggatacgccgtgccggagattgagcttgtgcttcatagcaaagacgtcgtttggaggatatttggagccaactcgatggtgagtgtcagtgatgacgtcatctgtttgggtttcgttgacggaggagtcaacgcaagaacctctgttgtgattggagggtttcagttggaggataatttgatcgaatttgatttggcgagtaacaaatttgggtttagttccacgttattgggccgtcaaactaactgcgccaacttcaatttcacttccactgcttgattaaattagttgatccgttttctttttttaaaactgttttttagtggttattatattatgtttgatgtgattaataaagagccaatggaatcattatttggcatttttttaatcaatttatttgaataaattatgtaatgagtgaattttatttgatacatct

SEQ ID NO: 2236 - protein, 1486 aa, Arabidopsis thaliana
  misc_feature: PFam Name: Asp; PFam Description: Eukaryotic aspartyl protease
  misc_feature: GI Number: 21537233; NR Description: EDGP precursor
  misc_feature: GI Number: 7488910; NR Description: dermal glycoprotein precursor, extracellular - carrot (fragment)
  misc_feature: GI Number: 32482806; NR Description: putative xyloglucanase
  misc_feature: GI Number: 27372527; NR Description: xyloglucan-specific fungal endoglucanase inhibitor protein precursor [Lycopersicon
  misc_feature: GI Number: 11191819; NR Description: conglutin gamma [Lupinus
TGAACATCGTCATCTCTAACAATGGCGCCTTCTCCGATCATCTTCTCCGTTCTTCTTCTCTTCATCTTCTCACTCTCATCATCTGCTCAAACACCTTTCCGTCCCAAAGCTCTCCTTCTCCCAGTAACAAAAGACCAATCTACCCTCCAGTACACAACCGTCATCAACCAACGCACACCTCTCGTCCCCGCTTCCGTCGTCTTCGACCTCGGTGGTCGAGAACTCTGGGTCGACTGCGACAAAGGCTACGTCTCCTCCACTTACCAGTCTCCTCGCTGCAACTCCGCCGTCTGCTCACGTGCCGGCTCCACAAGCTGCGGCACATGCTTCTCCCCTCCGAGACCTGGCTGTAGTAACAACACTTGCGGCGGCATTCCGGATAACACCGTTACCGGTACCGCAACTTCCGGCGAATTTGCTTTAGACGTTGTGTCTATCCAGTCCACTAACGGATCCAATCCGGGCAGGGTCGTTAAAATCCCAAATTTGATCTTCGATTGTGGAGCAACGTTTCTTCTTAAAGGACTCGCTAAAGGAACCGTTGGTATGGCGGGAATGGGACGTCACAACATCGGTTTACCGTCGCAATTCGCCGCCGCGTTTAGCTTCCACCGTAAATTCGCCGTCTGTCTAACTTCCGGTAAAGGCGTCGCCTTCTTCGGCAACGGACCTTACGTTTTCCTTCCCGGAATCCAGATCTCAAGTCTCCAAACGACGCCCCTTCTCATCAATCCGGTCAGCACTGCTTCTGCGTTTTCACAAGGTGAGAAATCCTCAGAGTACTTTATCGGCGTGACGGCGATTCAAATCGTCGAGAAAACAGTTCCGATCAATCCAACGCTATTGAAGATTAACGCAAGTACCGGTATCGGAGGAACCAAAATCAGCTCCGTCAATCCTTACACGGTGTTGGAGTCATCGATCTACAATGCTTTTACGTCGGAGTTCGTTAAACAAGCAGCGGCGAGGAGCATCAAGAGAGTAGCGTCGGTGAAACCGTTCGGCGCGTGTTTCAGCACGAAGAACGTCGGCGTGACGCGCCTAGGATACGCCGTGCCGGAGATTGAGCTTGTGCTTCATAGCAAAGACGTCGTTTGGAGGATATTTGGAGCCAACTCGATGGTGAGTGTCAGTGATGACGTCATCTGTTTGGGTTTCGTTGACGGAGGAGTCAACGCAAGAACCTCTGTTGTGATTGGAGGGTTTCAGTTGGAGGATAATTTGATCGAATTTGATTTGGCGAGTAACAAATTTGGGTTTAGTTCCACGTTATTGGGCCGTCAAACTAACTGCGCCAACTTCAATTTCACTTCCACTGCTTGATTAAATTAGTTGATCCGTTTTCTTTTTTTAAAACTGTTTTTTAGTGGTTATTATATTATGTTTGATGTGATTAATAAAGAGCCAATGGAATCATTATTTGGCATTTTTTTAATCAATTTATTTGAATAAATTATGTAATGAGTGAATTTTATTTGATACATCT

SEQ ID NO: 2237 - DNA, 1358 bp, Arabidopsis thaliana
  misc_feature (1)..(1358): Ceres cDNA ID no. 13499728
  misc_feature (1)..(1358): Ceres CLONE  ID no. 35098
  misc_feature (1)..(1358): Also known as  Ceres CDNA ID no. 23388752
cattattacaccaccgttggcctccgacgacggctcaagcctatcttcgtcgccggcttctccgatggttaccaatcgcgtagacgtcttctggcacgaaggaatgctccgacacgacgccgtagaaggcgtcttcgacactggatacgaccctggattcctcgacgtattggagaagcacccggagaacgccgatcgcgtcaggaacatgctttcgattctccgacgcggtcccatcgctcctcatgtcaattggtttaccggtcttccagcaatcgtttcggagcttctaatgtttcacacttcagagtacattgagaagctagtggaggcagataaatcaggagaaaggtgtgaaattgccgcaggtactttcatgagcccaggctcgtgggaagctgctcttcttgcagctggaacaactctttcagcaatgcaacatattcttgattgccatgggaaaattgcatatgctctggtacgcccaccaggtcaccactcacagcctactcaggctgatgggtattgcttcctcaacaacgctgctcttgctgtcaagctggcattgaattcgggttcttgttcccgagttgcggttattgacatcgatgtacattatggaaatggcacagctgaagggttttatacatctgataaggttcttacggtgtcactccatatgaaccatggatcatggggatcgtcccacccgcagaaagggtcgattgatgaacttggtgaagacgtgggattgggttacaatctgaatgtccctttaccgaatggcacgggtgaccggggatatgaatatgccatgaatgagctggtggttcctgcagttagaaggtttggacccgatatggttgttctcgttgttggtcaagactctagcgcttttgatccaaacgggagacaaagcctgacaatgaatggatacagaaggattgggcagataatgaggggagttgcagaggagcacagccatggaaggttgcttatggtgcaagaaggcgggtatcatgtaacatatgcagcttactgcctccacgccatgctcgaaggggtgctgaagattccagaaccgcatctatctgatccgatcgcttattatcccgaagaagaagctaatgctgttgctgctgtggagtcaatcaaaacatatcacaccgaatttgttccatttctcagaggaacttgaaaatgggacgtatgaatgagtttatgttattcctcgttgtcttgtgaccttttggaacacagatccaaatcaatcaggtcaaaccgtatatatcaaaatacttgttgatcaaactatcttttgtatgaaaacttattcacacgatccgactttgtttttc

SEQ ID NO: 2238 - protein, 1358 aa, Arabidopsis thaliana
  misc_feature: PFam Name: Hist_deacetyl; PFam Description: Histone
  misc_feature: GI Number: 16226923; NR Description: At1g08460/T27G7_7
  misc_feature: GI Number: 20453297; NR Description: At1g08460/T27G7_7 [Arabidopsis thaliana] >gi|21360988|gb|AAM49769.1| HDA8 [Arabidopsis thaliana] >gi|15294162|gb|AAK95258.1| At1g08460/T27G7_7 [Arabidopsis thaliana]
  misc_feature: GI Number: 25407044; NR Description: protein T27G7.14 [imported] - Arabidopsis thaliana >gi|6664310|gb|AAF22892.1|
  misc_feature: GI Number: 32038919; NR Description: COG0123: Deacetylases, including yeast histone deacetylase and acetoin utilization protein
  misc_feature: GI Number: 15598969; NR Description: probable acetylpolyamine aminohydrolase [Pseudomonas aeruginosa PA01] >gi|11350855|pir||D83174 probable acetylpolyamine aminohydrolase PA3774 [imported] - Pseudomonas aeruginosa (strain PAO1)
CATTATTACACCACCGTTGGCCTCCGACGACGGCTCAAGCCTATCTTCGTCGCCGGCTTCTCCGATGGTTACCAATCGCGTAGACGTCTTCTGGCACGAAGGAATGCTCCGACACGACGCCGTAGAAGGCGTCTTCGACACTGGATACGACCCTGGATTCCTCGACGTATTGGAGAAGCACCCGGAGAACGCCGATCGCGTCAGGAACATGCTTTCGATTCTCCGACGCGGTCCCATCGCTCCTCATGTCAATTGGTTTACCGGTCTTCCAGCAATCGTTTCGGAGCTTCTAATGTTTCACACTTCAGAGTACATTGAGAAGCTAGTGGAGGCAGATAAATCAGGAGAAAGGTGTGAAATTGCCGCAGGTACTTTCATGAGCCCAGGCTCGTGGGAAGCTGCTCTTCTTGCAGCTGGAACAACTCTTTCAGCAATGCAACATATTCTTGATTGCCATGGGAAAATTGCATATGCTCTGGTACGCCCACCAGGTCACCACTCACAGCCTACTCAGGCTGATGGGTATTGCTTCCTCAACAACGCTGCTCTTGCTGTCAAGCTGGCATTGAATTCGGGTTCTTGTTCCCGAGTTGCGGTTATTGACATCGATGTACATTATGGAAATGGCACAGCTGAAGGGTTTTATACATCTGATAAGGTTCTTACGGTGTCACTCCATATGAACCATGGATCATGGGGATCGTCCCACCCGCAGAAAGGGTCGATTGATGAACTTGGTGAAGACGTGGGATTGGGTTACAATCTGAATGTCCCTTTACCGAATGGCACGGGTGACCGGGGATATGAATATGCCATGAATGAGCTGGTGGTTCCTGCAGTTAGAAGGTTTGGACCCGATATGGTTGTTCTCGTTGTTGGTCAAGACTCTAGCGCTTTTGATCCAAACGGGAGACAAAGCCTGACAATGAATGGATACAGAAGGATTGGGCAGATAATGAGGGGAGTTGCAGAGGAGCACAGCCATGGAAGGTTGCTTATGGTGCAAGAAGGCGGGTATCATGTAACATATGCAGCTTACTGCCTCCACGCCATGCTCGAAGGGGTGCTGAAGATTCCAGAACCGCATCTATCTGATCCGATCGCTTATTATCCCGAAGAAGAAGCTAATGCTGTTGCTGCTGTGGAGTCAATCAAAACATATCACACCGAATTTGTTCCATTTCTCAGAGGAACTTGAAAATGGGACGTATGAATGAGTTTATGTTATTCCTCGTTGTCTTGTGACCTTTTGGAACACAGATCCAAATCAATCAGGTCAAACCGTATATATCAAAATACTTGTTGATCAAACTATCTTTTGTATGAAAACTTATTCACACGATCCGACTTTGTTTTTC

SEQ ID NO: 2239 - DNA, 1851 bp, Arabidopsis thaliana
  misc_feature (1)..(1851): Ceres cDNA ID no. 13499920
  misc_feature (1)..(1851): Ceres CLONE  ID no. 114256
  misc_feature (1)..(1851): Also known as  Ceres CDNA ID no. 23389260
aagtctctttttttgtttaaagatgaacaaatttttgtgttcacattaataaaaactaaaaagaggattcccatgcacacgaaccaacaccaagagcctttttattgtattttaatttctttatttgagccaacaactatttattttcgttcttctttcacactagctctaaaaaccggtttaactaaaccagtcaaaaaccggacgtatgaaagcgttcactgtcttctctgacttacgcgttgaccaatgactacagtattttgaaaaaaccttcgtgtgatataaccggttactggaagtctgtaaccatccgtactgtatatttaacctgctattgccggtcaataaaaaaaaaatcaaggaccaccatttaacacagtgcggtgacaaatatcaaatccttgagtcattattatctctttcctctcttacgccatacatttcatctttcttctctctctatctctcctctttgaaccctaaaaactctttctttacaaggattgatctttttgtatttttgattttgacatttgctttgtgttcgatctctgttttgatgcgatttctctgtttttaaagccatttgatagattgtttccggtaaagctcagcgagagaagaagaagaacaacaatggagtttacagatttctcaaagacgagtttttactacccgtcgtcacaaagcgtttgggatttcggagatttagcggcggcggagaggcattctttagggttcatggagttattaagttctcagcagcatcaagactttgctactgtttctcctcattccttccttctccaaacgtctcaaccgcaaacgcaaacgcaaccatcggcgaagctgtcttcaagtatcattcaagctccaccgtcagagcaattagtgacgtcaaaggtggagtctttgtgttcggatcatttgttgataaacccaccggcgactcctaactcgtcatcgatttcgtctgcttcaagcgaggctctaaatgaagagaaaccgaaaacagaagacaatgaagaagaaggaggtgaagatcaacaagagaagagtcatactaagaaacagttgaaagcaaagaagaataatcagaagagacagagagaggcaagagtcgcattcatgacaaagagtgaagttgatcatctcgaagatggttatcgctggcgaaaatatggtcaaaaagctgtcaaaaacagtccttttcccaggagttactaccgttgcacaacggcttcatgtaacgtgaagaagagagtggagagatcattcagagatccaagcactgtggttacaacctacgaaggtcaacacactcacattagtccactcacgtctcgtcctatttccactggaggtttcttcggatcgtcaggagctgcttcgagtctcggtaatggttgctttgggtttcctattgatggctccacgttaatctctcctcagttccaacagcttgtccaataccatcaccaacagcagcaacaagaactcatgtcttgttttggaggagtcaacgagtaccttaatagccacgctaatgagtatggtgatgataatcgtgtgaagaagagtcgagttttggttaaagataatggacttctgcaagatgttgttccgtctcatatgttgaaggaagagtagtagtatatatatagtcttatagttttaatctagtttttttttgtataattgtctaaaagaaacggatcttttgttctgatgaagaagatgttttcttatggttctgaaatcgtaaggtaatgatgattgtaccaagccgagaaagtacttgtgattttcaccattgaatcactataaatgtaatttttatttactgcg

SEQ ID NO: 2240 - protein, 1851 aa, Arabidopsis thaliana
  misc_feature: PFam Name: WRKY; PFam Description: WRKY DNA -binding domain
  misc_feature: GI Number: 30017307; NR Description: At2g47260 [Arabidopsis thaliana] >gi|26450898|dbj|BAC42556.1| putative WRKY-type DNA binding protein [Arabidopsis thaliana] >gi|2275204|gb|AAB63826.1| putative WRKY-type DNA binding protein transcription factor 23
  misc_feature: GI Number: 21536889; NR Description: putative WRKY-type DNA
  misc_feature: GI Number: 15991734; NR Description: WRKY transcription factor 68 [Arabidopsis thaliana] >gi|29839600|sp|Q93WV6|WR68_ARATH Probable WRKY transcription factor 68 (WRKY DNA-binding protein 68) >gi|18412338|ref|NP_567127.1| WRKY family transcription factor
  misc_feature: GI Number: 37910167; NR Description: transcription factor
  misc_feature: GI Number: 21435999; NR Description: AT4g18170/T9A21_10 [Arabidopsis thaliana] >gi|17979528|gb|AAL50099.1| AT4g18170/T9A21_10 [Arabidopsis thaliana] >gi|17064158|gb|AAL35286.1| WRKY transcription factor 28
AAGTCTCTTTTTTTGTTTAAAGATGAACAAATTTTTGTGTTCACATTAATAAAAACTAAAAAGAGGATTCCCATGCACACGAACCAACACCAAGAGCCTTTTTATTGTATTTTAATTTCTTTATTTGAGCCAACAACTATTTATTTTCGTTCTTCTTTCACACTAGCTCTAAAAACCGGTTTAACTAAACCAGTCAAAAACCGGACGTATGAAAGCGTTCACTGTCTTCTCTGACTTACGCGTTGACCAATGACTACAGTATTTTGAAAAAACCTTCGTGTGATATAACCGGTTACTGGAAGTCTGTAACCATCCGTACTGTATATTTAACCTGCTATTGCCGGTCAATAAAAAAAAAATCAAGGACCACCATTTAACACAGTGCGGTGACAAATATCAAATCCTTGAGTCATTATTATCTCTTTCCTCTCTTACGCCATACATTTCATCTTTCTTCTCTCTCTATCTCTCCTCTTTGAACCCTAAAAACTCTTTCTTTACAAGGATTGATCTTTTTGTATTTTTGATTTTGACATTTGCTTTGTGTTCGATCTCTGTTTTGATGCGATTTCTCTGTTTTTAAAGCCATTTGATAGATTGTTTCCGGTAAAGCTCAGCGAGAGAAGAAGAAGAACAACAATGGAGTTTACAGATTTCTCAAAGACGAGTTTTTACTACCCGTCGTCACAAAGCGTTTGGGATTTCGGAGATTTAGCGGCGGCGGAGAGGCATTCTTTAGGGTTCATGGAGTTATTAAGTTCTCAGCAGCATCAAGACTTTGCTACTGTTTCTCCTCATTCCTTCCTTCTCCAAACGTCTCAACCGCAAACGCAAACGCAACCATCGGCGAAGCTGTCTTCAAGTATCATTCAAGCTCCACCGTCAGAGCAATTAGTGACGTCAAAGGTGGAGTCTTTGTGTTCGGATCATTTGTTGATAAACCCACCGGCGACTCCTAACTCGTCATCGATTTCGTCTGCTTCAAGCGAGGCTCTAAATGAAGAGAAACCGAAAACAGAAGACAATGAAGAAGAAGGAGGTGAAGATCAACAAGAGAAGAGTCATACTAAGAAACAGTTGAAAGCAAAGAAGAATAATCAGAAGAGACAGAGAGAGGCAAGAGTCGCATTCATGACAAAGAGTGAAGTTGATCATCTCGAAGATGGTTATCGCTGGCGAAAATATGGTCAAAAAGCTGTCAAAAACAGTCCTTTTCCCAGGAGTTACTACCGTTGCACAACGGCTTCATGTAACGTGAAGAAGAGAGTGGAGAGATCATTCAGAGATCCAAGCACTGTGGTTACAACCTACGAAGGTCAACACACTCACATTAGTCCACTCACGTCTCGTCCTATTTCCACTGGAGGTTTCTTCGGATCGTCAGGAGCTGCTTCGAGTCTCGGTAATGGTTGCTTTGGGTTTCCTATTGATGGCTCCACGTTAATCTCTCCTCAGTTCCAACAGCTTGTCCAATACCATCACCAACAGCAGCAACAAGAACTCATGTCTTGTTTTGGAGGAGTCAACGAGTACCTTAATAGCCACGCTAATGAGTATGGTGATGATAATCGTGTGAAGAAGAGTCGAGTTTTGGTTAAAGATAATGGACTTCTGCAAGATGTTGTTCCGTCTCATATGTTGAAGGAAGAGTAGTAGTATATATATAGTCTTATAGTTTTAATCTAGTTTTTTTTTGTATAATTGTCTAAAAGAAACGGATCTTTTGTTCTGATGAAGAAGATGTTTTCTTATGGTTCTGAAATCGTAAGGTAATGATGATTGTACCAAGCCGAGAAAGTACTTGTGATTTTCACCATTGAATCACTATAAATGTAATTTTTATTTACTGCG

SEQ ID NO: 2241 - DNA, 1636 bp, Arabidopsis thaliana
  misc_feature (1)..(1636): Ceres cDNA ID no. 13500074
  misc_feature (1)..(1636): Ceres CLONE  ID no. 41573
  misc_feature (1)..(1636): Also known as  Ceres CDNA ID no. 23389692
ataattacttgtgattcttatttgtcttcttcaatatggcgagaagttctgttttgctatgtttaattctattggttacgttaggagttgtgataagtgtcacatttgccgacaacgttgaattgaaatcaaaagatctagagagcagtaagaaagataagaaggttgatcatgatagtacacacaaagagaagggaggtgaaaaggtagatggtgccggttctgatgatgaagacaacgataaaaaagaaaaaaagaaagagcatgatgtgcaaaaaaaggataaacaacatgaaaacaaagacaaggatgacgagaagaagcatgttgataagaagaagagcggtggtcatgataaagatgatgatgatgaaaagaagcacaaggataaaaagaaggatggacacaatgatgatgatgatagtgatgatgatacggatgatgacgatgacgatgatgatgatgatgatgatgatgatgaagttgatggagatgataatgagaaggagaaaattgggttatacgagctcaagaagggaaatctaactgtcaaattcacaaattggggtgcttcaatcatatctctccatttcccagacaaaaatggtaaaatggacgatattgttcttggctatgatagcgtcaaaacctacaagaccgacaaggtttatttcggagcaaccgttggccgagtagcaaatagaataggaaagggcaaattcaagttgaatggtaaagagtacaagacaagtgtcaacgatggaaaaaacacactccatggtggcaagaaagggtttggggatgttgtgtgggcagttgcaaaacaccagtacgatggcaagaaaccacacattgtcttcactcacacaagtcctgacggcgatcaagggtttccgggagaactcagtgtcacggtgacatataaacttgtcaaagacaatgaattgagtgtggtgatggaggcaaagcctaaggataaagcaactccggtgaacttagctcatcatagttattggaatcttggtggtcataattccggagatattttgtctgaagaaattcaaatcctcggctcgggttatacccccgtcgacggtgagctcattcccaccgggaaaatcaatccggtgaaaggaacagcatacgattttctccaactccgtcctattaaagataatatgaaggatcttaaaacaggatatgatataaattattgcttagatggtaaggcaaaaaagatgagaaaaatagttgaactcgtagataagaaatcagggaggaaaatggagttatccggaaaccaagcgggtttgcaattctataccggagggatgttaaaggatgtcaaagggaagaatggggcagtttaccaagctttcgggggattatgtttagaaacacaaagttatccagacgcattgaaccatcccaaatttccttcacagattgtcgagccagggaaaaaatacaaacacactatgctcttcaagttttctattgtttcatagattgttttagatgttgttacatgaacacccttggaaccatgtccaatgttcatgaacaagaaactaaatacattgtaatattttgtaacaatgcttaaattatcaaattatataaacctaacgtgaac

SEQ ID NO: 2242 - protein, 1636 aa, Arabidopsis thaliana
  misc_feature: PFam Name: Aldose_epim; PFam Description: Aldose 1-epimerase
  misc_feature: GI Number: 26452398; NR Description: putative aldose
  misc_feature: GI Number: 7671483; NR Description: putative aldose 1-epimerase-like protein [Arabidopsis thaliana] >gi|11358633|pir||T49949 probable aldose 1-epimerase-like protein - Arabidopsis thaliana >gi|15242223|ref|NP_197018.1| aldose
  misc_feature: GI Number: 21537069; NR Description: aldose 1-epimerase-like
  misc_feature: GI Number: 15824567; NR Description: non-cell-autonomous
  misc_feature: GI Number: 15824565; NR Description: non-cell-autonomous
ATAATTACTTGTGATTCTTATTTGTCTTCTTCAATATGGCGAGAAGTTCTGTTTTGCTATGTTTAATTCTATTGGTTACGTTAGGAGTTGTGATAAGTGTCACATTTGCCGACAACGTTGAATTGAAATCAAAAGATCTAGAGAGCAGTAAGAAAGATAAGAAGGTTGATCATGATAGTACACACAAAGAGAAGGGAGGTGAAAAGGTAGATGGTGCCGGTTCTGATGATGAAGACAACGATAAAAAAGAAAAAAAGAAAGAGCATGATGTGCAAAAAAAGGATAAACAACATGAAAACAAAGACAAGGATGACGAGAAGAAGCATGTTGATAAGAAGAAGAGCGGTGGTCATGATAAAGATGATGATGATGAAAAGAAGCACAAGGATAAAAAGAAGGATGGACACAATGATGATGATGATAGTGATGATGATACGGATGATGACGATGACGATGATGATGATGATGATGATGATGATGAAGTTGATGGAGATGATAATGAGAAGGAGAAAATTGGGTTATACGAGCTCAAGAAGGGAAATCTAACTGTCAAATTCACAAATTGGGGTGCTTCAATCATATCTCTCCATTTCCCAGACAAAAATGGTAAAATGGACGATATTGTTCTTGGCTATGATAGCGTCAAAACCTACAAGACCGACAAGGTTTATTTCGGAGCAACCGTTGGCCGAGTAGCAAATAGAATAGGAAAGGGCAAATTCAAGTTGAATGGTAAAGAGTACAAGACAAGTGTCAACGATGGAAAAAACACACTCCATGGTGGCAAGAAAGGGTTTGGGGATGTTGTGTGGGCAGTTGCAAAACACCAGTACGATGGCAAGAAACCACACATTGTCTTCACTCACACAAGTCCTGACGGCGATCAAGGGTTTCCGGGAGAACTCAGTGTCACGGTGACATATAAACTTGTCAAAGACAATGAATTGAGTGTGGTGATGGAGGCAAAGCCTAAGGATAAAGCAACTCCGGTGAACTTAGCTCATCATAGTTATTGGAATCTTGGTGGTCATAATTCCGGAGATATTTTGTCTGAAGAAATTCAAATCCTCGGCTCGGGTTATACCCCCGTCGACGGTGAGCTCATTCCCACCGGGAAAATCAATCCGGTGAAAGGAACAGCATACGATTTTCTCCAACTCCGTCCTATTAAAGATAATATGAAGGATCTTAAAACAGGATATGATATAAATTATTGCTTAGATGGTAAGGCAAAAAAGATGAGAAAAATAGTTGAACTCGTAGATAAGAAATCAGGGAGGAAAATGGAGTTATCCGGAAACCAAGCGGGTTTGCAATTCTATACCGGAGGGATGTTAAAGGATGTCAAAGGGAAGAATGGGGCAGTTTACCAAGCTTTCGGGGGATTATGTTTAGAAACACAAAGTTATCCAGACGCATTGAACCATCCCAAATTTCCTTCACAGATTGTCGAGCCAGGGAAAAAATACAAACACACTATGCTCTTCAAGTTTTCTATTGTTTCATAGATTGTTTTAGATGTTGTTACATGAACACCCTTGGAACCATGTCCAATGTTCATGAACAAGAAACTAAATACATTGTAATATTTTGTAACAATGCTTAAATTATCAAATTATATAAACCTAACGTGAAC

SEQ ID NO: 2243 - DNA, 1162 bp, Zea mays
  misc_feature (1)..(1162): Ceres cDNA ID no. 13501279
  misc_feature (1)..(1162): Ceres CLONE  ID no. 460221
  misc_feature (1)..(1162): Also known as  Ceres CDNA ID no. 23811316
acgtatacgttacgtttcgcttggtttttttttcacggaacgatccagacgcgctagccgtaggccgcgcgtagctgggcggtgtgcgctgcgccatgaagaccacttcgtcgcacgggctccacgccgcgtcggcgtcgctctgcacgccgtacctactcctcctaccgctcggcctcctcgccgtgctgctggcgctcccgagcctcggctcctcttacgcgcgctcccaaggcctcggcgtgctctgccgcagcgcggcggcaggcaccgacggcggcggcggcggtgactactcctcctccgtcgcgtcgggcgccggcgacgagaagaaggccgcggtcgccgagacaccgccgccgccgcggccggagctcagcctgctggtgggcgtgctgaccgtgccgggcccggcgggagcggcgggacatcctgcggacggcctacgcgctgcagccggcggcgcccgcgtcgcgcgtggacgtgcgcttcgtcttctgcagcgtgacggacccggtggaggcggcgctggtggcggtggaggcgcggcgccacggcgacgtgctggtgctggactgcgcggagaacatgaacgacgggaagacgcacgcgtacctgtcctccgtgccgcgcctcttcgcgtccgcgccctacgactacgtcatgaagaccgacgacgacacgtacctgcgcgtcgcggcgctggtggcggagctgcgccccaggccccgcgacgacgtctacctgggctacggcttccccgtcggcgacgaccccatgccgttcatgcacggcatgggctacgtcgtgtcctgggacgtggcgcgctgggtgtccgccaacggggacatcctgcgccacaacgacacgcacgggcccgaggacctgctcgtcggcaagtggctcaacatcggcggcaggggcaggaaccgctacgacctcaagcccaggatgtacgacctcaactggttcatggacaacttccgcccggacaccatcgccgtgcacatgctcaaggacaaccgccgatgggcggccacgttcacctacttcaacgtcaccgccaggatccacaccaacagcctgccgtgatcaaccagttatttcagttcgatttttttttccctgaggttgacgttggctgattgtgccaaggtggcgt

SEQ ID NO: 2244 - protein, 1162 aa, Zea mays
  misc_feature: PFam Name: Galactosyl_T; PFam Description: Galactosyltransferase
  misc_feature: PFam Name: Mucin; PFam Description: Mucin-like glycoprotein
  misc_feature: PFam Name: SerH; PFam Description: Cell surface
  misc_feature: GI Number: 55741077; NR Description: hypro1 [Zea mays]
  misc_feature: GI Number: 21537037; NR Description: unknown [Arabidopsis thaliana]
  misc_feature: GI Number: 66777243; NR Description: Ribonuclease PH [Anaeromyxobacter dehalogenans 2CP-C] >gi|66856937|ref|ZP_00400996.1| Ribonuclease PH [Anaeromyxobacter
  misc_feature: GI Number: 56283929; NR Description: CG3047-PA [Drosophila melanogaster] gi|55380421|gb|AAF50957.4| CG3047-PA [Drosophila
  misc_feature: GI Number: 31198197; NR Description: ENSANGP00000019335 [Anopheles gambiae] >gi|21291511|gb|EAA03656.1| ENSANGP00000019335
ACGTATACGTTACGTTTCGCTTGGTTTTTTTTTCACGGAACGATCCAGACGCGCTAGCCGTAGGCCGCGCGTAGCTGGGCGGTGTGCGCTGCGCCATGAAGACCACTTCGTCGCACGGGCTCCACGCCGCGTCGGCGTCGCTCTGCACGCCGTACCTACTCCTCCTACCGCTCGGCCTCCTCGCCGTGCTGCTGGCGCTCCCGAGCCTCGGCTCCTCTTACGCGCGCTCCCAAGGCCTCGGCGTGCTCTGCCGCAGCGCGGCGGCAGGCACCGACGGCGGCGGCGGCGGTGACTACTCCTCCTCCGTCGCGTCGGGCGCCGGCGACGAGAAGAAGGCCGCGGTCGCCGAGACACCGCCGCCGCCGCGGCCGGAGCTCAGCCTGCTGGTGGGCGTGCTGACCGTGCCGGGCCCGGCGGGAGCGGCGGGACATCCTGCGGACGGCCTACGCGCTGCAGCCGGCGGCGCCCGCGTCGCGCGTGGACGTGCGCTTCGTCTTCTGCAGCGTGACGGACCCGGTGGAGGCGGCGCTGGTGGCGGTGGAGGCGCGGCGCCACGGCGACGTGCTGGTGCTGGACTGCGCGGAGAACATGAACGACGGGAAGACGCACGCGTACCTGTCCTCCGTGCCGCGCCTCTTCGCGTCCGCGCCCTACGACTACGTCATGAAGACCGACGACGACACGTACCTGCGCGTCGCGGCGCTGGTGGCGGAGCTGCGCCCCAGGCCCCGCGACGACGTCTACCTGGGCTACGGCTTCCCCGTCGGCGACGACCCCATGCCGTTCATGCACGGCATGGGCTACGTCGTGTCCTGGGACGTGGCGCGCTGGGTGTCCGCCAACGGGGACATCCTGCGCCACAACGACACGCACGGGCCCGAGGACCTGCTCGTCGGCAAGTGGCTCAACATCGGCGGCAGGGGCAGGAACCGCTACGACCTCAAGCCCAGGATGTACGACCTCAACTGGTTCATGGACAACTTCCGCCCGGACACCATCGCCGTGCACATGCTCAAGGACAACCGCCGATGGGCGGCCACGTTCACCTACTTCAACGTCACCGCCAGGATCCACACCAACAGCCTGCCGTGATCAACCAGTTATTTCAGTTCGATTTTTTTTTCCCTGAGGTTGACGTTGGCTGATTGTGCCAAGGTGGCGT

SEQ ID NO: 2245 - DNA, 1735 bp, Zea mays
  misc_feature (1)..(1735): Ceres cDNA ID no. 13502413
  misc_feature (1)..(1735): Ceres CLONE  ID no. 987485
  misc_feature (1)..(1735): Also known as  Ceres CDNA ID no. 24382010
cctcttcaagaggggatcatcagattgggcttattattccttattactccaggcaaggatcggagttgctctgaattgactgaaccatggcggcgacaatggcagtgacgacgatggtgacgaggagcaaggagagctggtcgtcattgcaggtcccggcggtggcattcccttggaagccacgaggtggcaagaccggcggcctcgagttccctcgccgggcgatgttcgccagcgtcggcctcaacgtgtgcccgggcgtcccagcggggcgcgacccgcgggagcccgatcccaaggtcgtccgggcggccgacaactgcgacatcgcgcgccagcttggcgccgccgttcccgggcagcaggccgcctgggaggcggaggaagaggcagcgaagaggaggaagcagaagggcggcggcacgaagaagcagcagcagctgggcgatctgagcctgaggaaggtcagggtcaagatcgccaacccgcacctgcgcgcctggttagcggcgccatcgccggcgccgtgtccaggacgtttgtggcgccgctggagacgatccggacgcacttgatggtcggcagcatcggcgtcgactccatggccggggtgttccagtggatcatgcagaacgaagggtggaccggcctgttccgcggcaacgccgtcaacgtcctgcgcgtcgctccgagcaaggctatcgagcatttcacctatgacacggccaagaagttcctaacccccaagggcgacgagccgcccaagatcccgatccccactccgctggttgccggagctctagccggattcgcctcaaccttgtgcacctaccccatggagctgatcaagaccagggtcaccatcgagaaggacgtatacgacaacgtcgcgcacgcgttcgtgaagatcctacgcgacgagggcccgtcggagctgtaccgtgggctgacacccagcctgatcggcgtggtgccgtacgcggcctgtaacttctacgcctacgagacgctgaagcggctctaccgtcgcgcgaccgggcggcgtcccggcgcggacgtgggccccgtggcgacgctgctcatcgggtccgcggcgggcgccatcgccagctcggccacgttcccgctagaggtggcccgcaagcagatgcaggtgggcgctgtgggcgggaggcaggtgtaccagaacgtcctccacgctatctactgcatcctcaagaaggagggcgccggcggcctgtaccgaggtctcggccctagctgcatcaagctcatgcccgccgccggcatcgccttcatgtgctacgaggcgtgcaagaagatcctcgtcgacaaggaggatgaggaggaggaggacgaagccggcggcggagaggatgacaagaaaaaggttgaatgatcaaagttcttggccaagaaggtagcaatgtcgtgaagcgtacgtgaactggaaacggatggacaagtatatttggagtttgatgtggtgtttccggatcgtgtgtttgtctcagatgaaaaaaatacaatattttgagtccaagttaatcaatgttccatttgcctatccggagctcaatttgttaggttgcatgttccatgtaattactatatttgcctatttcaattttcaagctcttttcgttgtgtttagtaaactgtggtgtgaccacttacggtcacaataaccatttttatctgtttttggtataataagcatgtctgtgttcggtcc

SEQ ID NO: 2246 - protein, 1735 aa, Zea mays
  misc_feature: PFam Name: Mito_carr; PFam Description: Mitochondrial
  misc_feature: GI Number: 231654; NR Description: Brittle-1 protein, chloroplast precursor >gi|82676|pir||JQ1459 Bt1 protein precursor -
  misc_feature: GI Number: 50906079; NR Description: putative Brittle-1 protein, chloroplast precursor [Oryza sativa (japonica cultivar-group)] >gi|46390080|dbj|BAD15497.1| putative Brittle-1 protein, chloroplast precursor [Oryza sativa (japonica
  misc_feature: GI Number: 47156872; NR Description: plastidial ADP-glucose
  misc_feature: GI Number: 51090886; NR Description: putative mitochondrial
  misc_feature: GI Number: 52353768; NR Description: putative adenylate translocator (Brittle-1) protein [Oryza sativa (japonica
CCTCTTCAAGAGGGGATCATCAGATTGGGCTTATTATTCCTTATTACTCCAGGCAAGGATCGGAGTTGCTCTGAATTGACTGAACCATGGCGGCGACAATGGCAGTGACGACGATGGTGACGAGGAGCAAGGAGAGCTGGTCGTCATTGCAGGTCCCGGCGGTGGCATTCCCTTGGAAGCCACGAGGTGGCAAGACCGGCGGCCTCGAGTTCCCTCGCCGGGCGATGTTCGCCAGCGTCGGCCTCAACGTGTGCCCGGGCGTCCCAGCGGGGCGCGACCCGCGGGAGCCCGATCCCAAGGTCGTCCGGGCGGCCGACAACTGCGACATCGCGCGCCAGCTTGGCGCCGCCGTTCCCGGGCAGCAGGCCGCCTGGGAGGCGGAGGAAGAGGCAGCGAAGAGGAGGAAGCAGAAGGGCGGCGGCACGAAGAAGCAGCAGCAGCTGGGCGATCTGAGCCTGAGGAAGGTCAGGGTCAAGATCGCCAACCCGCACCTGCGCGCCTGGTTAGCGGCGCCATCGCCGGCGCCGTGTCCAGGACGTTTGTGGCGCCGCTGGAGACGATCCGGACGCACTTGATGGTCGGCAGCATCGGCGTCGACTCCATGGCCGGGGTGTTCCAGTGGATCATGCAGAACGAAGGGTGGACCGGCCTGTTCCGCGGCAACGCCGTCAACGTCCTGCGCGTCGCTCCGAGCAAGGCTATCGAGCATTTCACCTATGACACGGCCAAGAAGTTCCTAACCCCCAAGGGCGACGAGCCGCCCAAGATCCCGATCCCCACTCCGCTGGTTGCCGGAGCTCTAGCCGGATTCGCCTCAACCTTGTGCACCTACCCCATGGAGCTGATCAAGACCAGGGTCACCATCGAGAAGGACGTATACGACAACGTCGCGCACGCGTTCGTGAAGATCCTACGCGACGAGGGCCCGTCGGAGCTGTACCGTGGGCTGACACCCAGCCTGATCGGCGTGGTGCCGTACGCGGCCTGTAACTTCTACGCCTACGAGACGCTGAAGCGGCTCTACCGTCGCGCGACCGGGCGGCGTCCCGGCGCGGACGTGGGCCCCGTGGCGACGCTGCTCATCGGGTCCGCGGCGGGCGCCATCGCCAGCTCGGCCACGTTCCCGCTAGAGGTGGCCCGCAAGCAGATGCAGGTGGGCGCTGTGGGCGGGAGGCAGGTGTACCAGAACGTCCTCCACGCTATCTACTGCATCCTCAAGAAGGAGGGCGCCGGCGGCCTGTACCGAGGTCTCGGCCCTAGCTGCATCAAGCTCATGCCCGCCGCCGGCATCGCCTTCATGTGCTACGAGGCGTGCAAGAAGATCCTCGTCGACAAGGAGGATGAGGAGGAGGAGGACGAAGCCGGCGGCGGAGAGGATGACAAGAAAAAGGTTGAATGATCAAAGTTCTTGGCCAAGAAGGTAGCAATGTCGTGAAGCGTACGTGAACTGGAAACGGATGGACAAGTATATTTGGAGTTTGATGTGGTGTTTCCGGATCGTGTGTTTGTCTCAGATGAAAAAAATACAATATTTTGAGTCCAAGTTAATCAATGTTCCATTTGCCTATCCGGAGCTCAATTTGTTAGGTTGCATGTTCCATGTAATTACTATATTTGCCTATTTCAATTTTCAAGCTCTTTTCGTTGTGTTTAGTAAACTGTGGTGTGACCACTTACGGTCACAATAACCATTTTTATCTGTTTTTGGTATAATAAGCATGTCTGTGTTCGGTCC

SEQ ID NO: 2247 - DNA, 1345 bp, Zea mays
  misc_feature (1)..(1345): Ceres cDNA ID no. 13502498
  misc_feature (1)..(1345): Ceres CLONE  ID no. 272277
  misc_feature (1)..(1345): Also known as  Ceres CDNA ID no. 23756937
ataccgcaaccagctattgagctactgcctctgaccaagtcccaagctgcgctgcgcctgctatgtcgtcgtcctcgcccgtatcggcggtctcatcagccactgcgccgcacgtcgtggacgactgcctcggcatcgtgcagcttcttagcgatggcaccgtgacgcgctccgcggactactccgacatccctctcctgggcgaggtgccgtccaacctgcccgtccagtggaaggacgtcgtctacgaccccgcgcacgcgctccgcctccgcatgtacaggcccaccgacaccgacggcggcaggacgaccaacaacaagctgccggtgctagtctacttccacggcggcggcttctgcatctgcagcttcgagatgccccacttccacgccggcgggctccgcctcgccgccgagctcccggcgctcgtgctctccgccgactaccgcctggggcccgagcaccgcctccccgcggcgcaccgcgacgccgaggccgtcctgtcctggctccgcgcccaggccgaggccgacccgtggcttgtcgagtcggctgacatgggcagggtgttcgtctgcggcgactcggccggcggcaacatcgcgcaccacatcgccgtccagtacggcacgggccacctcgccctcggccccgtcgtccggcttggcggctacatcatgctgtggccctacttcgccgccgaggagaggacggcgtccgagacggccggtcttgacgtcgaccaccagttcgttagcacggcgctgttggatcagatgtggcgcctggcgctgccggtcggcgcgaccagggaccacccagcagcgaacccgttcggaccggacagcgtcccgctggaggacgtcgccttccagccgctgctcgtcgtggacccagaccaggacgtgctgcacgaccgcacacaggactatgccgctaggttgacggccatggggaaactggtcgagctcgtcgtgttcagaggccagggccacgggttcttcgtcttcgacccgtgtggtgaagctttccgaccagctgatccacgtcattcggcgcttcgtactgttgcataagcatccatgtaatcttgttgatcttagtactaccatgtagttgcattagtgagtcatgtactcatgtgttcgtcagtcggacaagtttgtttcgtagaatcgcggacgagctggagagtgcacagcccgtgcagtgaccgcgtctagggatgtgtttccgccacggtgtgcatgtcatgcacgtcgcacgttcgtccttagaagtcggatcgtgcagctgtattccgtggcggggaaacgtggaactaccccagtgtatttggttc

SEQ ID NO: 2248 - protein, 1345 aa, Zea mays
  misc_feature: PFam Name: Abhydrolase_3; PFam Description: alpha/beta
  misc_feature: PFam Name: COesterase; PFam Description: Carboxylesterase
  misc_feature: PFam Name: Mucin; PFam Description: Mucin-like glycoprotein
  misc_feature: PFam Name: Peptidase_S8; PFam Description: Subtilase family
  misc_feature: PFam Name: SerH; PFam Description: Cell surface
  misc_feature: GI Number: 34895938; NR Description: P0030H07.40 [Oryza sativa (japonica cultivar-group)] >gi|13872965|dbj|BAB44070.1| P0030H07.40 [Oryza sativa (japonica cultivar-group)] >gi|15528618|dbj|BAB64639.1| P0011G08.10 [Oryza sativa (japonica
  misc_feature: GI Number: 50919067; NR Description: putative esterase [Oryza sativa (japonica cultivar-group)] >gi|27819508|gb|AAO24912.1|
  misc_feature: GI Number: 34895916; NR Description: P0030H07.24 [Oryza sativa (japonica cultivar-group)] >gi|13872954|dbj|BAB44059.1|
  misc_feature: GI Number: 34899924; NR Description: putative cell death associated protein [Oryza sativa (japonica cultivar-group)] >gi|22831101|dbj|BAC15963.1| putative cell death associated protein [Oryza sativa (japonica cultivar-group)] [Oryza sativa
  misc_feature: GI Number: 34899936; NR Description: putative cell death associated protein [Oryza sativa (japonica cultivar-group)] >gi|23617085|dbj|BAC20768.1| putative cell death associated protein
ATACCGCAACCAGCTATTGAGCTACTGCCTCTGACCAAGTCCCAAGCTGCGCTGCGCCTGCTATGTCGTCGTCCTCGCCCGTATCGGCGGTCTCATCAGCCACTGCGCCGCACGTCGTGGACGACTGCCTCGGCATCGTGCAGCTTCTTAGCGATGGCACCGTGACGCGCTCCGCGGACTACTCCGACATCCCTCTCCTGGGCGAGGTGCCGTCCAACCTGCCCGTCCAGTGGAAGGACGTCGTCTACGACCCCGCGCACGCGCTCCGCCTCCGCATGTACAGGCCCACCGACACCGACGGCGGCAGGACGACCAACAACAAGCTGCCGGTGCTAGTCTACTTCCACGGCGGCGGCTTCTGCATCTGCAGCTTCGAGATGCCCCACTTCCACGCCGGCGGGCTCCGCCTCGCCGCCGAGCTCCCGGCGCTCGTGCTCTCCGCCGACTACCGCCTGGGGCCCGAGCACCGCCTCCCCGCGGCGCACCGCGACGCCGAGGCCGTCCTGTCCTGGCTCCGCGCCCAGGCCGAGGCCGACCCGTGGCTTGTCGAGTCGGCTGACATGGGCAGGGTGTTCGTCTGCGGCGACTCGGCCGGCGGCAACATCGCGCACCACATCGCCGTCCAGTACGGCACGGGCCACCTCGCCCTCGGCCCCGTCGTCCGGCTTGGCGGCTACATCATGCTGTGGCCCTACTTCGCCGCCGAGGAGAGGACGGCGTCCGAGACGGCCGGTCTTGACGTCGACCACCAGTTCGTTAGCACGGCGCTGTTGGATCAGATGTGGCGCCTGGCGCTGCCGGTCGGCGCGACCAGGGACCACCCAGCAGCGAACCCGTTCGGACCGGACAGCGTCCCGCTGGAGGACGTCGCCTTCCAGCCGCTGCTCGTCGTGGACCCAGACCAGGACGTGCTGCACGACCGCACACAGGACTATGCCGCTAGGTTGACGGCCATGGGGAAACTGGTCGAGCTCGTCGTGTTCAGAGGCCAGGGCCACGGGTTCTTCGTCTTCGACCCGTGTGGTGAAGCTTTCCGACCAGCTGATCCACGTCATTCGGCGCTTCGTACTGTTGCATAAGCATCCATGTAATCTTGTTGATCTTAGTACTACCATGTAGTTGCATTAGTGAGTCATGTACTCATGTGTTCGTCAGTCGGACAAGTTTGTTTCGTAGAATCGCGGACGAGCTGGAGAGTGCACAGCCCGTGCAGTGACCGCGTCTAGGGATGTGTTTCCGCCACGGTGTGCATGTCATGCACGTCGCACGTTCGTCCTTAGAAGTCGGATCGTGCAGCTGTATTCCGTGGCGGGGAAACGTGGAACTACCCCAGTGTATTTGGTTC

SEQ ID NO: 2249 - DNA, 1604 bp, Arabidopsis thaliana
  misc_feature (1)..(1604): Ceres cDNA ID no. 13503043
  misc_feature (1)..(1604): Ceres CLONE  ID no. 1002369
  misc_feature (1)..(1604): Also known as  Ceres CDNA ID no. 23411589
gagcgagtgattaatgggacattaatgttacatatagaaaaacaaaaaaataagttattgcctttatacaacaaagttcccaaaattttgaattttttgtaatcatctctaagattctgttaatggtctcgcctgagacatcatcatcacattaccaatcatctccaatggcaaaatacgccggaacaagaaccagaccggttgtatgtatctccgacgtcgttctcttccttggcggagctttcatgtcactaatcctcgtctggtctttcttctccttctcttcaatctccccaaatctcaccgtgaaaaacgaagaatcctccaacaaatgttcttcaggaatcgatatgagccaagatccaaccgacccggtttactacgacgacccggatctaacctacacaatcgaaaaaccggttaaaaactgggacgagaaacgaagacgttggttaaatctacacccttcgtttatccccggagctgagaatcgtacggttatggtaacaggatcacaatctgcgccgtgtaaaaacccaatcggagatcatttgttgcttcgattttttaagaacaaagttgattattgtcggatccatggtcatgatatattctatagtaacgctcttcttcatccgaagatgaattcttattgggcgaaacttccggcggttaaagcggcgatgattgctcatcctgaggcggagtggatctggtgggttgattctgatgctttgtttacggatatggattttacgccgccgtggcgacggtataaggagcataatcttgttgttcatggttggccgggagtgatttataatgatcggagctggacggcgttaaacgccggagtttttctcattaggaattgtcagtggtctatggaactcattgacacgtggacaggtatgggaccagtgagtccagagtacgcaaaatggggacaaatccaacggtcaatattcaaagacaaactcttcccagagtcagatgatcaaacggctctgctttacttactctacaaacacagagaagtgtattatccaaagatatacctcgaaggagacttttatttcgaaggatattggttagagatcgtaccgggtttatccaacgtaacggaacggtatctggagatggaaagagaagacgccacgttgcgtagacgacacgcagagaaagtgagcgaacgatacgctgcgtttcgtgaggaacggtttttaaaaggagaaagaggcgggaaaggaagcaaacggagaccgttcgtgacgcattttacgggatgtcaaccttgtagtggtgatcataacaagatgtacgatggtgacacgtgttggaatgggatgatcaaagccattaatttcgctgataatcaagtgatgcgtaaatatggtttcgtacactcggatctaggcaagacttcccctcttcaacctgtaccgttcgattatcctgatgagccttggtgaaataattgtgttttgttgttttataaactctttagatgtgcttttataatgagttgattattataatccatgaagtgaaaggtttataatgcggaatctttttgaataattcaatgattattggtttatttg

SEQ ID NO: 2250 - protein, 1604 aa, Arabidopsis thaliana
  misc_feature: PFam Name: Glyco_transf_34; PFam Description: galactosyl
  misc_feature: GI Number: 5702018; NR Description: alpha galactosyltransferase [Trigonella foenum-graecum] >gi|25486551|pir||T52082 alpha galactosyltransferase (EC 2.4.1.-)
  misc_feature: GI Number: 55956980; NR Description:
  misc_feature: GI Number: 55956978; NR Description:
  misc_feature: GI Number: 55956976; NR Description:
  misc_feature: GI Number: 62700755; NR Description: galactomannan
GAGCGAGTGATTAATGGGACATTAATGTTACATATAGAAAAACAAAAAAATAAGTTATTGCCTTTATACAACAAAGTTCCCAAAATTTTGAATTTTTTGTAATCATCTCTAAGATTCTGTTAATGGTCTCGCCTGAGACATCATCATCACATTACCAATCATCTCCAATGGCAAAATACGCCGGAACAAGAACCAGACCGGTTGTATGTATCTCCGACGTCGTTCTCTTCCTTGGCGGAGCTTTCATGTCACTAATCCTCGTCTGGTCTTTCTTCTCCTTCTCTTCAATCTCCCCAAATCTCACCGTGAAAAACGAAGAATCCTCCAACAAATGTTCTTCAGGAATCGATATGAGCCAAGATCCAACCGACCCGGTTTACTACGACGACCCGGATCTAACCTACACAATCGAAAAACCGGTTAAAAACTGGGACGAGAAACGAAGACGTTGGTTAAATCTACACCCTTCGTTTATCCCCGGAGCTGAGAATCGTACGGTTATGGTAACAGGATCACAATCTGCGCCGTGTAAAAACCCAATCGGAGATCATTTGTTGCTTCGATTTTTTAAGAACAAAGTTGATTATTGTCGGATCCATGGTCATGATATATTCTATAGTAACGCTCTTCTTCATCCGAAGATGAATTCTTATTGGGCGAAACTTCCGGCGGTTAAAGCGGCGATGATTGCTCATCCTGAGGCGGAGTGGATCTGGTGGGTTGATTCTGATGCTTTGTTTACGGATATGGATTTTACGCCGCCGTGGCGACGGTATAAGGAGCATAATCTTGTTGTTCATGGTTGGCCGGGAGTGATTTATAATGATCGGAGCTGGACGGCGTTAAACGCCGGAGTTTTTCTCATTAGGAATTGTCAGTGGTCTATGGAACTCATTGACACGTGGACAGGTATGGGACCAGTGAGTCCAGAGTACGCAAAATGGGGACAAATCCAACGGTCAATATTCAAAGACAAACTCTTCCCAGAGTCAGATGATCAAACGGCTCTGCTTTACTTACTCTACAAACACAGAGAAGTGTATTATCCAAAGATATACCTCGAAGGAGACTTTTATTTCGAAGGATATTGGTTAGAGATCGTACCGGGTTTATCCAACGTAACGGAACGGTATCTGGAGATGGAAAGAGAAGACGCCACGTTGCGTAGACGACACGCAGAGAAAGTGAGCGAACGATACGCTGCGTTTCGTGAGGAACGGTTTTTAAAAGGAGAAAGAGGCGGGAAAGGAAGCAAACGGAGACCGTTCGTGACGCATTTTACGGGATGTCAACCTTGTAGTGGTGATCATAACAAGATGTACGATGGTGACACGTGTTGGAATGGGATGATCAAAGCCATTAATTTCGCTGATAATCAAGTGATGCGTAAATATGGTTTCGTACACTCGGATCTAGGCAAGACTTCCCCTCTTCAACCTGTACCGTTCGATTATCCTGATGAGCCTTGGTGAAATAATTGTGTTTTGTTGTTTTATAAACTCTTTAGATGTGCTTTTATAATGAGTTGATTATTATAATCCATGAAGTGAAAGGTTTATAATGCGGAATCTTTTTGAATAATTCAATGATTATTGGTTTATTTG

SEQ ID NO: 2251 - DNA, 1391 bp, Zea mays
  misc_feature (1)..(1391): Ceres cDNA ID no. 13504058
  misc_feature (1)..(1391): Ceres CLONE  ID no. 493557
  misc_feature (1)..(1391): Also known as  Ceres CDNA ID no. 23790761
  misc_feature (1379)..(1379): n is a, c, t, g, unknown, or other
agcgcagggtcaggagaggcagaggcctcagagatacgccgggacgcaacacgtcgtgccgcgcggagggttttgccgagattttccctcaaaagggtattgccacccgcaccgagaaaagaaaacgatacacaccgagataaaaacataccctctccatcctctcctcttcttcctcctcccgtagcggcttcccccgatttgcatccgggcgcggccccatccccacctggccgccgcgcgccgccatggacggcctgcacggtacggacgcatgcttctcccccgcgagggctatctcgccgcaggtgaggccccccgggccgccggacgtaggcagtcagtacctggcggagctgctgcaggagcaccagaagctggggcccttcatgcaggtgctcccaatctgcagcaggctgctgaatcaagaaatagtgcgggtgtcgaatatacggcgccaacatggtgttgctggcgactttgagaggtttccagccgcaagccccaaccagatgcatccggcaccccccatgacaaacttttgtggaaacggttttagtccatggaatgggatgcattcagagagagtaggtgttccgcaaggagctatgggttggcaaggacccccacagagcccctcttcttatattgtcaagaagattttgcggttggaagtaccgacagaagcataccctaatttcaattttatcggccgtcttcttggaccaaggggaaactctttaaagatgattgaagcctccacaggctgtcgtgttttcatcagagggaaaggctcaattaaagattctggcaaggaggaacaactcaagggaagacctggctatgaacacttgagtgaacccctccatatcttgattgaagctgagttacctgctaatgtgattgatgcaagacttgcaaaggcacaagagatccttgaagagctgttgaaaccagtggacgaatcacaagactactacaagagacagcaactgcgagaacttgcaatgctaaattcgccactccgagaggagagtccacatccaggtggtgctcctcctagtcccttcagtaacggcggcatgaaaagagtgaaacaatgacaccgccgaggctcgttcctccatcttgactccccagcaaccccaatgcagtccataccttcacaccctatttttcaatgagcaagctttcatgacggtgttggtagtgtgtgacattcttcactgtactagcaggtgaattttgatctcccatcccatgttacattaaccttgagtgacagatgactatgcgtagtgtatcctctatggcagtataactagaacatttgatttatttgttactggtaatgctgagatatagtactgtgcagattntgagttacggtg

SEQ ID NO: 2252 - protein, 1391 aa, Zea mays
  misc_feature: PFam Name: KH_1; PFam Description: KH domain
  misc_feature: GI Number: 34909270; NR Description: P0454H12.18 [Oryza sativa (japonica cultivar-group)] >gi|15128399|dbj|BAB62585.1|
  misc_feature: GI Number: 34900448; NR Description: KH domain-like protein [Oryza sativa (japonica cultivar-group)] >gi|24060154|dbj|BAC21599.1| KH domain-like protein [Oryza sativa
  misc_feature: GI Number: 23197752; NR Description: putative RNA-binding protein [Arabidopsis thaliana] >gi|3786011|gb|AAC67357.1| putative RNA-binding protein [Arabidopsis thaliana] >gi|17978787|gb|AAL47387.1| putative RNA-binding protein
  misc_feature: GI Number: 56785233; NR Description: QUAKING isoform 5-like [Oryza sativa (japonica cultivar-group)] gi|56784311|dbj|BAD82237.1| QUAKING isoform 5-like [Oryza sativa
  misc_feature: GI Number: 19310523; NR Description: At1g09660/F21M12_5 [Arabidopsis thaliana] >gi|16930473|gb|AAL31922.1|
AGCGCAGGGTCAGGAGAGGCAGAGGCCTCAGAGATACGCCGGGACGCAACACGTCGTGCCGCGCGGAGGGTTTTGCCGAGATTTTCCCTCAAAAGGGTATTGCCACCCGCACCGAGAAAAGAAAACGATACACACCGAGATAAAAACATACCCTCTCCATCCTCTCCTCTTCTTCCTCCTCCCGTAGCGGCTTCCCCCGATTTGCATCCGGGCGCGGCCCCATCCCCACCTGGCCGCCGCGCGCCGCCATGGACGGCCTGCACGGTACGGACGCATGCTTCTCCCCCGCGAGGGCTATCTCGCCGCAGGTGAGGCCCCCCGGGCCGCCGGACGTAGGCAGTCAGTACCTGGCGGAGCTGCTGCAGGAGCACCAGAAGCTGGGGCCCTTCATGCAGGTGCTCCCAATCTGCAGCAGGCTGCTGAATCAAGAAATAGTGCGGGTGTCGAATATACGGCGCCAACATGGTGTTGCTGGCGACTTTGAGAGGTTTCCAGCCGCAAGCCCCAACCAGATGCATCCGGCACCCCCCATGACAAACTTTTGTGGAAACGGTTTTAGTCCATGGAATGGGATGCATTCAGAGAGAGTAGGTGTTCCGCAAGGAGCTATGGGTTGGCAAGGACCCCCACAGAGCCCCTCTTCTTATATTGTCAAGAAGATTTTGCGGTTGGAAGTACCGACAGAAGCATACCCTAATTTCAATTTTATCGGCCGTCTTCTTGGACCAAGGGGAAACTCTTTAAAGATGATTGAAGCCTCCACAGGCTGTCGTGTTTTCATCAGAGGGAAAGGCTCAATTAAAGATTCTGGCAAGGAGGAACAACTCAAGGGAAGACCTGGCTATGAACACTTGAGTGAACCCCTCCATATCTTGATTGAAGCTGAGTTACCTGCTAATGTGATTGATGCAAGACTTGCAAAGGCACAAGAGATCCTTGAAGAGCTGTTGAAACCAGTGGACGAATCACAAGACTACTACAAGAGACAGCAACTGCGAGAACTTGCAATGCTAAATTCGCCACTCCGAGAGGAGAGTCCACATCCAGGTGGTGCTCCTCCTAGTCCCTTCAGTAACGGCGGCATGAAAAGAGTGAAACAATGACACCGCCGAGGCTCGTTCCTCCATCTTGACTCCCCAGCAACCCCAATGCAGTCCATACCTTCACACCCTATTTTTCAATGAGCAAGCTTTCATGACGGTGTTGGTAGTGTGTGACATTCTTCACTGTACTAGCAGGTGAATTTTGATCTCCCATCCCATGTTACATTAACCTTGAGTGACAGATGACTATGCGTAGTGTATCCTCTATGGCAGTATAACTAGAACATTTGATTTATTTGTTACTGGTAATGCTGAGATATAGTACTGTGCAGATTNTGAGTTACGGTG

SEQ ID NO: 2253 - DNA, 1173 bp, Arabidopsis thaliana
  misc_feature (1)..(1173): Ceres cDNA ID no. 13504705
  misc_feature (1)..(1173): Also known as  Ceres CDNA ID no. 23790761
atgaagggggatcaagaagtacaagtcattgttcagcagggaaaagaaccaattccaacagatcaagacgaaagaagttcggtcagtggcagccaaacaaaactatctcactctaatacatacaaacggtggctccgggttgctatctatacattctttgtcatttcaggccaatcagttgctacaattctgggcagactatactatgaaaatggaggaaacagcaaatggctagcaacggtagttcagcttgtaggctttcctattctacttccatatcatctcttgtcagtcaaaacacatacaacaactcagagagatggcaaattaacctcacttaggaaccgtgcattagtttacatagtgcttggacttcttgtaggagcagcttgctacctatattccattggactgctttacctacctgtttctaccctttccctgatctgtgcatcacagttagccttcaccgctttcttctcttatttactcaactcacaaaaacttactcctatcattttgaattctcttttcctcctcactatatcttccaccctccttgcatttaataacgaggaatcagattccaaaaaagttacaaaaggagagtatgtcaaaggtttcgtatgcaccgttggtgcatctgctgggtttggtctactcttatccctacaacagctagcctttcgtaaagttttaaagaagcaaactttctcagaagttataaatatgataatctacatgagtctagtggccagttgtgttagcgtggtggggctttttgctagtagcgagtggaaaactttgagcagtgaaatggaaaactacaaacttgggaaggtatcctatgtcatgaacctagtgtggacagctgttacctggcaggtattctccatcggttgcacaggactgatcttcgagctttcctccctattctcaaatgcaataagcgctttgggactccccgtggttcctatcctggctgtcatcattttccatgacaaaatgaacggcttaaaggtgatttctatgattctagctatttggggtttcgtatcctatgtctaccaacaatatcttgatgaaacaaacttgaagaaaagtaatgaaataccaacaacagaatcccctgaccgaccagaagcagaagggtcaagtgagcaatcaaaataa

SEQ ID NO: 2254 - protein, 1173 aa, Arabidopsis thaliana
  misc_feature: PFam Name: KH_1; PFam Description: KH domain
  misc_feature: GI Number: 34909270; NR Description: P0454H12.18 [Oryza sativa (japonica cultivar-group)] >gi|15128399|dbj|BAB62585.1|
  misc_feature: GI Number: 34900448; NR Description: KH domain-like protein [Oryza sativa (japonica cultivar-group)] >gi|24060154|dbj|BAC21599.1| KH domain-like protein [Oryza sativa
  misc_feature: GI Number: 23197752; NR Description: putative RNA-binding protein [Arabidopsis thaliana] >gi|3786011|gb|AAC67357.1| putative RNA-binding protein [Arabidopsis thaliana] >gi|17978787|gb|AAL47387.1| putative RNA-binding protein
  misc_feature: GI Number: 56785233; NR Description: QUAKING isoform 5-like [Oryza sativa (japonica cultivar-group)] gi|56784311|dbj|BAD82237.1| QUAKING isoform 5-like [Oryza sativa
  misc_feature: GI Number: 19310523; NR Description: At1g09660/F21M12_5 [Arabidopsis thaliana] >gi|16930473|gb|AAL31922.1|
ATGAAGGGGGATCAAGAAGTACAAGTCATTGTTCAGCAGGGAAAAGAACCAATTCCAACAGATCAAGACGAAAGAAGTTCGGTCAGTGGCAGCCAAACAAAACTATCTCACTCTAATACATACAAACGGTGGCTCCGGGTTGCTATCTATACATTCTTTGTCATTTCAGGCCAATCAGTTGCTACAATTCTGGGCAGACTATACTATGAAAATGGAGGAAACAGCAAATGGCTAGCAACGGTAGTTCAGCTTGTAGGCTTTCCTATTCTACTTCCATATCATCTCTTGTCAGTCAAAACACATACAACAACTCAGAGAGATGGCAAATTAACCTCACTTAGGAACCGTGCATTAGTTTACATAGTGCTTGGACTTCTTGTAGGAGCAGCTTGCTACCTATATTCCATTGGACTGCTTTACCTACCTGTTTCTACCCTTTCCCTGATCTGTGCATCACAGTTAGCCTTCACCGCTTTCTTCTCTTATTTACTCAACTCACAAAAACTTACTCCTATCATTTTGAATTCTCTTTTCCTCCTCACTATATCTTCCACCCTCCTTGCATTTAATAACGAGGAATCAGATTCCAAAAAAGTTACAAAAGGAGAGTATGTCAAAGGTTTCGTATGCACCGTTGGTGCATCTGCTGGGTTTGGTCTACTCTTATCCCTACAACAGCTAGCCTTTCGTAAAGTTTTAAAGAAGCAAACTTTCTCAGAAGTTATAAATATGATAATCTACATGAGTCTAGTGGCCAGTTGTGTTAGCGTGGTGGGGCTTTTTGCTAGTAGCGAGTGGAAAACTTTGAGCAGTGAAATGGAAAACTACAAACTTGGGAAGGTATCCTATGTCATGAACCTAGTGTGGACAGCTGTTACCTGGCAGGTATTCTCCATCGGTTGCACAGGACTGATCTTCGAGCTTTCCTCCCTATTCTCAAATGCAATAAGCGCTTTGGGACTCCCCGTGGTTCCTATCCTGGCTGTCATCATTTTCCATGACAAAATGAACGGCTTAAAGGTGATTTCTATGATTCTAGCTATTTGGGGTTTCGTATCCTATGTCTACCAACAATATCTTGATGAAACAAACTTGAAGAAAAGTAATGAAATACCAACAACAGAATCCCCTGACCGACCAGAAGCAGAAGGGTCAAGTGAGCAATCAAAATAA

SEQ ID NO: 2255 - DNA, 1910 bp, Arabidopsis thaliana
  misc_feature (1)..(1910): Ceres cDNA ID no. 13509014
  misc_feature (1)..(1910): Ceres CLONE  ID no. 25677
  misc_feature (1)..(1910): Also known as  Ceres CDNA ID no. 23431227
acttaactcatatcaaccttcgccggaaataatggctttcccgcgatttctttctctcctcgccgtcgtcactctctctcttttcctcaccaccactgatgcttcctctcgctctctatccactccacctaaaacgaacgtactcgacgtcgtttcatctctccagcaaacacaaactatcctctcactcgacccgactcgttcctcactcaccaccaccaaacccgaatccctatccgacccggttttcttcaattcatcttcaccactatctctagagcttcactctcgagacactttcgtcgcgtcacagcacaaagactacaaaagcttaacactcagtcgactcgagcgcgactcatcccgagtcgccggaatcgtcgcgaagatccgtttcgccgtcgaaggagtcgatagatccgatctcaaacccgtttacaacgaagatacacgataccaaaccgaggatctaacgacacctgtcgtctccggagcctctcaaggaagcggcgagtatttctcaagaatcggtgtcggaactccggcgaaagagatgtacttggttctcgacaccggaagcgacgtaaattggatccagtgtgaaccttgcgccgactgttaccaacagtccgacccggtttttaacccgacttcgtcttccacatacaaatctctcacttgctctgctccacagtgctctcttctcgaaacctccgcttgtcggtcaaacaaatgtctctaccaagttagttacggagacggatctttcaccgtcggtgaactcgctaccgatacggtgacgtttggtaactctggtaaaataaacaacgtcgctttgggttgtggtcacgacaacgaaggtctctttaccggagcagccggtttactcggtttaggcggtggtgttttatcgataaccaatcaaatgaaagcgacgtcgttttcttactgcctcgttgaccgtgactcgggaaagtcctcaagtcttgatttcaactcggtccaactcggtggcggagacgcgacggcgccgcttctacgtaacaaaaagatcgacactttctactacgtcggactcagtggattcagcgtcggtggtgaaaaagtcgtgctgcctgatgcgatcttcgatgtcgatgcttcgggaagcggaggagtgatcttggattgtggaaccgccgtgactcgtcttcagacgcaggcttataactcgctgcgtgacgcgtttcttaaactcaccgtgaatctcaaaaaaggatcttcgagcatctctctgttcgacacgtgttacgatttctcgtctctctccactgtgaaagtaccgacggttgcgtttcatttcacgggagggaagtcgcttgatttgccggcgaagaattatctgatccctgtggatgatagtggaacgttttgcttcgcttttgctccgacgtcgtcgtcgttgtcgatcatcgggaatgtgcagcagcaagggacacgtatcacttacgatctatccaaaaatgttatcggattgtcagggaataaatgctaaacatgtcaaagtagaaaaattaatagttttacgggtaatcagtaaaactttttatggtactagctagctacggtaacaagatgaaaacaaaatccttaagtgtgaatttttctaccttttttttaattaatcataagttattgtcgtcttttatcgaataataataggattaattaattttattataaagttgaaagtgttgttgtctcagcaagaagttttcagtagtgaagaagaagaagagtcaataaagtaagaagttacaaaaaagaagggtctttttgtaacaaaagtttagtcttcaaagaaacaaacagacttttgttgttgtggccctttaatgtccttcaatattttaaattatagtctgaatttt

SEQ ID NO: 2256 - protein, 1910 aa, Arabidopsis thaliana
  misc_feature: PFam Name: Asp; PFam Description: Eukaryotic aspartyl protease
  misc_feature: GI Number: 23297732; NR Description: putative chloroplast nucleoid DNA-binding protein [Arabidopsis thaliana] >gi|11994113|dbj|BAB01116.1| CND41, chloroplast nucleoid DNA binding protein-like [Arabidopsis thaliana]
  misc_feature: GI Number: 19424106; NR Description: putative chloroplast
  misc_feature: GI Number: 34895664; NR Description: nucleoid DNA-binding protein cnd41-like protein [Oryza sativa (japonica cultivar-group)] >gi|12328547|dbj|BAB21205.1| nucleoid DNA-binding protein
  misc_feature: GI Number: 14532550; NR Description: AT3g61820/F15G16_210
  misc_feature: GI Number: 21594980; NR Description: chloroplast nucleoid DNA
ACTTAACTCATATCAACCTTCGCCGGAAATAATGGCTTTCCCGCGATTTCTTTCTCTCCTCGCCGTCGTCACTCTCTCTCTTTTCCTCACCACCACTGATGCTTCCTCTCGCTCTCTATCCACTCCACCTAAAACGAACGTACTCGACGTCGTTTCATCTCTCCAGCAAACACAAACTATCCTCTCACTCGACCCGACTCGTTCCTCACTCACCACCACCAAACCCGAATCCCTATCCGACCCGGTTTTCTTCAATTCATCTTCACCACTATCTCTAGAGCTTCACTCTCGAGACACTTTCGTCGCGTCACAGCACAAAGACTACAAAAGCTTAACACTCAGTCGACTCGAGCGCGACTCATCCCGAGTCGCCGGAATCGTCGCGAAGATCCGTTTCGCCGTCGAAGGAGTCGATAGATCCGATCTCAAACCCGTTTACAACGAAGATACACGATACCAAACCGAGGATCTAACGACACCTGTCGTCTCCGGAGCCTCTCAAGGAAGCGGCGAGTATTTCTCAAGAATCGGTGTCGGAACTCCGGCGAAAGAGATGTACTTGGTTCTCGACACCGGAAGCGACGTAAATTGGATCCAGTGTGAACCTTGCGCCGACTGTTACCAACAGTCCGACCCGGTTTTTAACCCGACTTCGTCTTCCACATACAAATCTCTCACTTGCTCTGCTCCACAGTGCTCTCTTCTCGAAACCTCCGCTTGTCGGTCAAACAAATGTCTCTACCAAGTTAGTTACGGAGACGGATCTTTCACCGTCGGTGAACTCGCTACCGATACGGTGACGTTTGGTAACTCTGGTAAAATAAACAACGTCGCTTTGGGTTGTGGTCACGACAACGAAGGTCTCTTTACCGGAGCAGCCGGTTTACTCGGTTTAGGCGGTGGTGTTTTATCGATAACCAATCAAATGAAAGCGACGTCGTTTTCTTACTGCCTCGTTGACCGTGACTCGGGAAAGTCCTCAAGTCTTGATTTCAACTCGGTCCAACTCGGTGGCGGAGACGCGACGGCGCCGCTTCTACGTAACAAAAAGATCGACACTTTCTACTACGTCGGACTCAGTGGATTCAGCGTCGGTGGTGAAAAAGTCGTGCTGCCTGATGCGATCTTCGATGTCGATGCTTCGGGAAGCGGAGGAGTGATCTTGGATTGTGGAACCGCCGTGACTCGTCTTCAGACGCAGGCTTATAACTCGCTGCGTGACGCGTTTCTTAAACTCACCGTGAATCTCAAAAAAGGATCTTCGAGCATCTCTCTGTTCGACACGTGTTACGATTTCTCGTCTCTCTCCACTGTGAAAGTACCGACGGTTGCGTTTCATTTCACGGGAGGGAAGTCGCTTGATTTGCCGGCGAAGAATTATCTGATCCCTGTGGATGATAGTGGAACGTTTTGCTTCGCTTTTGCTCCGACGTCGTCGTCGTTGTCGATCATCGGGAATGTGCAGCAGCAAGGGACACGTATCACTTACGATCTATCCAAAAATGTTATCGGATTGTCAGGGAATAAATGCTAAACATGTCAAAGTAGAAAAATTAATAGTTTTACGGGTAATCAGTAAAACTTTTTATGGTACTAGCTAGCTACGGTAACAAGATGAAAACAAAATCCTTAAGTGTGAATTTTTCTACCTTTTTTTTAATTAATCATAAGTTATTGTCGTCTTTTATCGAATAATAATAGGATTAATTAATTTTATTATAAAGTTGAAAGTGTTGTTGTCTCAGCAAGAAGTTTTCAGTAGTGAAGAAGAAGAAGAGTCAATAAAGTAAGAAGTTACAAAAAAGAAGGGTCTTTTTGTAACAAAAGTTTAGTCTTCAAAGAAACAAACAGACTTTTGTTGTTGTGGCCCTTTAATGTCCTTCAATATTTTAAATTATAGTCTGAATTTT

SEQ ID NO: 2257 - DNA, 1569 bp, Arabidopsis thaliana
  misc_feature (1)..(1569): Ceres cDNA ID no. 13509244
  misc_feature (1)..(1569): Ceres CLONE  ID no. 1025185
  misc_feature (1)..(1569): Also known as  Ceres CDNA ID no. 23431514
gattttggccttctttctgatatttatttatctccgaaacttttgcttcttaagtctgtctctctcttctatcagattccacactaatcggaaaaaatggcacagaagcttaacttgcttaatctcgccgtccctccggtcacccaccgctctaacttcccttccaccttcaccttcggcgtcgccacttccgcttaccagattgaaggaggttggaatgaaggtaaaaagggaccaagtatatgggataagttcactcatatcgaagggaagattcttgatggaagtaacggcgatgttgctgtggatcattaccatagatacaaggaagatgttgatcttataggacaattaggattcggtgcttacagattttctatatcttggtctcgaattttccctgatggcctgggaactgaagtcaatgaagaaggcattgctttctacaacgatcttattaatacacttcttgaaaaaggtattcagccgtatgtaactctgtaccattgggatctcccatcacatctccaggaagcaatcggaggttggacaaataggaaaattgtcgattattttggcctctatgcagatgcttgttttgccaattttggtgatagagtgaagcactggatcacattaaatgaacctcttcagacctcggtgaatggacactgtattggtatatttgcacctggaagaaatgagaagcccttgatcgaaccatatttggtctcacatcatcaggttctggcccatgcaactgctgtatccatatatagaagcaagtacaaggaaagtcaaggtggacaaatcggtttgtcagttgattgtgaatgggcagagccaaactctgagaaaccagaagacaaggttgctgcggataggcgaattgactttcaacttggatggttcttggatcctttgttttttggagactatcctgcaagtatgcgccagaaacttggagacaatcttcctagatttactccggaagaaaaggagtttatgcttcaaaactcatgggacttccttggcctgaaccactatacgtcgaggttgatttctcatgtctcaaacaaagaagctgagagtaacttttaccaagcacaagaattggagaggattgttgaactggaaaatggagatttgataggcgaaagggctgcttcggattggctttatgctgtgccttggggaatccgaaagacattgaattacatgagcaaaaaatataaccaccctccaatatttatcactgaaaatggtatggatgatgaagatgatggatcggcctctattcatgatatgcttgacgataaacgtagagttgactatttcaagagttaccttgccaacgtctcccaggctattgaagacggagtggacataaagggatactttgcgtggtcgctgctggacaacttcgagtgggcgcaagggtacaccaagagatttggtttggtatatgtagactacaagaacggtttaacccgtcacccaaaatcatctgcttactggttcatgaaatttctgaaaggtgatgaagaaaacaaaggtaagaaggaatga

SEQ ID NO: 2258 - protein, 1569 aa, Arabidopsis thaliana
  misc_feature: PFam Name: Glyco_hydro_1; PFam Description: Glycosyl
  misc_feature: GI Number: 37202036; NR Description: At5g36890 [Arabidopsis thaliana] >gi|10178206|dbj|BAB11630.1| beta-glucosidase [Arabidopsis thaliana] >gi|51969662|dbj|BAD43523.1| beta-glucosidase -like protein [Arabidopsis thaliana]
  misc_feature: GI Number: 22658440; NR Description: beta-glucosidase [Oryza
  misc_feature: GI Number: 31580730; NR Description: latex cyanogenic beta
  misc_feature: GI Number: 34907636; NR Description: putative beta-glucosidase [Oryza sativa (japonica cultivar-group)] >gi|19386689|dbj|BAB86071.1| putative beta-glucosidase [Oryza sativa (japonica cultivar-group)] >gi|22093598|dbj|BAC06894.1|
  misc_feature: GI Number: 56785274; NR Description: putative latex cyanogenic beta glucosidase [Oryza sativa (japonica cultivar-group)] gi|56784325|dbj|BAD82346.1| putative latex cyanogenic beta glucosidase [Oryza sativa (japonica
GATTTTGGCCTTCTTTCTGATATTTATTTATCTCCGAAACTTTTGCTTCTTAAGTCTGTCTCTCTCTTCTATCAGATTCCACACTAATCGGAAAAAATGGCACAGAAGCTTAACTTGCTTAATCTCGCCGTCCCTCCGGTCACCCACCGCTCTAACTTCCCTTCCACCTTCACCTTCGGCGTCGCCACTTCCGCTTACCAGATTGAAGGAGGTTGGAATGAAGGTAAAAAGGGACCAAGTATATGGGATAAGTTCACTCATATCGAAGGGAAGATTCTTGATGGAAGTAACGGCGATGTTGCTGTGGATCATTACCATAGATACAAGGAAGATGTTGATCTTATAGGACAATTAGGATTCGGTGCTTACAGATTTTCTATATCTTGGTCTCGAATTTTCCCTGATGGCCTGGGAACTGAAGTCAATGAAGAAGGCATTGCTTTCTACAACGATCTTATTAATACACTTCTTGAAAAAGGTATTCAGCCGTATGTAACTCTGTACCATTGGGATCTCCCATCACATCTCCAGGAAGCAATCGGAGGTTGGACAAATAGGAAAATTGTCGATTATTTTGGCCTCTATGCAGATGCTTGTTTTGCCAATTTTGGTGATAGAGTGAAGCACTGGATCACATTAAATGAACCTCTTCAGACCTCGGTGAATGGACACTGTATTGGTATATTTGCACCTGGAAGAAATGAGAAGCCCTTGATCGAACCATATTTGGTCTCACATCATCAGGTTCTGGCCCATGCAACTGCTGTATCCATATATAGAAGCAAGTACAAGGAAAGTCAAGGTGGACAAATCGGTTTGTCAGTTGATTGTGAATGGGCAGAGCCAAACTCTGAGAAACCAGAAGACAAGGTTGCTGCGGATAGGCGAATTGACTTTCAACTTGGATGGTTCTTGGATCCTTTGTTTTTTGGAGACTATCCTGCAAGTATGCGCCAGAAACTTGGAGACAATCTTCCTAGATTTACTCCGGAAGAAAAGGAGTTTATGCTTCAAAACTCATGGGACTTCCTTGGCCTGAACCACTATACGTCGAGGTTGATTTCTCATGTCTCAAACAAAGAAGCTGAGAGTAACTTTTACCAAGCACAAGAATTGGAGAGGATTGTTGAACTGGAAAATGGAGATTTGATAGGCGAAAGGGCTGCTTCGGATTGGCTTTATGCTGTGCCTTGGGGAATCCGAAAGACATTGAATTACATGAGCAAAAAATATAACCACCCTCCAATATTTATCACTGAAAATGGTATGGATGATGAAGATGATGGATCGGCCTCTATTCATGATATGCTTGACGATAAACGTAGAGTTGACTATTTCAAGAGTTACCTTGCCAACGTCTCCCAGGCTATTGAAGACGGAGTGGACATAAAGGGATACTTTGCGTGGTCGCTGCTGGACAACTTCGAGTGGGCGCAAGGGTACACCAAGAGATTTGGTTTGGTATATGTAGACTACAAGAACGGTTTAACCCGTCACCCAAAATCATCTGCTTACTGGTTCATGAAATTTCTGAAAGGTGATGAAGAAAACAAAGGTAAGAAGGAATGA

SEQ ID NO: 2259 - DNA, 1610 bp, Arabidopsis thaliana
  misc_feature (1)..(1610): Ceres cDNA ID no. 13509351
  misc_feature (1)..(1610): Ceres CLONE  ID no. 1008613
  misc_feature (1)..(1610): Also known as  Ceres CDNA ID no. 23431652
  misc_feature (1540)..(1540): n is a, c, t, g, unknown, or other
  misc_feature (1577)..(1577): n is a, c, t, g, unknown, or other
  misc_feature (1603)..(1603): n is a, c, t, g, unknown, or other
tccaatcctcagcccaaacccaaacccgctcctcctcctcctccgtcaacatcctccggttcacaaatcggtccaatcctaaaccgaccaatgatcgatctctcagctctctacgacctccacaaagaactcggccgtggccaattcggaatcacttacaaatgcacggacaaatccaacggtcgagaatacgcctgcaaatccatctcaaaacgtaaactcatacgtcgcaaagacatcgaagacgtgagacgtgaggtcatgatcttgcaacaccttactggtcaaccaaacatagtcgagtttcgaggcgcgtatgaagacaaagacaatcttcatttggttatggagctctgttctggaggagagctttttgatcgtattatcaagaaaggaagttactctgagaaagaagctgctaatatcttcagacagatcgttaatgttgttcatgtttgtcacttcatgggcgttgttcatagagacttaaagcctgagaatttcttgcttgttagtaacgaagaagattctccaatcaaagcaacagattttggactctctgttttcatcgaagaaggtaaagtgtatagagatatagttgggagcgcatactacgttgcacctgaagttctacatcgaaactacgggaaagaaatcgatgtatggagcgcgggtgttatgctttacattcttctcagtggtgttcctccattttggggagagaccgagaagactatatttgaggcgatcttagaaggaaagctggatcttgaaacttctccttggcctactatatcggaaagcgcaaaagatttgataagaaagatgttgataagagatcctaaaaaaaggataaccgcagctgaagcacttgagcatccatggatgacagacaccaaaatttctgataaaccaatcaatagtgctgttcttgttaggatgaagcaattccgcgcgatgaacaagctcaagaaacttgccttgaaggtgatagcggaaaacttatcggaagaagagataaaaggattaaagcaaacgtttaagaacatggatacagatgaaagtggcaccatcacttttgatgaactaagaaacgggttacatcgtcttggatctaagcttacggagtctgaaatcaaacaactcatggaagctgctgatgtggacaaaagtgggacgattgattacattgagtttgtaactgcaacaatgcatcgtcatagattggagaaagaagagaatttgatagaagcatttaaatacttcgacaaagacagaagcggttttatcacaagggacgagcttaaacactccatgactgagtatggcatgggtgatgatgcgaccatagatgaagttatcaatgatgttgataccgacaatgatgggaggataaactacgaggaatttgtggcgatgatgaggaaaggaactacagattcagatccaaagctgatcagatgatatatattcaactacagtgacgaatgcttttgcttcatatataataattaaaataaactaataataaacacgaatncaatgagaattaatgcattcctatgttttttcccttnagatgtataaataataaatatgatgnattgcgc

SEQ ID NO: 2260 - protein, 1610 aa, Arabidopsis thaliana
  misc_feature: PFam Name: Pkinase; PFam Description: Protein kinase domain
  misc_feature: GI Number: 6721111; NR Description: T4O12.25 [Arabidopsis thaliana]
  misc_feature: GI Number: 42572119; NR Description: calcium-dependent
  misc_feature: GI Number: 18175903; NR Description: putative
  misc_feature: GI Number: 39546555; NR Description: calcium-dependent
  misc_feature: GI Number: 15239716; NR Description: calcium-dependent
TCCAATCCTCAGCCCAAACCCAAACCCGCTCCTCCTCCTCCTCCGTCAACATCCTCCGGTTCACAAATCGGTCCAATCCTAAACCGACCAATGATCGATCTCTCAGCTCTCTACGACCTCCACAAAGAACTCGGCCGTGGCCAATTCGGAATCACTTACAAATGCACGGACAAATCCAACGGTCGAGAATACGCCTGCAAATCCATCTCAAAACGTAAACTCATACGTCGCAAAGACATCGAAGACGTGAGACGTGAGGTCATGATCTTGCAACACCTTACTGGTCAACCAAACATAGTCGAGTTTCGAGGCGCGTATGAAGACAAAGACAATCTTCATTTGGTTATGGAGCTCTGTTCTGGAGGAGAGCTTTTTGATCGTATTATCAAGAAAGGAAGTTACTCTGAGAAAGAAGCTGCTAATATCTTCAGACAGATCGTTAATGTTGTTCATGTTTGTCACTTCATGGGCGTTGTTCATAGAGACTTAAAGCCTGAGAATTTCTTGCTTGTTAGTAACGAAGAAGATTCTCCAATCAAAGCAACAGATTTTGGACTCTCTGTTTTCATCGAAGAAGGTAAAGTGTATAGAGATATAGTTGGGAGCGCATACTACGTTGCACCTGAAGTTCTACATCGAAACTACGGGAAAGAAATCGATGTATGGAGCGCGGGTGTTATGCTTTACATTCTTCTCAGTGGTGTTCCTCCATTTTGGGGAGAGACCGAGAAGACTATATTTGAGGCGATCTTAGAAGGAAAGCTGGATCTTGAAACTTCTCCTTGGCCTACTATATCGGAAAGCGCAAAAGATTTGATAAGAAAGATGTTGATAAGAGATCCTAAAAAAAGGATAACCGCAGCTGAAGCACTTGAGCATCCATGGATGACAGACACCAAAATTTCTGATAAACCAATCAATAGTGCTGTTCTTGTTAGGATGAAGCAATTCCGCGCGATGAACAAGCTCAAGAAACTTGCCTTGAAGGTGATAGCGGAAAACTTATCGGAAGAAGAGATAAAAGGATTAAAGCAAACGTTTAAGAACATGGATACAGATGAAAGTGGCACCATCACTTTTGATGAACTAAGAAACGGGTTACATCGTCTTGGATCTAAGCTTACGGAGTCTGAAATCAAACAACTCATGGAAGCTGCTGATGTGGACAAAAGTGGGACGATTGATTACATTGAGTTTGTAACTGCAACAATGCATCGTCATAGATTGGAGAAAGAAGAGAATTTGATAGAAGCATTTAAATACTTCGACAAAGACAGAAGCGGTTTTATCACAAGGGACGAGCTTAAACACTCCATGACTGAGTATGGCATGGGTGATGATGCGACCATAGATGAAGTTATCAATGATGTTGATACCGACAATGATGGGAGGATAAACTACGAGGAATTTGTGGCGATGATGAGGAAAGGAACTACAGATTCAGATCCAAAGCTGATCAGATGATATATATTCAACTACAGTGACGAATGCTTTTGCTTCATATATAATAATTAAAATAAACTAATAATAAACACGAATNCAATGAGAATTAATGCATTCCTATGTTTTTTCCCTTNAGATGTATAAATAATAAATATGATGNATTGCGC

SEQ ID NO: 2261 - DNA, 3250 bp, Arabidopsis thaliana
  misc_feature (1)..(3250): Ceres cDNA ID no. 13509447
  misc_feature (1)..(3250): Ceres CLONE  ID no. 1010669
  misc_feature (1)..(3250): Also known as  Ceres CDNA ID no. 23431748
aaaacaaaaattacacaaaaatcaaaacttttactttttatttctcctctctggatcttcctcttcaaagctcaaggccattagggtttatctgagctccaaaatcaccctaattctagtgtatttctcagcaagcaagcttcttctttttttgtcctgggtaactgtgattgttgcaggatcttgtgtagaaacagatcacaagaagatgaatgataactcggtggtgcggctttgattatcttcagagattttagattctgtatccactctgttgcgatggggtcgtttgcaggcgcttgtgagattgtggaagagaaggatgatgaagtaagattgccaaaacattccgggagatatggtaaatcggttatgggatcatcaagtaaggatttggtggagcgtaagcaacgagagtatcatggttctcttgagtatgacattgatatgctttttcagtctatttctgttaaaccatctactacgaggttgatgagttcttctttccatcatcatgagacgagcgcgagtgccggtccaagcaggaccacaagcccttcgaagagaattgcgtccatgaaaaaaccagggacacctcagtctcctagatttgttggtctctctgattcagtttctttgaagcaggctcttagggatcgttgcatttctaaggcgtcggaaatggctgctcagaaacggttgtcgaaatctgctgctgcatctccgagggtctcagaagctgacaggataaagagtttgtataaccaagtttcgaatgaatctactagcagcaggtctgggcttgttcctgtggacaagggtaaaggaagtttggttgagatacctttgatgcctgtaaacgataaaccaagctcttcaaagagcgtacctcaacggtttgaagatccttctaaccccatttctgagccatctcaagctggaaccagttttggattacaaggagtggggaatcaaacgcgggagattaagctgttgcatagatccaacaaacctgggtcttgtcttagttctggcagtggagattatgagatagagttagatgaaaatgttgcgtctccttccactcatgcatttgttgaagatgatgtgatagaaatagacaaacacgttacttcactgccatctcactctagcaagaaagtcaatgcgacggagcttgacaagaatatttcctcatctgctgtagactcagagcagaaagggaagttggatgatgcacctaattcagggacagagaatggcaaaacagtacggaaggtaacaagaatgattccacgtcccaaacaaccgaaaaagaaaattttgcttaagaagaagttaaaaatcggggttgtgtcagcaacttacccaacaaaagacgatgaagaaattgttccttccttggactctagtgccaatcaacttctctgccagagatgtcactgttcgttgaagagcaccagcatcgatgacaacccaccttcatatacttctagtcataatcctaagatttgcacagatagtttgagctctgtttcaaataaagaagctcatcaaggatctgacgagaactcctctggctcgtgtaatgtcagtcaaagctctgaagctgacattgtcataatgaaacaagatgtttcctctagcaataatagtggaatcggtgcaatggtagaaaaagaaaccgagaatccgacttccagtgagaaattcgagttctctctgagttcaaaagatagtcttggggattatagcaggagcacaagcattagtgaggagagtaatctgagccgatttagctgtgggaataagcctcacatgtcgatggatgtgagatgggaagcgattaagcatatcaaggttcaatacggctctttgggtttacgacacttcaaccttctgaagaaacttggttgtggagatataggaacagtctatctcgccgagctgattggtacaaactgtttgtttgccataaaggttatggacaacgagttcttggcgagaaggaaaaagtctccccgggcacaagcagaaagagaaatacttaaaatgttggaccatccttttcttcctacattatacgcgcaatttacttcggataatttatcttgtctagtcatggaatattgtcctggaggagatcttcatgtcctcagacagaagcagctaggccggtgtttccctgaacctgcagcaagattctatgtggccgaaattctccttgcactggagtacttacacatgcttggtatcatataccgagatctgaaaccggaaaacattcttgtccgtgaagatggacacattatgcttacggattttgacctctcactccgttgtgcagtgaacccgactcttgtcaggtcaaactctccacctggtaaagatcccgcaaggatttcaggtccatacaacacatccaactgcatacaaccattctgtatcaccgaaccatcttgccaggtttcgtgtttcagccctaggctctcctcaaaccaacaacaaggtagaaaaccaaaaaggggtgatcatctttcgaaaacccaacaacacttgagtagatcattgcctcagctcgtggctgaaccaaccgaagcaagatccaattcctttgtgggaacacacgagtacctagccccagagatcatcaaaggagaaggacatggcgctgcagttgactggtggactttcggggttctcctttacgagcttttatacgggaaaacaccattcaaaggttacaacaacgacgagactttggccaatgttgtgttacagaacctcaagtttcctgatagcccgcttgtaagcttccaggcaaaagacttgatcaggggacttcttgttaaggaaccagagaacaggctcgggtcagagaaaggttctgtagagatcaaaagacatcctttttttgaaggattgaattgggctctgatccggtgtgcaatcccgcctgagctaccggatttctatgagtatggtggtggaccagaggcagcggcggattcgcctggaggcagtaataataggtatcttgaatgtaaagccataggcgatcatcttgagttcgagttgttttaagcaagacatagatattctctggtataagcattcagagtaatcgttgttgtaagttattatatctaagttaaatctaaatgtcttatatgtaaatttagcgttctctgagacataatctcatatagtattctcaaaaatatatatgctccttcgtatctcaattttt

SEQ ID NO: 2262 - protein, 3250 aa, Arabidopsis thaliana
  misc_feature: PFam Name: Pkinase; PFam Description: Protein kinase domain
  misc_feature: GI Number: 19310387; NR Description: At2g44830/T13E15.16
  misc_feature: GI Number: 125568; NR Description: Protein kinase PVPK-1 >gi|100013|pir||A30311 protein kinase C (EC 2.7.1.-) homolog -
  misc_feature: GI Number: 20259910; NR Description: protein kinase 5 [Arabidopsis thaliana] >gi|17064850|gb|AAL32579.1| protein kinase 5
  misc_feature: GI Number: 7716430; NR Description: protein kinase KIPK
  misc_feature: GI Number: 30689844; NR Description: protein kinase, putative
AAAACAAAAATTACACAAAAATCAAAACTTTTACTTTTTATTTCTCCTCTCTGGATCTTCCTCTTCAAAGCTCAAGGCCATTAGGGTTTATCTGAGCTCCAAAATCACCCTAATTCTAGTGTATTTCTCAGCAAGCAAGCTTCTTCTTTTTTTGTCCTGGGTAACTGTGATTGTTGCAGGATCTTGTGTAGAAACAGATCACAAGAAGATGAATGATAACTCGGTGGTGCGGCTTTGATTATCTTCAGAGATTTTAGATTCTGTATCCACTCTGTTGCGATGGGGTCGTTTGCAGGCGCTTGTGAGATTGTGGAAGAGAAGGATGATGAAGTAAGATTGCCAAAACATTCCGGGAGATATGGTAAATCGGTTATGGGATCATCAAGTAAGGATTTGGTGGAGCGTAAGCAACGAGAGTATCATGGTTCTCTTGAGTATGACATTGATATGCTTTTTCAGTCTATTTCTGTTAAACCATCTACTACGAGGTTGATGAGTTCTTCTTTCCATCATCATGAGACGAGCGCGAGTGCCGGTCCAAGCAGGACCACAAGCCCTTCGAAGAGAATTGCGTCCATGAAAAAACCAGGGACACCTCAGTCTCCTAGATTTGTTGGTCTCTCTGATTCAGTTTCTTTGAAGCAGGCTCTTAGGGATCGTTGCATTTCTAAGGCGTCGGAAATGGCTGCTCAGAAACGGTTGTCGAAATCTGCTGCTGCATCTCCGAGGGTCTCAGAAGCTGACAGGATAAAGAGTTTGTATAACCAAGTTTCGAATGAATCTACTAGCAGCAGGTCTGGGCTTGTTCCTGTGGACAAGGGTAAAGGAAGTTTGGTTGAGATACCTTTGATGCCTGTAAACGATAAACCAAGCTCTTCAAAGAGCGTACCTCAACGGTTTGAAGATCCTTCTAACCCCATTTCTGAGCCATCTCAAGCTGGAACCAGTTTTGGATTACAAGGAGTGGGGAATCAAACGCGGGAGATTAAGCTGTTGCATAGATCCAACAAACCTGGGTCTTGTCTTAGTTCTGGCAGTGGAGATTATGAGATAGAGTTAGATGAAAATGTTGCGTCTCCTTCCACTCATGCATTTGTTGAAGATGATGTGATAGAAATAGACAAACACGTTACTTCACTGCCATCTCACTCTAGCAAGAAAGTCAATGCGACGGAGCTTGACAAGAATATTTCCTCATCTGCTGTAGACTCAGAGCAGAAAGGGAAGTTGGATGATGCACCTAATTCAGGGACAGAGAATGGCAAAACAGTACGGAAGGTAACAAGAATGATTCCACGTCCCAAACAACCGAAAAAGAAAATTTTGCTTAAGAAGAAGTTAAAAATCGGGGTTGTGTCAGCAACTTACCCAACAAAAGACGATGAAGAAATTGTTCCTTCCTTGGACTCTAGTGCCAATCAACTTCTCTGCCAGAGATGTCACTGTTCGTTGAAGAGCACCAGCATCGATGACAACCCACCTTCATATACTTCTAGTCATAATCCTAAGATTTGCACAGATAGTTTGAGCTCTGTTTCAAATAAAGAAGCTCATCAAGGATCTGACGAGAACTCCTCTGGCTCGTGTAATGTCAGTCAAAGCTCTGAAGCTGACATTGTCATAATGAAACAAGATGTTTCCTCTAGCAATAATAGTGGAATCGGTGCAATGGTAGAAAAAGAAACCGAGAATCCGACTTCCAGTGAGAAATTCGAGTTCTCTCTGAGTTCAAAAGATAGTCTTGGGGATTATAGCAGGAGCACAAGCATTAGTGAGGAGAGTAATCTGAGCCGATTTAGCTGTGGGAATAAGCCTCACATGTCGATGGATGTGAGATGGGAAGCGATTAAGCATATCAAGGTTCAATACGGCTCTTTGGGTTTACGACACTTCAACCTTCTGAAGAAACTTGGTTGTGGAGATATAGGAACAGTCTATCTCGCCGAGCTGATTGGTACAAACTGTTTGTTTGCCATAAAGGTTATGGACAACGAGTTCTTGGCGAGAAGGAAAAAGTCTCCCCGGGCACAAGCAGAAAGAGAAATACTTAAAATGTTGGACCATCCTTTTCTTCCTACATTATACGCGCAATTTACTTCGGATAATTTATCTTGTCTAGTCATGGAATATTGTCCTGGAGGAGATCTTCATGTCCTCAGACAGAAGCAGCTAGGCCGGTGTTTCCCTGAACCTGCAGCAAGATTCTATGTGGCCGAAATTCTCCTTGCACTGGAGTACTTACACATGCTTGGTATCATATACCGAGATCTGAAACCGGAAAACATTCTTGTCCGTGAAGATGGACACATTATGCTTACGGATTTTGACCTCTCACTCCGTTGTGCAGTGAACCCGACTCTTGTCAGGTCAAACTCTCCACCTGGTAAAGATCCCGCAAGGATTTCAGGTCCATACAACACATCCAACTGCATACAACCATTCTGTATCACCGAACCATCTTGCCAGGTTTCGTGTTTCAGCCCTAGGCTCTCCTCAAACCAACAACAAGGTAGAAAACCAAAAAGGGGTGATCATCTTTCGAAAACCCAACAACACTTGAGTAGATCATTGCCTCAGCTCGTGGCTGAACCAACCGAAGCAAGATCCAATTCCTTTGTGGGAACACACGAGTACCTAGCCCCAGAGATCATCAAAGGAGAAGGACATGGCGCTGCAGTTGACTGGTGGACTTTCGGGGTTCTCCTTTACGAGCTTTTATACGGGAAAACACCATTCAAAGGTTACAACAACGACGAGACTTTGGCCAATGTTGTGTTACAGAACCTCAAGTTTCCTGATAGCCCGCTTGTAAGCTTCCAGGCAAAAGACTTGATCAGGGGACTTCTTGTTAAGGAACCAGAGAACAGGCTCGGGTCAGAGAAAGGTTCTGTAGAGATCAAAAGACATCCTTTTTTTGAAGGATTGAATTGGGCTCTGATCCGGTGTGCAATCCCGCCTGAGCTACCGGATTTCTATGAGTATGGTGGTGGACCAGAGGCAGCGGCGGATTCGCCTGGAGGCAGTAATAATAGGTATCTTGAATGTAAAGCCATAGGCGATCATCTTGAGTTCGAGTTGTTTTAAGCAAGACATAGATATTCTCTGGTATAAGCATTCAGAGTAATCGTTGTTGTAAGTTATTATATCTAAGTTAAATCTAAATGTCTTATATGTAAATTTAGCGTTCTCTGAGACATAATCTCATATAGTATTCTCAAAAATATATATGCTCCTTCGTATCTCAATTTTT

SEQ ID NO: 2263 - DNA, 1601 bp, Arabidopsis thaliana
  misc_feature (1)..(1601): Ceres cDNA ID no. 13509486
  misc_feature (1)..(1601): Ceres CLONE  ID no. 1011422
  misc_feature (1)..(1601): Also known as  Ceres CDNA ID no. 23431807
aagaagaagaaataggagaagccaagagcaaatctaattctctgactactctcattttcatgtcggagacttgccgaaatctaaagaatttcttcaacggagactgaaaagctttctcttttcttctttcgttatcttcgttttagtgttttcccctttgcttacatttgaagaaatcgagagcaagcgatagaaagtgagagagagagatgtatgtggtgacgcctcctcaaagatccggttttggatccgattgtgatttacgggtttaccaaacatggaaaggaagcaatatattttgtcttcaaggaaggtttatcttcgggccggatgtaagatcacttggtctgaccataagtcttattgtggcacctgttacaattttctgcatcttcgtcgctagcaaactaatggatgacttctctgatagttggggagtctcaataatccttgttgctgttgtcttcaccatttatgatttgattttgctgatgcttacatccggaagagatccagggattatcccaagaaattctcatcctccagaaccagaagttgttgatggcaacacgggctcgggaacaagccaaactccaagattgcctcgtgttaaagaagtggaagttaatggaaaagtattcaaggtcaagtactgtgatacttgcatgctctatagaccgcctcgctgctcacattgttcgatttgcaacaactgtgtagaaaggtttgaccatcactgtccttgggttggtcaatgtattgctcaaagaaactatcgattcttcttcatgtttgtcttctccacgactcttctctgtgtatatgtgttcgccttttgttgtgtctacataaagaagatcaaagagtccgaagatataagtatcttgaaagcaatgctcaaaactccagcttccattgctctgatactctacacattcatatctacattcttcgttggaggcttaacatgtttccatctctatctcatcagcacaaatcagactacatatgagaatttcagatacagttatgatcggcatagcaacccacataacaaaggagtggttgataacttcaaagaaatctttttttctccaatacctccttcaaagaacaacttcagggctatggtaccaagggaaaatccaatgccgtcgagatcagttgttggcggttttatgagtccaaacatgggaaaggccaatgatgatattgaaatggggaggaagggtgtttgggcaatggctgaacatggtgatggcaaagatggcaataacaatgaacggtttcatgttaacgacaatgagttaaacgagttatcaccagacatggggaacatagtgaatggtgatgagcaaatcaataggccaaacaatcacccgaggaacgcaaactgggaaatgtcaccagaagttatggccttatcagcaagaagagcttagaagcaggttaagagaaaattgaaaggtgttttaaatgtttgatgtattgatgtgttgtgtgtttacacgggaatcaattgtgaattggtgtgatattttcagatgttatgagtatttttagttgttcttcagacatttaaatcgtaaatcattgtgtgt

SEQ ID NO: 2264 - protein, 1601 aa, Arabidopsis thaliana
  misc_feature: PFam Name: zf-DHHC; PFam Description: DHHC zinc finger domain
  misc_feature: GI Number: 30688566; NR Description: zinc finger (DHHC type)
  misc_feature: GI Number: 50947995; NR Description: putative DHHC-type zinc finger domain-containing protein [Oryza sativa (japonica cultivar-group)] >gi|38175527|dbj|BAD01220.1| putative DHHC-type zinc finger domain-containing protein [Oryza sativa (japonica
  misc_feature: GI Number: 57900122; NR Description: putative zisp [Oryza sativa (japonica cultivar-group)] gi|57899394|dbj|BAD88041.1|
  misc_feature: GI Number: 30693084; NR Description: zinc finger (DHHC type)
  misc_feature: GI Number: 50948057; NR Description: putative DHHC-type zinc finger domain-containing protein [Oryza sativa (japonica cultivar-group)] >gi|50725676|dbj|BAD33142.1| putative DHHC-type zinc finger domain-containing protein [Oryza sativa (japonica
AAGAAGAAGAAATAGGAGAAGCCAAGAGCAAATCTAATTCTCTGACTACTCTCATTTTCATGTCGGAGACTTGCCGAAATCTAAAGAATTTCTTCAACGGAGACTGAAAAGCTTTCTCTTTTCTTCTTTCGTTATCTTCGTTTTAGTGTTTTCCCCTTTGCTTACATTTGAAGAAATCGAGAGCAAGCGATAGAAAGTGAGAGAGAGAGATGTATGTGGTGACGCCTCCTCAAAGATCCGGTTTTGGATCCGATTGTGATTTACGGGTTTACCAAACATGGAAAGGAAGCAATATATTTTGTCTTCAAGGAAGGTTTATCTTCGGGCCGGATGTAAGATCACTTGGTCTGACCATAAGTCTTATTGTGGCACCTGTTACAATTTTCTGCATCTTCGTCGCTAGCAAACTAATGGATGACTTCTCTGATAGTTGGGGAGTCTCAATAATCCTTGTTGCTGTTGTCTTCACCATTTATGATTTGATTTTGCTGATGCTTACATCCGGAAGAGATCCAGGGATTATCCCAAGAAATTCTCATCCTCCAGAACCAGAAGTTGTTGATGGCAACACGGGCTCGGGAACAAGCCAAACTCCAAGATTGCCTCGTGTTAAAGAAGTGGAAGTTAATGGAAAAGTATTCAAGGTCAAGTACTGTGATACTTGCATGCTCTATAGACCGCCTCGCTGCTCACATTGTTCGATTTGCAACAACTGTGTAGAAAGGTTTGACCATCACTGTCCTTGGGTTGGTCAATGTATTGCTCAAAGAAACTATCGATTCTTCTTCATGTTTGTCTTCTCCACGACTCTTCTCTGTGTATATGTGTTCGCCTTTTGTTGTGTCTACATAAAGAAGATCAAAGAGTCCGAAGATATAAGTATCTTGAAAGCAATGCTCAAAACTCCAGCTTCCATTGCTCTGATACTCTACACATTCATATCTACATTCTTCGTTGGAGGCTTAACATGTTTCCATCTCTATCTCATCAGCACAAATCAGACTACATATGAGAATTTCAGATACAGTTATGATCGGCATAGCAACCCACATAACAAAGGAGTGGTTGATAACTTCAAAGAAATCTTTTTTTCTCCAATACCTCCTTCAAAGAACAACTTCAGGGCTATGGTACCAAGGGAAAATCCAATGCCGTCGAGATCAGTTGTTGGCGGTTTTATGAGTCCAAACATGGGAAAGGCCAATGATGATATTGAAATGGGGAGGAAGGGTGTTTGGGCAATGGCTGAACATGGTGATGGCAAAGATGGCAATAACAATGAACGGTTTCATGTTAACGACAATGAGTTAAACGAGTTATCACCAGACATGGGGAACATAGTGAATGGTGATGAGCAAATCAATAGGCCAAACAATCACCCGAGGAACGCAAACTGGGAAATGTCACCAGAAGTTATGGCCTTATCAGCAAGAAGAGCTTAGAAGCAGGTTAAGAGAAAATTGAAAGGTGTTTTAAATGTTTGATGTATTGATGTGTTGTGTGTTTACACGGGAATCAATTGTGAATTGGTGTGATATTTTCAGATGTTATGAGTATTTTTAGTTGTTCTTCAGACATTTAAATCGTAAATCATTGTGTGT

SEQ ID NO: 2265 - DNA, 1868 bp, Arabidopsis thaliana
  misc_feature (1)..(1868): Ceres cDNA ID no. 13509820
  misc_feature (1)..(1868): Ceres CLONE  ID no. 1015036
  misc_feature (1)..(1868): Also known as  Ceres CDNA ID no. 23432242
agattctccatcttagttcttgtaacctctccctcttcttctccaaattccacctgagagaagagaactcattccacccaaaaagcaataatatatagtaccgtactttgattttttcgataatctgttgattgaagttaagccaaaactcagctctgttcttattcttcttcaaacccaagtttcccacttcactgattctttcatcttagctcgttttaaccacaaagttcagttcttttttggtgtgtttctttttcgttattggcttttgccttttttgggtatagggtgtttacgatttatctctcggttccgatgttgttcaaaggtgtttttgctgtctttttcgtaatcactttgttgtacgcaagtttgttaattgaagttgaagggattggtgtgaactggggctcacaggcgaggcatcccctacctccggctacggtggtgaggcttctccgagaaaacggtatccaaaaggtgaaacttttcgaggccgactctgcgattctcaaagctttaagtcggacagggattcaagttatggtcggaatccctaacgacttgcttgctcctttagccggtagcgttgcagccgctgagagatgggtctctcagaatgtatctgctcatgtctcctctaatggcgtcgatatcaggtatgtggcagttgggaatgagccttttctaaaagcattcaatggaacatttgagggtataactctacctgctcttcagaatatacaatcagctatcatcaaagctggtttagcgactcaggtgaaagtcacagtgcctcttaacgcagatgtgtaccaaagtgcgtctaatctcccttcggatggagatttcaggcctgaaatccgtgatctcatgttgaacattgttaagtttctgagtgataacggagcaccattcactatcaacatttaccctttcatcagtctctacaacgacccgaatttccctgtggagtttgctttctttgatggaactggtactccgataaacgacaatggaagaatctacgacaatgttcttgatgcaaactacgatacacttgtgtggtcgttgcagaagaatgggtttgggaatttgactattattgttggggaagttgggtggccaacagatggagataagaacgcaaacttgatgtatgccaggcggtataatcaaggttttatgaaccgtcaaaaggctaataaaggaacacctatgagacctggggcaatggatgcttacttgtttggtcttatcgatgaagatgccaaaagcattcagcctggaaactttgaaagacactgggggatattttatattgatggacagcctaagtatcagctcagtcttggcagtggtaacgggctgatccctgcaaaggatgttcattatttggctaagaaatggtgtattcttgcgccaaatgctaatcttcaggatcctcagttgggaccaagcgtgagctacgcttgtgatcatgctgattgcaccagtcttggttatggctcctcttgtggtaacctgaatctagcacagaatgtttcgtatgcgttcaatagctattaccaggtaagtaatcagctcgacagtgcgtgtaagttcccgggtctctctatagtcagtactagggatccttctgttgggagttgcaaattcaagataatgatcaagtcagaagatgctagtgaagcaagtgccatgatgcctataacacgatcaacggcagtgctgctacttctctccatctgtctgtatattgttctgtgaatactgaagaaaatttgatgggtttgattatttctttttttccttttttcttttgcaaaacttttggtgtttatggagaaacagaaaagttttgc

SEQ ID NO: 2266 - protein, 1868 aa, Arabidopsis thaliana
  misc_feature: PFam Name: Glyco_hydro_17; PFam Description: Glycosyl
  misc_feature: PFam Name: X8; PFam Description: X8 domain
  misc_feature: GI Number: 7270016; NR Description: 1, 3-beta-glucanase-like protein [Arabidopsis thaliana] >gi|38257777|sp|Q9M088|E135_ARATH Putative glucan endo-1,3-beta-glucosidase 5 precursor ((1->3)-beta-glucan endohydrolase) ((1->3)-beta-glucanase)
  misc_feature: GI Number: 23308419; NR Description: At5g58090/k21l19_70 [Arabidopsis thaliana] >gi|16604491|gb|AAL24251.1|
  misc_feature: GI Number: 9759535; NR Description: glucanase; glucan endo-1,3-beta-glucosidase [Arabidopsis thaliana] >gi|38257732|sp|Q93Z08|E136_ARATH Putative glucan endo-1,3-beta-glucosidase 6 precursor ((1->3)-beta-glucan
  misc_feature: GI Number: 15242078; NR Description: glycosyl hydrolase
  misc_feature: GI Number: 50921029; NR Description: putative 1,3-beta-glucanase [Oryza sativa (japonica cultivar-group)] >gi|30017525|gb|AAP12947.1| putative 1,3-beta-glucanase [Oryza
AGATTCTCCATCTTAGTTCTTGTAACCTCTCCCTCTTCTTCTCCAAATTCCACCTGAGAGAAGAGAACTCATTCCACCCAAAAAGCAATAATATATAGTACCGTACTTTGATTTTTTCGATAATCTGTTGATTGAAGTTAAGCCAAAACTCAGCTCTGTTCTTATTCTTCTTCAAACCCAAGTTTCCCACTTCACTGATTCTTTCATCTTAGCTCGTTTTAACCACAAAGTTCAGTTCTTTTTTGGTGTGTTTCTTTTTCGTTATTGGCTTTTGCCTTTTTTGGGTATAGGGTGTTTACGATTTATCTCTCGGTTCCGATGTTGTTCAAAGGTGTTTTTGCTGTCTTTTTCGTAATCACTTTGTTGTACGCAAGTTTGTTAATTGAAGTTGAAGGGATTGGTGTGAACTGGGGCTCACAGGCGAGGCATCCCCTACCTCCGGCTACGGTGGTGAGGCTTCTCCGAGAAAACGGTATCCAAAAGGTGAAACTTTTCGAGGCCGACTCTGCGATTCTCAAAGCTTTAAGTCGGACAGGGATTCAAGTTATGGTCGGAATCCCTAACGACTTGCTTGCTCCTTTAGCCGGTAGCGTTGCAGCCGCTGAGAGATGGGTCTCTCAGAATGTATCTGCTCATGTCTCCTCTAATGGCGTCGATATCAGGTATGTGGCAGTTGGGAATGAGCCTTTTCTAAAAGCATTCAATGGAACATTTGAGGGTATAACTCTACCTGCTCTTCAGAATATACAATCAGCTATCATCAAAGCTGGTTTAGCGACTCAGGTGAAAGTCACAGTGCCTCTTAACGCAGATGTGTACCAAAGTGCGTCTAATCTCCCTTCGGATGGAGATTTCAGGCCTGAAATCCGTGATCTCATGTTGAACATTGTTAAGTTTCTGAGTGATAACGGAGCACCATTCACTATCAACATTTACCCTTTCATCAGTCTCTACAACGACCCGAATTTCCCTGTGGAGTTTGCTTTCTTTGATGGAACTGGTACTCCGATAAACGACAATGGAAGAATCTACGACAATGTTCTTGATGCAAACTACGATACACTTGTGTGGTCGTTGCAGAAGAATGGGTTTGGGAATTTGACTATTATTGTTGGGGAAGTTGGGTGGCCAACAGATGGAGATAAGAACGCAAACTTGATGTATGCCAGGCGGTATAATCAAGGTTTTATGAACCGTCAAAAGGCTAATAAAGGAACACCTATGAGACCTGGGGCAATGGATGCTTACTTGTTTGGTCTTATCGATGAAGATGCCAAAAGCATTCAGCCTGGAAACTTTGAAAGACACTGGGGGATATTTTATATTGATGGACAGCCTAAGTATCAGCTCAGTCTTGGCAGTGGTAACGGGCTGATCCCTGCAAAGGATGTTCATTATTTGGCTAAGAAATGGTGTATTCTTGCGCCAAATGCTAATCTTCAGGATCCTCAGTTGGGACCAAGCGTGAGCTACGCTTGTGATCATGCTGATTGCACCAGTCTTGGTTATGGCTCCTCTTGTGGTAACCTGAATCTAGCACAGAATGTTTCGTATGCGTTCAATAGCTATTACCAGGTAAGTAATCAGCTCGACAGTGCGTGTAAGTTCCCGGGTCTCTCTATAGTCAGTACTAGGGATCCTTCTGTTGGGAGTTGCAAATTCAAGATAATGATCAAGTCAGAAGATGCTAGTGAAGCAAGTGCCATGATGCCTATAACACGATCAACGGCAGTGCTGCTACTTCTCTCCATCTGTCTGTATATTGTTCTGTGAATACTGAAGAAAATTTGATGGGTTTGATTATTTCTTTTTTTCCTTTTTTCTTTTGCAAAACTTTTGGTGTTTATGGAGAAACAGAAAAGTTTTGC

SEQ ID NO: 2267 - DNA, 1157 bp, Arabidopsis thaliana
  misc_feature (1)..(1157): Ceres cDNA ID no. 13509895
  misc_feature (1)..(1157): Ceres CLONE  ID no. 103565
  misc_feature (1)..(1157): Also known as  Ceres CDNA ID no. 13509895
ctctctacaacatggaagaagacagagcgattctcacttttcaccgtatcccttccctcaattcctccttaataacaacctcttctccggccaaatccggcgccgaacagtttcgccgccgtgttctgcgaaatccagctcgcggagatttcggtttaggtagattcgcgtgcatttcactcgtggagaagtgcgaacagagagaattcgctccgacgacagctcagctcttgaacaatcctctagctattcttgctcttgtccctaaggatgcagctatttttgccgccggtgctcttgccggagccgccgctaaaactgttactgctcctcttgaccgtatcaaacttcttatgcagacacatggtataagacttggacaacagagtgcgaagaaggcgataggatttatcgaggcaatcactttgatagctaaagaagaaggagttaaaggttattggaaaggaaatttacctcaggtgataagagtgttaccttacagtgcggtccagcttttggcttatgagagttacaagaacttgttcaaaggtaaagatgatcagctctcagtaatcggaagacttgcagctggtgcttgtgctggcatgacatctactttgttgacataccctctagatgttttgagattgaggttggctgtcgaacctaggtatcgaacaatgtctcaggttgctttgagtatgctccgtgatgaaggaatcgcatctttctattacggtctaggaccttctctagtggggatagctccatatattgctgtaaacttttgtattttcgatctggtgaagaagtctttaccggaggaatatagaaagaaggcacaatcgtctctattaacagctgttctctcagctggtattgcaacactgacatgttaccctctagacactgtgagacggcaaatgcaaatgagaggaactccatacaaatcaattccggaggcatttgctggaattatagaccgtgatgggcttataggcttgtaccgcggctttttacccaatgcattgaaaactctaccaaacagcagtattaggcttacaaccttcgacatggtaaagcgccttatcgccacaagtgagaagcagcttcaaaagatcagcgatgataatcggaatcgagaccaagctcaataa

SEQ ID NO: 2268 - protein, 1157 aa, Arabidopsis thaliana
CTCTCTACAACATGGAAGAAGACAGAGCGATTCTCACTTTTCACCGTATCCCTTCCCTCAATTCCTCCTTAATAACAACCTCTTCTCCGGCCAAATCCGGCGCCGAACAGTTTCGCCGCCGTGTTCTGCGAAATCCAGCTCGCGGAGATTTCGGTTTAGGTAGATTCGCGTGCATTTCACTCGTGGAGAAGTGCGAACAGAGAGAATTCGCTCCGACGACAGCTCAGCTCTTGAACAATCCTCTAGCTATTCTTGCTCTTGTCCCTAAGGATGCAGCTATTTTTGCCGCCGGTGCTCTTGCCGGAGCCGCCGCTAAAACTGTTACTGCTCCTCTTGACCGTATCAAACTTCTTATGCAGACACATGGTATAAGACTTGGACAACAGAGTGCGAAGAAGGCGATAGGATTTATCGAGGCAATCACTTTGATAGCTAAAGAAGAAGGAGTTAAAGGTTATTGGAAAGGAAATTTACCTCAGGTGATAAGAGTGTTACCTTACAGTGCGGTCCAGCTTTTGGCTTATGAGAGTTACAAGAACTTGTTCAAAGGTAAAGATGATCAGCTCTCAGTAATCGGAAGACTTGCAGCTGGTGCTTGTGCTGGCATGACATCTACTTTGTTGACATACCCTCTAGATGTTTTGAGATTGAGGTTGGCTGTCGAACCTAGGTATCGAACAATGTCTCAGGTTGCTTTGAGTATGCTCCGTGATGAAGGAATCGCATCTTTCTATTACGGTCTAGGACCTTCTCTAGTGGGGATAGCTCCATATATTGCTGTAAACTTTTGTATTTTCGATCTGGTGAAGAAGTCTTTACCGGAGGAATATAGAAAGAAGGCACAATCGTCTCTATTAACAGCTGTTCTCTCAGCTGGTATTGCAACACTGACATGTTACCCTCTAGACACTGTGAGACGGCAAATGCAAATGAGAGGAACTCCATACAAATCAATTCCGGAGGCATTTGCTGGAATTATAGACCGTGATGGGCTTATAGGCTTGTACCGCGGCTTTTTACCCAATGCATTGAAAACTCTACCAAACAGCAGTATTAGGCTTACAACCTTCGACATGGTAAAGCGCCTTATCGCCACAAGTGAGAAGCAGCTTCAAAAGATCAGCGATGATAATCGGAATCGAGACCAAGCTCAATAA

SEQ ID NO: 2269 - DNA, 1320 bp, Zea mays
  misc_feature (1)..(1320): Ceres cDNA ID no. 13566844
  misc_feature (1)..(1320): Ceres CLONE  ID no. 239015
  misc_feature (1)..(1320): Also known as  Ceres CDNA ID no. 23767430
atccctcctaccacatccgttccccttcccttccctcctctcgcgcgccggctccacgcagatccaggagatatgcctcgctatgatgaccgctatggaggcacgcgcttgtatgttggcagattggccactcgtactcgttcccgcgatttagaacatctgtttggcagatatggaagaatacgagaagtggagttgaagcgtgactatgcatttattgagttcagtgatcatcgcgatgctgatgaggctcgataccagctagatggcagggatgttgatgggagtcgtattgttgttgagtctgctaaaggggtcccacgtggttcaggtggctcacgtgaatatatggggagaggccctccaccaggtacaggtcgttgtttcaactgtggagttgatggtcactgggcaagagactgtaaagctggtgactggaaaaacaaatgctaccgttgtggagaaaggggccatatagaaagaaattgccagaacagtcctaggagtctcaggcgagagagaagttactcacggtccccatctccccgccgtggacggggccgcagtcgaagctatggcaggagcaggagccggagtcggagctatagtcgatcaagatccctgtctagatctcctaggggaggtcgtcgtgaccgtgacgataggagatcaaggagtcctagctatagcaggagccccatgcgatctgcctcgccaccagtaaaggaaaaggagcgcagccccgcacctgatggaagcaggagcccaaggagtcgcagcccccaggatcaggtgatgagcccaccaccaaaggataatggcgaaggcaatggctcagaccgtggcggcagccccagagggagggagaacagcaggagctgcagccgcagccgcagtccatctggtagtaaccgcagccctgcggccaatggacgtagccggagtcctggaggtgagcggagcccgagtcctggaggtgagcggagcccgagtcctagaggtgagcggagcccgagtcctagggctgaccgtagcccaagccccaatggcaatggtaacaatgatgctgctgctgatgtcgatgctgatgctgctgcccgcagtggctcccccactggaagcaagtcaccctgagcgctggcggtcccagattgtggtggtgcttctcaatgcaatgggcaatcgtattgctattttttgctaccatatcgaagacacaatagctacatcattttcttctctgaaacaaggactttattttgcttgctttgagatatgactcttaccctctcatggataatatatatatgatatgatgct

SEQ ID NO: 2270 - protein, 1320 aa, Zea mays
  misc_feature: PFam Name: RRM_1; PFam Description: RNA recognition motif.
  misc_feature: PFam Name: zf-CCHC; PFam Description: Zinc knuckle
  misc_feature: PFam Name: Transformer; PFam Description: Fruit fly
  misc_feature: PFam Name: S-antigen; PFam Description: S-antigen protein
  misc_feature: GI Number: 9843663; NR Description: splicing factor RSZ33
  misc_feature: GI Number: 9795142; NR Description: splicing factor-like protein [Arabidopsis thaliana] >gi|30693839|ref|NP_190918.3| zinc
  misc_feature: GI Number: 34895952; NR Description: putative splicing factor-like protein [Oryza sativa (japonica cultivar-group)] >gi|15528625|dbj|BAB64646.1| putative splicing factor-like protein
  misc_feature: GI Number: 11346381; NR Description: splicing factor-like
  misc_feature: GI Number: 24111329; NR Description: At3g53500/F4P12_200 [Arabidopsis thaliana] >gi|20465265|gb|AAM19952.1| AT3g53500/F4P12_200 [Arabidopsis thaliana] >gi|30693836|ref|NP_851015.1| zinc knuckle (CCHC-type) family
ATCCCTCCTACCACATCCGTTCCCCTTCCCTTCCCTCCTCTCGCGCGCCGGCTCCACGCAGATCCAGGAGATATGCCTCGCTATGATGACCGCTATGGAGGCACGCGCTTGTATGTTGGCAGATTGGCCACTCGTACTCGTTCCCGCGATTTAGAACATCTGTTTGGCAGATATGGAAGAATACGAGAAGTGGAGTTGAAGCGTGACTATGCATTTATTGAGTTCAGTGATCATCGCGATGCTGATGAGGCTCGATACCAGCTAGATGGCAGGGATGTTGATGGGAGTCGTATTGTTGTTGAGTCTGCTAAAGGGGTCCCACGTGGTTCAGGTGGCTCACGTGAATATATGGGGAGAGGCCCTCCACCAGGTACAGGTCGTTGTTTCAACTGTGGAGTTGATGGTCACTGGGCAAGAGACTGTAAAGCTGGTGACTGGAAAAACAAATGCTACCGTTGTGGAGAAAGGGGCCATATAGAAAGAAATTGCCAGAACAGTCCTAGGAGTCTCAGGCGAGAGAGAAGTTACTCACGGTCCCCATCTCCCCGCCGTGGACGGGGCCGCAGTCGAAGCTATGGCAGGAGCAGGAGCCGGAGTCGGAGCTATAGTCGATCAAGATCCCTGTCTAGATCTCCTAGGGGAGGTCGTCGTGACCGTGACGATAGGAGATCAAGGAGTCCTAGCTATAGCAGGAGCCCCATGCGATCTGCCTCGCCACCAGTAAAGGAAAAGGAGCGCAGCCCCGCACCTGATGGAAGCAGGAGCCCAAGGAGTCGCAGCCCCCAGGATCAGGTGATGAGCCCACCACCAAAGGATAATGGCGAAGGCAATGGCTCAGACCGTGGCGGCAGCCCCAGAGGGAGGGAGAACAGCAGGAGCTGCAGCCGCAGCCGCAGTCCATCTGGTAGTAACCGCAGCCCTGCGGCCAATGGACGTAGCCGGAGTCCTGGAGGTGAGCGGAGCCCGAGTCCTGGAGGTGAGCGGAGCCCGAGTCCTAGAGGTGAGCGGAGCCCGAGTCCTAGGGCTGACCGTAGCCCAAGCCCCAATGGCAATGGTAACAATGATGCTGCTGCTGATGTCGATGCTGATGCTGCTGCCCGCAGTGGCTCCCCCACTGGAAGCAAGTCACCCTGAGCGCTGGCGGTCCCAGATTGTGGTGGTGCTTCTCAATGCAATGGGCAATCGTATTGCTATTTTTTGCTACCATATCGAAGACACAATAGCTACATCATTTTCTTCTCTGAAACAAGGACTTTATTTTGCTTGCTTTGAGATATGACTCTTACCCTCTCATGGATAATATATATATGATATGATGCT

SEQ ID NO: 2271 - DNA, 516 bp, Zea mays
  misc_feature (1)..(516): Ceres cDNA ID no. 13572614
  misc_feature (1)..(516): Ceres CLONE  ID no. 689654
  misc_feature (1)..(516): Also known as  Ceres CDNA ID no. 23821633
  misc_feature (480)..(480): n is a, c, t, g, unknown, or other
aagctccakgacagyctcagaggcctaacgtcaccgtgaggaactggaacgacaaggactactcggtggtgaccatcagatgcaaggacaggtccaagcttctgttcgacacggtctgcactctgacggacttgcagtacgttgttttccacgcgaacatcgatgccaaggacaatcaggcttaccaggaattctatgtaaggcatgtgaatggatcgccaatgaacactgaaaccgagaggttgcgagtcatccaatgcctggaagcagccatcgaacggagggtatctgagggtgtgaagcttgagctgtgcaccaacgacaaggtcgggctgctatccgaggtcacccgcatcttccgcgagaacagcctgacggttacgagggcggaggtgaccacscggggcaggatggccgtgaacacgttctacgtgcgcggctccgcgggagaggccgtcgaccagaaggcgatcgactccntcagggaggccataggccmcarcctycaggtgaaag

SEQ ID NO: 2272 - protein, 516 aa, Zea mays
  misc_feature: PFam Name: ACT; PFam Description: ACT domain
  misc_feature: GI Number: 34896992; NR Description: putative ACT domain repeat protein [Oryza sativa (japonica cultivar-group)] >gi|28875985|gb|AAO59994.1| putative ACT domain repeat protein
  misc_feature: GI Number: 50916535; NR Description: putative ACT domain containing protein, ACR4, with alternative splicing forms [Oryza sativa (japonica cultivar-group)] >gi|41469088|gb|AAS07062.1|
  misc_feature: GI Number: 50916533; NR Description: putative ACT domain containing protein, ACR4, with alternative splicing forms [Oryza sativa (japonica cultivar-group)] >gi|41469089|gb|AAS07063.1|
  misc_feature: GI Number: 22138098; NR Description: ACR4 [Arabidopsis thaliana] >gi|15221589|ref|NP_177067.1| ACT domain containing
  misc_feature: GI Number: 42572033; NR Description: ACT domain containing
AAGCTCCAKGACAGYCTCAGAGGCCTAACGTCACCGTGAGGAACTGGAACGACAAGGACTACTCGGTGGTGACCATCAGATGCAAGGACAGGTCCAAGCTTCTGTTCGACACGGTCTGCACTCTGACGGACTTGCAGTACGTTGTTTTCCACGCGAACATCGATGCCAAGGACAATCAGGCTTACCAGGAATTCTATGTAAGGCATGTGAATGGATCGCCAATGAACACTGAAACCGAGAGGTTGCGAGTCATCCAATGCCTGGAAGCAGCCATCGAACGGAGGGTATCTGAGGGTGTGAAGCTTGAGCTGTGCACCAACGACAAGGTCGGGCTGCTATCCGAGGTCACCCGCATCTTCCGCGAGAACAGCCTGACGGTTACGAGGGCGGAGGTGACCACSCGGGGCAGGATGGCCGTGAACACGTTCTACGTGCGCGGCTCCGCGGGAGAGGCCGTCGACCAGAAGGCGATCGACTCCNTCAGGGAGGCCATAGGCCMCARCCTYCAGGTGAAAG

SEQ ID NO: 2273 - DNA, 1429 bp, Arabidopsis thaliana
  misc_feature (1)..(1429): Ceres cDNA ID no. 13575008
  misc_feature (1)..(1429): Ceres CLONE  ID no. 105402
  misc_feature (1)..(1429): Also known as  Ceres CDNA ID no. 23446789
attcacatttggtgtctgctgctggctttggtctttctctttctctttctacttttttttggttctgcgatttccatcaaaacccttttcccaacaatcttggttttgtacagagaagaagaagaagaagaaaggcacacaaaataacccatgtctggtttatacaataactcatcttacttctctcctgctcgagctgcttctcctcagattagaagcactcctgagatcgacagctctcagtacttgacggagcttctcgctgaacatcaaaagcttactccttttatgcaggtcctacccatatgtagccgtctattgaatcaagagatgttcagggtctctggaatgatgtctaaccaaggatttggtgattttgatagacttcgacacagaagtcccagccctatggcttcttctaatcttatgtctaatgtctctaataccgggttaggaggctggaacggcctctctcaggagagacttagtggaacacctggaatgacaatggattggcaaggtgcacctggaagccccagttcatacaccgtcaaaaggatattgcgtctggagattcctgtagataactatcctaatttcaattttgttggacgacttctcggccctagaggcaactcgttaaaacgcgttgaagctaccaccggttgccgagtattcatcagagggaaagggtcaatcaaggatcccgaaaaggaagataaattaaggggaagacctggctatgaacacttgaatgagcagcttcacatcttaatagaggcagatcttccagctagtattgtggagatacgtctgcgacaagctcaagaaattatagaagagttactaaagcctgtggacgagtcgcaagatttcataaagagacagcagctgagggaactggcattgctaaactcgaacaacctgagggaagagagtccggggccaagcggaggtggaagcgtttcgcctttcaattcaagtggtaaacgcccgaaaacaggatgctaagtagcgttttgtacgtctcgcccaaaacgctccttcaagccttataatggttacttcaaccaaaagtacatgtctgcatgcattacacagacgcacatgtgtatatctggtttctccagtagtggctgcaatggtggtggtctggtcaaggcctgccctggtctctctcgggtgagcgaccctgtggctttcgtttttcttcttctttattttaaatttttgtttttctttttcctcatcaaaaattcattacagattatttaaaaaagattcatgcaaaaaaaaaaaaaaagagtatgagatatataatatatatagggagaaaaagatgtggtggcttgggagggcgtggactgaaaattcttattgtataaacataaacaaaaaacacatttattggattgattcttatcgtttg

SEQ ID NO: 2274 - protein, 1429 aa, Arabidopsis thaliana
  misc_feature: PFam Name: KH_1; PFam Description: KH domain
  misc_feature: GI Number: 23197752; NR Description: putative RNA-binding protein [Arabidopsis thaliana] >gi|3786011|gb|AAC67357.1| putative RNA-binding protein [Arabidopsis thaliana] >gi|17978787|gb|AAL47387.1| putative RNA-binding protein
  misc_feature: GI Number: 34900448; NR Description: KH domain-like protein [Oryza sativa (japonica cultivar-group)] >gi|24060154|dbj|BAC21599.1| KH domain-like protein [Oryza sativa
  misc_feature: GI Number: 34909270; NR Description: P0454H12.18 [Oryza sativa (japonica cultivar-group)] >gi|15128399|dbj|BAB62585.1|
  misc_feature: GI Number: 56785233; NR Description: QUAKING isoform 5-like [Oryza sativa (japonica cultivar-group)] gi|56784311|dbj|BAD82237.1| QUAKING isoform 5-like [Oryza sativa
  misc_feature: GI Number: 24030184; NR Description: putative RNA-binding protein [Arabidopsis thaliana] >gi|9758634|dbj|BAB09296.1| RNA-binding protein-like [Arabidopsis thaliana] >gi|15241136|ref|NP_200425.1| KH domain-containing protein
ATTCACATTTGGTGTCTGCTGCTGGCTTTGGTCTTTCTCTTTCTCTTTCTACTTTTTTTTGGTTCTGCGATTTCCATCAAAACCCTTTTCCCAACAATCTTGGTTTTGTACAGAGAAGAAGAAGAAGAAGAAAGGCACACAAAATAACCCATGTCTGGTTTATACAATAACTCATCTTACTTCTCTCCTGCTCGAGCTGCTTCTCCTCAGATTAGAAGCACTCCTGAGATCGACAGCTCTCAGTACTTGACGGAGCTTCTCGCTGAACATCAAAAGCTTACTCCTTTTATGCAGGTCCTACCCATATGTAGCCGTCTATTGAATCAAGAGATGTTCAGGGTCTCTGGAATGATGTCTAACCAAGGATTTGGTGATTTTGATAGACTTCGACACAGAAGTCCCAGCCCTATGGCTTCTTCTAATCTTATGTCTAATGTCTCTAATACCGGGTTAGGAGGCTGGAACGGCCTCTCTCAGGAGAGACTTAGTGGAACACCTGGAATGACAATGGATTGGCAAGGTGCACCTGGAAGCCCCAGTTCATACACCGTCAAAAGGATATTGCGTCTGGAGATTCCTGTAGATAACTATCCTAATTTCAATTTTGTTGGACGACTTCTCGGCCCTAGAGGCAACTCGTTAAAACGCGTTGAAGCTACCACCGGTTGCCGAGTATTCATCAGAGGGAAAGGGTCAATCAAGGATCCCGAAAAGGAAGATAAATTAAGGGGAAGACCTGGCTATGAACACTTGAATGAGCAGCTTCACATCTTAATAGAGGCAGATCTTCCAGCTAGTATTGTGGAGATACGTCTGCGACAAGCTCAAGAAATTATAGAAGAGTTACTAAAGCCTGTGGACGAGTCGCAAGATTTCATAAAGAGACAGCAGCTGAGGGAACTGGCATTGCTAAACTCGAACAACCTGAGGGAAGAGAGTCCGGGGCCAAGCGGAGGTGGAAGCGTTTCGCCTTTCAATTCAAGTGGTAAACGCCCGAAAACAGGATGCTAAGTAGCGTTTTGTACGTCTCGCCCAAAACGCTCCTTCAAGCCTTATAATGGTTACTTCAACCAAAAGTACATGTCTGCATGCATTACACAGACGCACATGTGTATATCTGGTTTCTCCAGTAGTGGCTGCAATGGTGGTGGTCTGGTCAAGGCCTGCCCTGGTCTCTCTCGGGTGAGCGACCCTGTGGCTTTCGTTTTTCTTCTTCTTTATTTTAAATTTTTGTTTTTCTTTTTCCTCATCAAAAATTCATTACAGATTATTTAAAAAAGATTCATGCAAAAAAAAAAAAAAAGAGTATGAGATATATAATATATATAGGGAGAAAAAGATGTGGTGGCTTGGGAGGGCGTGGACTGAAAATTCTTATTGTATAAACATAAACAAAAAACACATTTATTGGATTGATTCTTATCGTTTG

SEQ ID NO: 2275 - DNA, 1375 bp, Arabidopsis thaliana
  misc_feature (1)..(1375): Ceres cDNA ID no. 13575039
  misc_feature (1)..(1375): Ceres CLONE  ID no. 108528
  misc_feature (1)..(1375): Also known as  Ceres CDNA ID no. 23446832
aactcacacaagaaccaacacaaaacaaaaaatattaagaaagtgatattatgacttgcagccaaacactcggaaacaacaacaccaacaaataccagatctgcgaggagatcggccgtggccgtttcggcaccgtctctcgcgtctacgctccggccaccggtgatttcttcgcttgcaaaaccatcgacaaagcctctctctccgacgaccttgaccgtgcctgtctcgacaacgagcctaagctcatggctctcttgtcctatcaccctaacatcgttcaaatccatgatctcatcgacactgattcgactctctccatcttcatggagctcgtccatccctctgtttcgatctacgaccgtctcgtctcttctggaaccttctttgagcctcagacggcgtcgttcgctaaacagattctccaggcgctttcgcattgtcaccgatacggcgtcgttcacagggatattaaaccggagaacattctggtagatctacgaaacgatacggttaagatctgcgatttcggttcagggatttggttaggtgagggagagaccaccgaaggagtcgtcggaacgccgtattacgtggcgccggaggttttaatgggatattcttacggagagaaggtcgatctatggagcgccggcgtcgttttgtacacgatgctcgctggaactccaccgttttacggcgagacagctgaagagatattcgaagcggtactcagaggaaatctccgttttccgacgaagatattccggggggtttcatctatggctaaagatttcctaaggaaattgatatgcaaagatgcttctagaagattctcagccgaacaagcattaaggcacccatggatccaaagagcaggagaaacagaggagagattcatctagaagattctctcggagaaataaataagtgtcaagtgatagcttatcatctctctcggtggttttttatctaacaagtatggaggagtgtcgggcatgtaaatttgggttatgggcattttagattccgccagcctaccaacctagtagaagagaagactctggaaaagacttttaaccaaaaaaaaaggagctgaataataaaagaagcttgtttgttgtggctgcttctgagtttggcgatgagtttttttttttttctgcatttgttgcttatgtgaattttgtttggcttttgaaaagtctttttaggggtagagacggtaatgtagagaggataacaaatctttttccgccttttacgggtttttttttccatgtggggtgagtaaaaggatgtgagaaagcagagttgtactcctttttctgcttttttttttttttaatcaataaaaatagtttatgttatccct

SEQ ID NO: 2276 - protein, 1375 aa, Arabidopsis thaliana
  misc_feature: PFam Name: Pkinase; PFam Description: Protein kinase domain
  misc_feature: GI Number: 9802556; NR Description: F22O13.13 [Arabidopsis thaliana] >gi|7434322|pir||T00718 calcium-dependent protein kinase
  misc_feature: GI Number: 23297592; NR Description: putative calcium-dependent protein kinase [Arabidopsis thaliana] >gi|17644151|gb|AAL38773.1| putative calcium-dependent protein kinase [Arabidopsis thaliana] >gi|6318613|gb|AAF06968.1| kinase
  misc_feature: GI Number: 15192724; NR Description: phosphoenolpyruvate carboxylase kinase 2 [Arabidopsis thaliana] >gi|13877128|gb|AAK43710.1| phosphoenolpyruvate carboxylase kinase
  misc_feature: GI Number: 18396914; NR Description: phosphoenolpyruvate
  misc_feature: GI Number: 7547112; NR Description: phosphoenolpyruvate
AACTCACACAAGAACCAACACAAAACAAAAAATATTAAGAAAGTGATATTATGACTTGCAGCCAAACACTCGGAAACAACAACACCAACAAATACCAGATCTGCGAGGAGATCGGCCGTGGCCGTTTCGGCACCGTCTCTCGCGTCTACGCTCCGGCCACCGGTGATTTCTTCGCTTGCAAAACCATCGACAAAGCCTCTCTCTCCGACGACCTTGACCGTGCCTGTCTCGACAACGAGCCTAAGCTCATGGCTCTCTTGTCCTATCACCCTAACATCGTTCAAATCCATGATCTCATCGACACTGATTCGACTCTCTCCATCTTCATGGAGCTCGTCCATCCCTCTGTTTCGATCTACGACCGTCTCGTCTCTTCTGGAACCTTCTTTGAGCCTCAGACGGCGTCGTTCGCTAAACAGATTCTCCAGGCGCTTTCGCATTGTCACCGATACGGCGTCGTTCACAGGGATATTAAACCGGAGAACATTCTGGTAGATCTACGAAACGATACGGTTAAGATCTGCGATTTCGGTTCAGGGATTTGGTTAGGTGAGGGAGAGACCACCGAAGGAGTCGTCGGAACGCCGTATTACGTGGCGCCGGAGGTTTTAATGGGATATTCTTACGGAGAGAAGGTCGATCTATGGAGCGCCGGCGTCGTTTTGTACACGATGCTCGCTGGAACTCCACCGTTTTACGGCGAGACAGCTGAAGAGATATTCGAAGCGGTACTCAGAGGAAATCTCCGTTTTCCGACGAAGATATTCCGGGGGGTTTCATCTATGGCTAAAGATTTCCTAAGGAAATTGATATGCAAAGATGCTTCTAGAAGATTCTCAGCCGAACAAGCATTAAGGCACCCATGGATCCAAAGAGCAGGAGAAACAGAGGAGAGATTCATCTAGAAGATTCTCTCGGAGAAATAAATAAGTGTCAAGTGATAGCTTATCATCTCTCTCGGTGGTTTTTTATCTAACAAGTATGGAGGAGTGTCGGGCATGTAAATTTGGGTTATGGGCATTTTAGATTCCGCCAGCCTACCAACCTAGTAGAAGAGAAGACTCTGGAAAAGACTTTTAACCAAAAAAAAAGGAGCTGAATAATAAAAGAAGCTTGTTTGTTGTGGCTGCTTCTGAGTTTGGCGATGAGTTTTTTTTTTTTTCTGCATTTGTTGCTTATGTGAATTTTGTTTGGCTTTTGAAAAGTCTTTTTAGGGGTAGAGACGGTAATGTAGAGAGGATAACAAATCTTTTTCCGCCTTTTACGGGTTTTTTTTTCCATGTGGGGTGAGTAAAAGGATGTGAGAAAGCAGAGTTGTACTCCTTTTTCTGCTTTTTTTTTTTTTTAATCAATAAAAATAGTTTATGTTATCCCT

SEQ ID NO: 2277 - DNA, 1355 bp, Arabidopsis thaliana
  misc_feature (1)..(1355): Ceres cDNA ID no. 13575049
  misc_feature (1)..(1355): Ceres CLONE  ID no. 111640
  misc_feature (1)..(1355): Also known as  Ceres CDNA ID no. 23446854
atcatttccctttctcttcccattttagtcttcctataacttcttctcaatcctctctcatatcttttttcttagtttaaatttcaataaaatagaaaaaaacatatacaaatctacagagaagagaagctttattttaatcttatgtgtgtgtgtgtgttttatataatttttattttttttcaaattaaaatctcttctttgcttttgatgtgggcatggctggtcttgatctaggcacagcttttcgttacgttaatcaccagctccatcgtcccgatctccaccttcaccacaattcctcctccgatgacgtcactcccggagccgggatgggtcatttcaccgtcgacgacgaagacaacaacaacaaccatcaaggtcttgacttagcctctggtggaggatcaggaagctctggaggaggaggaggtcacggcgggggaggagacgtcgttggtcgtcgtccacgtggcagaccaccgggatccaagaacaaaccgaaacctccggtaattatcacgcgcgagagcgcaaacactctaagagctcacattcttgaagtaacaaacggctgcgatgttttcgactgcgttgcgacttatgctcgtcggagacagcgagggatctgcgttctgagcggtagcggaacggtcacgaacgtcagcatacgtcagccatctgcggctggagcggttgtgacgctacaaggaacgttcgagattctttctctctccggatcgtttcttcctcctccggcacctcccggagcaacgagtttgacaattttcttagccggaggacaaggtcaggtggttggaggaagcgttgtgggtgagcttacggcggctggaccggtgattgtgattgcagcttcgtttactaatgttgcttatgagagacttcctttagaagaagatgagcagcagcaacagcttggaggaggatctaacggcggaggtaatttgtttccggaggtggcagctggaggaggaggaggacttccgttctttaatttaccgatgaatatgcaaccaaatgtgcaacttccggtggaaggttggccggggaattccggtggaagaggtcctttctgatgtgtatatattgataatcattatatatataccggcggagaagcttttccggcgaagaatttgcgagagtgaagaaaggttagaaaagcttttaatggactaatgaatttcaaattatcatcgtgatttcggacattgtcttgttcatcatgttaagcttaggtttattttttgtcgtttgtagaattttatgtttgaatccttttttttttctgtgaaactctattgtgttcgtctgcgaaggaaaaaaaaattctc

SEQ ID NO: 2278 - protein, 1355 aa, Arabidopsis thaliana
  misc_feature: PFam Name: Protamine_P1; PFam Description: Protamine P1
  misc_feature: GI Number: 3668079; NR Description: putative AT-hook DNA-binding protein [Arabidopsis thaliana] >gi|25348244|pir||E84766 probable AT-hook DNA-binding protein [imported] - Arabidopsis thaliana >gi|15226945|ref|NP_181070.1| DNA-binding protein-related
  misc_feature: GI Number: 50941343; NR Description: DNA-binding protein-like [Oryza sativa (japonica cultivar-group)] >gi|29467557|dbj|BAC66727.1| DNA-binding protein-like [Oryza sativa (japonica cultivar-group)] >gi|37806155|dbj|BAC99660.1|
  misc_feature: GI Number: 50252749; NR Description: putative DNA-binding
  misc_feature: GI Number: 32815961; NR Description: At4g12050 [Arabidopsis thaliana] >gi|4586110|emb|CAB40946.1| putative DNA-binding protein [Arabidopsis thaliana] >gi|7267906|emb|CAB78248.1| putative DNA-binding protein [Arabidopsis thaliana]
  misc_feature: GI Number: 7269128; NR Description: putative DNA binding protein [Arabidopsis thaliana] >gi|2827558|emb|CAA16566.1| putative DNA binding protein [Arabidopsis thaliana] >gi|15235815|ref|NP_194012.1| DNA-binding protein-related
ATCATTTCCCTTTCTCTTCCCATTTTAGTCTTCCTATAACTTCTTCTCAATCCTCTCTCATATCTTTTTTCTTAGTTTAAATTTCAATAAAATAGAAAAAAACATATACAAATCTACAGAGAAGAGAAGCTTTATTTTAATCTTATGTGTGTGTGTGTGTTTTATATAATTTTTATTTTTTTTCAAATTAAAATCTCTTCTTTGCTTTTGATGTGGGCATGGCTGGTCTTGATCTAGGCACAGCTTTTCGTTACGTTAATCACCAGCTCCATCGTCCCGATCTCCACCTTCACCACAATTCCTCCTCCGATGACGTCACTCCCGGAGCCGGGATGGGTCATTTCACCGTCGACGACGAAGACAACAACAACAACCATCAAGGTCTTGACTTAGCCTCTGGTGGAGGATCAGGAAGCTCTGGAGGAGGAGGAGGTCACGGCGGGGGAGGAGACGTCGTTGGTCGTCGTCCACGTGGCAGACCACCGGGATCCAAGAACAAACCGAAACCTCCGGTAATTATCACGCGCGAGAGCGCAAACACTCTAAGAGCTCACATTCTTGAAGTAACAAACGGCTGCGATGTTTTCGACTGCGTTGCGACTTATGCTCGTCGGAGACAGCGAGGGATCTGCGTTCTGAGCGGTAGCGGAACGGTCACGAACGTCAGCATACGTCAGCCATCTGCGGCTGGAGCGGTTGTGACGCTACAAGGAACGTTCGAGATTCTTTCTCTCTCCGGATCGTTTCTTCCTCCTCCGGCACCTCCCGGAGCAACGAGTTTGACAATTTTCTTAGCCGGAGGACAAGGTCAGGTGGTTGGAGGAAGCGTTGTGGGTGAGCTTACGGCGGCTGGACCGGTGATTGTGATTGCAGCTTCGTTTACTAATGTTGCTTATGAGAGACTTCCTTTAGAAGAAGATGAGCAGCAGCAACAGCTTGGAGGAGGATCTAACGGCGGAGGTAATTTGTTTCCGGAGGTGGCAGCTGGAGGAGGAGGAGGACTTCCGTTCTTTAATTTACCGATGAATATGCAACCAAATGTGCAACTTCCGGTGGAAGGTTGGCCGGGGAATTCCGGTGGAAGAGGTCCTTTCTGATGTGTATATATTGATAATCATTATATATATACCGGCGGAGAAGCTTTTCCGGCGAAGAATTTGCGAGAGTGAAGAAAGGTTAGAAAAGCTTTTAATGGACTAATGAATTTCAAATTATCATCGTGATTTCGGACATTGTCTTGTTCATCATGTTAAGCTTAGGTTTATTTTTTGTCGTTTGTAGAATTTTATGTTTGAATCCTTTTTTTTTTCTGTGAAACTCTATTGTGTTCGTCTGCGAAGGAAAAAAAAATTCTC

SEQ ID NO: 2279 - DNA, 944 bp, Arabidopsis thaliana
  misc_feature (1)..(944): Ceres cDNA ID no. 13575244
  misc_feature (1)..(944): Ceres CLONE  ID no. 742989
  misc_feature (1)..(944): Also known as  Ceres CDNA ID no. 23650951
atcatcatcacccacagcacagagacacacacaaaaaacccataaaaaaatatggcaaatatctccagtattcacattctcttcctcgtgttcatcacaagcggcattgctgttatggccacagacttcactctaaggaacaattgccctaccaccgtctgggccggaactctcgccggtcaaggacccaagctcggcgatggaggatttgaattgactccaggtgcttcccgacagctcacggctcctgcaggatggtcaggccggttctgggctcgtacaggctgcaactttgacgcctccggaaacggtagatgtgtaaccggagactgtggcggtctaagatgtaacggcggcggagttcctcccgtcactctggctgaattcactctagtaggcgatggcggcaaagatttctacgatgtgagcctcgtagatggttacaatgtcaagctggggataagaccatccggaggatcgggagattgcaaatacgcaggctgtgtctctgacctcaacgcggcttgccccgacatgcttaaggtcatggatcagaacaatgtcgtggcctgcaagagtgcctgtgagaggtttaatacggatcaatattgctgccgtggagctaacgataagccggaaacttgtcctcccacggactactcgaggattttcaagaacgcttgccctgacgcctatagctacgcttatgacgacgaaacgagcaccttcacttgtaccggagctaactacgaaatcactttctgcccttaaaaaccgaagcttcgagttagatacagtcgggtttaattatctctcacgtttcttttgcttattatgtacggaaagataaataaggaaagctgatgactatgaatcatcgtcttccacttttaagcttttttagtgagtattagtcagttgttacactcagctgatttgtttac

SEQ ID NO: 2280 - protein, 944 aa, Arabidopsis thaliana
  misc_feature: PFam Name: Thaumatin; PFam Description: Thaumatin family
  misc_feature: GI Number: 16323452; NR Description: putative thaumatin protein [Arabidopsis thaliana] >gi|14334528|gb|AAK59672.1| putative thaumatin protein [Arabidopsis thaliana] >gi|135915|sp|P28493|PR5_ARATH Pathogenesis-related protein 5
  misc_feature: GI Number: 51968828; NR Description: thaumatin-like protein [Arabidopsis thaliana] >gi|12323901|gb|AAG51927.1| thaumatin-like protein; 28949-28112 [Arabidopsis thaliana] >gi|15222088|ref|NP_177640.1| pathogenesis-related thaumatin
  misc_feature: GI Number: 2435406; NR Description: thaumatin-like protein
  misc_feature: GI Number: 6273385; NR Description: SCUTL2 [Vitis vinifera]
ATCATCATCACCCACAGCACAGAGACACACACAAAAAACCCATAAAAAAATATGGCAAATATCTCCAGTATTCACATTCTCTTCCTCGTGTTCATCACAAGCGGCATTGCTGTTATGGCCACAGACTTCACTCTAAGGAACAATTGCCCTACCACCGTCTGGGCCGGAACTCTCGCCGGTCAAGGACCCAAGCTCGGCGATGGAGGATTTGAATTGACTCCAGGTGCTTCCCGACAGCTCACGGCTCCTGCAGGATGGTCAGGCCGGTTCTGGGCTCGTACAGGCTGCAACTTTGACGCCTCCGGAAACGGTAGATGTGTAACCGGAGACTGTGGCGGTCTAAGATGTAACGGCGGCGGAGTTCCTCCCGTCACTCTGGCTGAATTCACTCTAGTAGGCGATGGCGGCAAAGATTTCTACGATGTGAGCCTCGTAGATGGTTACAATGTCAAGCTGGGGATAAGACCATCCGGAGGATCGGGAGATTGCAAATACGCAGGCTGTGTCTCTGACCTCAACGCGGCTTGCCCCGACATGCTTAAGGTCATGGATCAGAACAATGTCGTGGCCTGCAAGAGTGCCTGTGAGAGGTTTAATACGGATCAATATTGCTGCCGTGGAGCTAACGATAAGCCGGAAACTTGTCCTCCCACGGACTACTCGAGGATTTTCAAGAACGCTTGCCCTGACGCCTATAGCTACGCTTATGACGACGAAACGAGCACCTTCACTTGTACCGGAGCTAACTACGAAATCACTTTCTGCCCTTAAAAACCGAAGCTTCGAGTTAGATACAGTCGGGTTTAATTATCTCTCACGTTTCTTTTGCTTATTATGTACGGAAAGATAAATAAGGAAAGCTGATGACTATGAATCATCGTCTTCCACTTTTAAGCTTTTTTAGTGAGTATTAGTCAGTTGTTACACTCAGCTGATTTGTTTAC

SEQ ID NO: 2281 - DNA, 1765 bp, Arabidopsis thaliana
  misc_feature (1)..(1765): Ceres cDNA ID no. 13575380
  misc_feature (1)..(1765): Ceres CLONE  ID no. 802949
  misc_feature (1)..(1765): Also known as  Ceres CDNA ID no. 23447351
atggagcccaagcttctgctttctgcacataaacctttgtttgtctcttgtaactctccattcaatgaaaaaaccaagctttcggtcaaatccggtttgcccatgtccacaattcgagctgcgaggtctcagtttatgggggaaggtttgattttggggaacaagtatgggttttggagtacttctaggaaaactcgtgttgttgttgagcctgtgagagctgctgtgaagagaaggaaagagcttactttcgatagcgttgttcaaagggataagaaacttaagttagtgttgaacattaggaagattcttgtgagtcaacctgataggatgatgtctcttaggggtttgggtaagtacaggagagatttgggtttgaagaaacgtcgtcggtttatagctctgcttaggaaatatcctggtgtgtttgagatagttgaagaaggagcttattctttgagatttaagatgacatcagaggctgaaaggttgtaccttgacgaaatgaggattaggaatgagcttgaagatgtactggttgttaagctgaggaaactggtgatgatgtctattgataagcggatattgttggagaagatttcccatttgaagactgatttagggcttccgttagagttccgcgacacgatttgtcagcgttacccgcaatatttccgtgtggttcctacgcctagaggtccggctttagagttgactcactgggatcctgagcttgcagtgtcagctgctgagttatctgaggatgataataggactagagagtcagaagaaaggaatttgattattgatagaccacctaagttcaacagggttaagcttccaaggggtctcaatctttcaaagagtgagacgaggaagatatctcagttccgtgacatgcagtatatatctccttacaaggatttctcccacttgaggtcgggaacactcgagaaagaaaagcatgcttgtggggttattcatgagcttttgagcttaacgactgagaaaagaacgctggtggatcacttgactcatttccgtgaggaattcagattctcacaacaactgaggggaatgcttattaggcaccctgatctcttctacgtgtctttgaaaggtgaaagagactcggtgttcttaagagaagcttacaggaactctgaattgatagataaagatcctttaactcttgtgaaagagaagatgcgtgcacttgtttctgtaccaaggttcccaaggagaggaggacccaggaaagacgaagaaggaagagaggtagagatcgatggaagcgatgcagatggtgaggaggaagaagaagaaagtgatgctgaagaatggtctgatgttgatggttacttggaaggtgaagatggtggcaatgatgatgatggcgattggacagatgacgaaggagaggaagatgtgcctcctaactttgatgatgatgatgaagacgaagaagaagatagcgtgaagattggattaagtccttcaagtagaaaatcaagtagtcctagaaagaaagaagagaaagtacttactcctgtgttccctgatggtactccaagggaaaaatggtaaactatcacagattagtttcatgaaaaaatgtttacttgtcttgtatcattcttgaagatgaacactaatagctcaagcttatgtaagttgctgcttttgttgtaagaacacttgagaatgatgttgaatctttctcaactttttgtagtgttagatgagtaatttgctatcttccgct

SEQ ID NO: 2282 - protein, 1765 aa, Arabidopsis thaliana
ATGGAGCCCAAGCTTCTGCTTTCTGCACATAAACCTTTGTTTGTCTCTTGTAACTCTCCATTCAATGAAAAAACCAAGCTTTCGGTCAAATCCGGTTTGCCCATGTCCACAATTCGAGCTGCGAGGTCTCAGTTTATGGGGGAAGGTTTGATTTTGGGGAACAAGTATGGGTTTTGGAGTACTTCTAGGAAAACTCGTGTTGTTGTTGAGCCTGTGAGAGCTGCTGTGAAGAGAAGGAAAGAGCTTACTTTCGATAGCGTTGTTCAAAGGGATAAGAAACTTAAGTTAGTGTTGAACATTAGGAAGATTCTTGTGAGTCAACCTGATAGGATGATGTCTCTTAGGGGTTTGGGTAAGTACAGGAGAGATTTGGGTTTGAAGAAACGTCGTCGGTTTATAGCTCTGCTTAGGAAATATCCTGGTGTGTTTGAGATAGTTGAAGAAGGAGCTTATTCTTTGAGATTTAAGATGACATCAGAGGCTGAAAGGTTGTACCTTGACGAAATGAGGATTAGGAATGAGCTTGAAGATGTACTGGTTGTTAAGCTGAGGAAACTGGTGATGATGTCTATTGATAAGCGGATATTGTTGGAGAAGATTTCCCATTTGAAGACTGATTTAGGGCTTCCGTTAGAGTTCCGCGACACGATTTGTCAGCGTTACCCGCAATATTTCCGTGTGGTTCCTACGCCTAGAGGTCCGGCTTTAGAGTTGACTCACTGGGATCCTGAGCTTGCAGTGTCAGCTGCTGAGTTATCTGAGGATGATAATAGGACTAGAGAGTCAGAAGAAAGGAATTTGATTATTGATAGACCACCTAAGTTCAACAGGGTTAAGCTTCCAAGGGGTCTCAATCTTTCAAAGAGTGAGACGAGGAAGATATCTCAGTTCCGTGACATGCAGTATATATCTCCTTACAAGGATTTCTCCCACTTGAGGTCGGGAACACTCGAGAAAGAAAAGCATGCTTGTGGGGTTATTCATGAGCTTTTGAGCTTAACGACTGAGAAAAGAACGCTGGTGGATCACTTGACTCATTTCCGTGAGGAATTCAGATTCTCACAACAACTGAGGGGAATGCTTATTAGGCACCCTGATCTCTTCTACGTGTCTTTGAAAGGTGAAAGAGACTCGGTGTTCTTAAGAGAAGCTTACAGGAACTCTGAATTGATAGATAAAGATCCTTTAACTCTTGTGAAAGAGAAGATGCGTGCACTTGTTTCTGTACCAAGGTTCCCAAGGAGAGGAGGACCCAGGAAAGACGAAGAAGGAAGAGAGGTAGAGATCGATGGAAGCGATGCAGATGGTGAGGAGGAAGAAGAAGAAAGTGATGCTGAAGAATGGTCTGATGTTGATGGTTACTTGGAAGGTGAAGATGGTGGCAATGATGATGATGGCGATTGGACAGATGACGAAGGAGAGGAAGATGTGCCTCCTAACTTTGATGATGATGATGAAGACGAAGAAGAAGATAGCGTGAAGATTGGATTAAGTCCTTCAAGTAGAAAATCAAGTAGTCCTAGAAAGAAAGAAGAGAAAGTACTTACTCCTGTGTTCCCTGATGGTACTCCAAGGGAAAAATGGTAAACTATCACAGATTAGTTTCATGAAAAAATGTTTACTTGTCTTGTATCATTCTTGAAGATGAACACTAATAGCTCAAGCTTATGTAAGTTGCTGCTTTTGTTGTAAGAACACTTGAGAATGATGTTGAATCTTTCTCAACTTTTTGTAGTGTTAGATGAGTAATTTGCTATCTTCCGCT

SEQ ID NO: 2283 - DNA, 1387 bp, Arabidopsis thaliana
  misc_feature (1)..(1387): Ceres cDNA ID no. 13575429
  misc_feature (1)..(1387): Ceres CLONE  ID no. 1007884
  misc_feature (1)..(1387): Also known as  Ceres CDNA ID no. 23447416
acgtgataacccctatatatatctcaatggccggttcggttatggttccgtccgtttcaatcggtttagccttatctgtcttaatcttcttcgctctttccctcaagacccttgaagctcgtggaaccttcggcaggcttgccggacagccaccgcagaggactgctgccggcggcatatgcgcttcttctgttcacatatttggttacaagtgcgaagaacatgatgtggtgactcaagatgggtacatattgaatatgcaaaggataccggaaggacgagccggagccgtcgccggagatgggggaaagagacaacctgtcctaatacaacatggaattcttgtcgatgggatgtcatggctgttgaatccagcggatcaaaatctgccgttgattttggcggatcaaggattcgatgtgtggatggggaacacaagagggactagattcagcagaagacacaagtaccttaacccttctcaacgggctttctggaactggacgtgggacgagcttgtgagttacgatctgcctgctatgtttgaccatatccatggcctaacaggccaaaagattcactacctcggacactctttggggacgttaataggatttgcttcgttctcagaaaaagggttggtggatcaagtgagatcggcggcgatgttgagtcccgttgcttatctcagccacatgaccaccgtcatcggcgatatcgccgcaaaaaccttcctcgccgaggccacctctattcttggatggccagagtttaacccgaaaagtggattagtaggggattttataaaggctatatgccttaaagcggggatcgactgttatgatttagtctctgttatcactggaaagaattgctgccttaacgcatcaaccattgatctgttccttgccaacgaacctcaatctacttccaccaagaacatgatccaccttgctcaaacggtaagagacaaggagttgagaaaatacaactatggaagcagtgatcgcaacataaaacattacggtcaagcgataccaccggcatacaacatatcggcgatcccacacgagcttccgctttttttcagctacggtggtttagatagcctggctgatgtgaaagacgttgagtttctccttgaccagtttaagtatcacgacatcgataagatgaatgtgcagtttgtgaaagactatgctcatgctgatttcatcatgggtgttactgccaaagacgttgtttataaccaagttgctacctttttcaaacgacaagcttgataatattattaccttgtcattagtttatgtaattgcatgtgcccatattcttcaattgtttccctctaaacaaaatgggcaaaaataaaattaaaatttttatc

SEQ ID NO: 2284 - protein, 1387 aa, Arabidopsis thaliana
  misc_feature: PFam Name: Abhydro_lipase; PFam Description: ab-hydrolase
  misc_feature: PFam Name: Abhydrolase_1; PFam Description: alpha/beta
  misc_feature: GI Number: 39636476; NR Description: triacylglycerol/steryl
  misc_feature: GI Number: 50947883; NR Description: putative gastric lipase precursor [Oryza sativa (japonica cultivar-group)] >gi|42407876|dbj|BAD09017.1| putative gastric lipase precursor [Oryza sativa (japonica cultivar-group)]
  misc_feature: GI Number: 35395931; NR Description: lysosomal acid
  misc_feature: GI Number: 38344633; NR Description: OSJNBa0094P09.4 [Oryza
  misc_feature: GI Number: 51091881; NR Description: lingual lipase-like
ACGTGATAACCCCTATATATATCTCAATGGCCGGTTCGGTTATGGTTCCGTCCGTTTCAATCGGTTTAGCCTTATCTGTCTTAATCTTCTTCGCTCTTTCCCTCAAGACCCTTGAAGCTCGTGGAACCTTCGGCAGGCTTGCCGGACAGCCACCGCAGAGGACTGCTGCCGGCGGCATATGCGCTTCTTCTGTTCACATATTTGGTTACAAGTGCGAAGAACATGATGTGGTGACTCAAGATGGGTACATATTGAATATGCAAAGGATACCGGAAGGACGAGCCGGAGCCGTCGCCGGAGATGGGGGAAAGAGACAACCTGTCCTAATACAACATGGAATTCTTGTCGATGGGATGTCATGGCTGTTGAATCCAGCGGATCAAAATCTGCCGTTGATTTTGGCGGATCAAGGATTCGATGTGTGGATGGGGAACACAAGAGGGACTAGATTCAGCAGAAGACACAAGTACCTTAACCCTTCTCAACGGGCTTTCTGGAACTGGACGTGGGACGAGCTTGTGAGTTACGATCTGCCTGCTATGTTTGACCATATCCATGGCCTAACAGGCCAAAAGATTCACTACCTCGGACACTCTTTGGGGACGTTAATAGGATTTGCTTCGTTCTCAGAAAAAGGGTTGGTGGATCAAGTGAGATCGGCGGCGATGTTGAGTCCCGTTGCTTATCTCAGCCACATGACCACCGTCATCGGCGATATCGCCGCAAAAACCTTCCTCGCCGAGGCCACCTCTATTCTTGGATGGCCAGAGTTTAACCCGAAAAGTGGATTAGTAGGGGATTTTATAAAGGCTATATGCCTTAAAGCGGGGATCGACTGTTATGATTTAGTCTCTGTTATCACTGGAAAGAATTGCTGCCTTAACGCATCAACCATTGATCTGTTCCTTGCCAACGAACCTCAATCTACTTCCACCAAGAACATGATCCACCTTGCTCAAACGGTAAGAGACAAGGAGTTGAGAAAATACAACTATGGAAGCAGTGATCGCAACATAAAACATTACGGTCAAGCGATACCACCGGCATACAACATATCGGCGATCCCACACGAGCTTCCGCTTTTTTTCAGCTACGGTGGTTTAGATAGCCTGGCTGATGTGAAAGACGTTGAGTTTCTCCTTGACCAGTTTAAGTATCACGACATCGATAAGATGAATGTGCAGTTTGTGAAAGACTATGCTCATGCTGATTTCATCATGGGTGTTACTGCCAAAGACGTTGTTTATAACCAAGTTGCTACCTTTTTCAAACGACAAGCTTGATAATATTATTACCTTGTCATTAGTTTATGTAATTGCATGTGCCCATATTCTTCAATTGTTTCCCTCTAAACAAAATGGGCAAAAATAAAATTAAAATTTTTATC

SEQ ID NO: 2285 - DNA, 1147 bp, Arabidopsis thaliana
  misc_feature (1)..(1147): Ceres cDNA ID no. 13575583
  misc_feature (1)..(1147): Ceres CLONE  ID no. 96368
  misc_feature (1)..(1147): Also known as  Ceres CDNA ID no. 23649295
attaaattcgcttttttttttcttctttgtatatttttttttttttgaccatggcggaggaatttggaagcatagatttactcggagatgaagatttcttcttcgatttcgatccttcaatcgtaattgattctcttccggcggaggattttcttcagtcttcaccggattcatggatcggagaaatcgagaatcaattgatgaacgatgagaatcatcaagaggagagttttgtggaattggatcagcaatcggtttcagatttcatagcggatctactcgttgattatccaactagcgattctggctccgttgatttggcggctgataaagttctaaccgtcgattctcccgccgccgctgatgattccgggaaggagaattcggatttggttgttgagaagaagtctaatgattctggtagcgagattcatgatgatgatgacgaagaaggagacgatgatgctgtggctaaaaaacgaagaaggagagtaagaaatagagatgcggcggttagatcgagagagaggaagaaggaatatgtacaagatttagagaagaagagtaagtatctcgaaagagaatgcttgagactaggacgtatgcttgagtgcttcgttgctgaaaaccagtctctacgttactgtttgcaaaagggtaatggcaataatactaccatgatgtcgaagcaggagtctgctgtgctcttgttggaatccctgctgttgggttccctgctttggcttctgggagtaaacttcatttgcctattcccttatatgtcccacacaaagtgttgcctcctacgtccagaaccagaaaagctggttctaaacgggctcgggagtagtagcaaaccgtcttataccggcgttagtcggagatgtaagggttcgaggcctaggatgaaataccaaatcttaacccttgcggcgtgacaacgccttttttaactgcttcttttgcgcattttgagttgtagatgagtgtcttttagttttctctctcttgttttgtatttcgctgttgaaagttttctgtctaatatcgataagttaacagtgaatgtgggtcttatggttatggatgatatctatctaataatgcttctgcctttaaaatgttgattttgaggcataacttcagg

SEQ ID NO: 2286 - protein, 1147 aa, Arabidopsis thaliana
  misc_feature: PFam Name: bZIP_2; PFam Description: Basic region leucine zipper
  misc_feature: PFam Name: bZIP_1; PFam Description: bZIP transcription factor
  misc_feature: GI Number: 22136790; NR Description: putative bZIP transcription factor [Arabidopsis thaliana] >gi|15028323|gb|AAK76638.1| putative bZIP transcription factor [Arabidopsis thaliana] >gi|25405103|pir||E96497 probable bZIP
  misc_feature: GI Number: 51090849; NR Description: bZIP transcription
  misc_feature: GI Number: 27311793; NR Description: putative bZIP
  misc_feature: GI Number: 6630550; NR Description: putative bZIP transcription factor [Arabidopsis thaliana] >gi|15228374|ref|NP_187691.1| bZIP transcription factor family
  misc_feature: GI Number: 50939577; NR Description: putative bZIP family transcription factor [Oryza sativa (japonica cultivar-group)] >gi|22093711|dbj|BAC07004.1| putative bZIP family transcription factor [Oryza sativa (japonica transcription factor [Oryza sativa
ATTAAATTCGCTTTTTTTTTTCTTCTTTGTATATTTTTTTTTTTTTGACCATGGCGGAGGAATTTGGAAGCATAGATTTACTCGGAGATGAAGATTTCTTCTTCGATTTCGATCCTTCAATCGTAATTGATTCTCTTCCGGCGGAGGATTTTCTTCAGTCTTCACCGGATTCATGGATCGGAGAAATCGAGAATCAATTGATGAACGATGAGAATCATCAAGAGGAGAGTTTTGTGGAATTGGATCAGCAATCGGTTTCAGATTTCATAGCGGATCTACTCGTTGATTATCCAACTAGCGATTCTGGCTCCGTTGATTTGGCGGCTGATAAAGTTCTAACCGTCGATTCTCCCGCCGCCGCTGATGATTCCGGGAAGGAGAATTCGGATTTGGTTGTTGAGAAGAAGTCTAATGATTCTGGTAGCGAGATTCATGATGATGATGACGAAGAAGGAGACGATGATGCTGTGGCTAAAAAACGAAGAAGGAGAGTAAGAAATAGAGATGCGGCGGTTAGATCGAGAGAGAGGAAGAAGGAATATGTACAAGATTTAGAGAAGAAGAGTAAGTATCTCGAAAGAGAATGCTTGAGACTAGGACGTATGCTTGAGTGCTTCGTTGCTGAAAACCAGTCTCTACGTTACTGTTTGCAAAAGGGTAATGGCAATAATACTACCATGATGTCGAAGCAGGAGTCTGCTGTGCTCTTGTTGGAATCCCTGCTGTTGGGTTCCCTGCTTTGGCTTCTGGGAGTAAACTTCATTTGCCTATTCCCTTATATGTCCCACACAAAGTGTTGCCTCCTACGTCCAGAACCAGAAAAGCTGGTTCTAAACGGGCTCGGGAGTAGTAGCAAACCGTCTTATACCGGCGTTAGTCGGAGATGTAAGGGTTCGAGGCCTAGGATGAAATACCAAATCTTAACCCTTGCGGCGTGACAACGCCTTTTTTAACTGCTTCTTTTGCGCATTTTGAGTTGTAGATGAGTGTCTTTTAGTTTTCTCTCTCTTGTTTTGTATTTCGCTGTTGAAAGTTTTCTGTCTAATATCGATAAGTTAACAGTGAATGTGGGTCTTATGGTTATGGATGATATCTATCTAATAATGCTTCTGCCTTTAAAATGTTGATTTTGAGGCATAACTTCAGG

SEQ ID NO: 2287 - DNA, 1730 bp, Arabidopsis thaliana
  misc_feature (1)..(1730): Ceres cDNA ID no. 13575843
  misc_feature (1)..(1730): Ceres CLONE  ID no. 1142552
  misc_feature (1)..(1730): Also known as  Ceres CDNA ID no. 23448084
gaaaaaccataaaaataaaaataagtggagaaatcaaaatcatcgattctcctttgtttcgcctaacccaattcctaaatctcagcatctttcatcaatccaatctctcaaataagcgagagagaaacaaagattatcgaatccttggagacgaaaacatactccaatttgttttaggacatttgggttaccctgaggcttaaggagaatagtggtttagttatttatactgaattttgtgtcattcagactttccgaggattttctgtttggtaccgtttgcctcgtctgtgttttcatttgagctgcatcttaaagtgaaagttcagtgcttaaacagtaataaagtagtatttcaacaggctgctaataagattgctccctttcgcttacacagtgcttaacaagatggctggtgtaaagcgaaaattaagtaccgagtcagatgttcatgctcttcacaaagaactggatgaggtttcatgtcctgtttgcatggatcacccacataatgctgttctactgctgtgcagctctcatgacaaaggttgcaggtcctacatctgtgataccagttaccgacattccaattgccttgaccggtttaagaaattgcattctgaatccgcaaatgaccctactcccgaggcgaacttggcttcaagggaacataataacgaatctctatacgagcatggtacagccagtcgaagcagttttcaccgtgagtctggaaaccgaggctcttcttgggattccgaatcactgaggaggaggaggagagttgaggaagaagttgagtcagaagatatcacaaatttgaaatgtcctctatgccggggtactgttttaggatggaaggttgtagaagaagtaagaacgtatcttgatcataagaaccgaagttgctcccgagaatcctgctcatttactggcaactaccaggatctgcgccgccatgccaggaggactcacccaacaactcgtccttcagacactgatccatcaagagagagagcttggaggcggcttgagaaccagagggagtatggagatatagtcagtgcaatccgttctgccatgcccggtgctgttgtagtaggagattatgttatagaaaacggagataggtttgcaggtgagagggaaacgggaaatggtgggagcgacctttggaccactttactattgtttcagatgattggctctcttgacaatggaggttctagcgctagtgggagtggtggtggatcaagatcccacaggtcaagggcatggaggaatcatcggcgttcatcttcagataggccgtacctttggggggagaatctattgggtctacaagatgagcgcaataacaacgatgatgaagagtttcgtttgcagaatgatgcaggcggtgcttctactcctgttccaagaagaagaaggagatttggacgtcctagatcaagcggaaatcatccgcgataagctgaagcgtcccggtgatatcgatatctctcgggtcagaaccaggccgatgcaaagggaaaggttttactaaaaacccgagaggcttaggattgtttggttttatgtaaatgtcattttgagccttggctcattgtatactactaagtatggcttcttatgcaatgtcttttgttacttaactcgtggattattttcttttgcgttgtgatgaagtttgttatttaggaaatcgaccacgtataaatattttatct

SEQ ID NO: 2288 - protein, 1730 aa, Arabidopsis thaliana
  misc_feature: GI Number: 34912600; NR Description: P0046B10.17 [Oryza sativa (japonica cultivar-group)] >gi|11034559|dbj|BAB17083.1| P0410E01.4 [Oryza sativa (japonica cultivar-group)] >gi|21104687|dbj|BAB93277.1| P0046B10.17 [Oryza sativa (japonica
  misc_feature: GI Number: 5103842; NR Description: F9L1.39 [Arabidopsis thaliana]
GAAAAACCATAAAAATAAAAATAAGTGGAGAAATCAAAATCATCGATTCTCCTTTGTTTCGCCTAACCCAATTCCTAAATCTCAGCATCTTTCATCAATCCAATCTCTCAAATAAGCGAGAGAGAAACAAAGATTATCGAATCCTTGGAGACGAAAACATACTCCAATTTGTTTTAGGACATTTGGGTTACCCTGAGGCTTAAGGAGAATAGTGGTTTAGTTATTTATACTGAATTTTGTGTCATTCAGACTTTCCGAGGATTTTCTGTTTGGTACCGTTTGCCTCGTCTGTGTTTTCATTTGAGCTGCATCTTAAAGTGAAAGTTCAGTGCTTAAACAGTAATAAAGTAGTATTTCAACAGGCTGCTAATAAGATTGCTCCCTTTCGCTTACACAGTGCTTAACAAGATGGCTGGTGTAAAGCGAAAATTAAGTACCGAGTCAGATGTTCATGCTCTTCACAAAGAACTGGATGAGGTTTCATGTCCTGTTTGCATGGATCACCCACATAATGCTGTTCTACTGCTGTGCAGCTCTCATGACAAAGGTTGCAGGTCCTACATCTGTGATACCAGTTACCGACATTCCAATTGCCTTGACCGGTTTAAGAAATTGCATTCTGAATCCGCAAATGACCCTACTCCCGAGGCGAACTTGGCTTCAAGGGAACATAATAACGAATCTCTATACGAGCATGGTACAGCCAGTCGAAGCAGTTTTCACCGTGAGTCTGGAAACCGAGGCTCTTCTTGGGATTCCGAATCACTGAGGAGGAGGAGGAGAGTTGAGGAAGAAGTTGAGTCAGAAGATATCACAAATTTGAAATGTCCTCTATGCCGGGGTACTGTTTTAGGATGGAAGGTTGTAGAAGAAGTAAGAACGTATCTTGATCATAAGAACCGAAGTTGCTCCCGAGAATCCTGCTCATTTACTGGCAACTACCAGGATCTGCGCCGCCATGCCAGGAGGACTCACCCAACAACTCGTCCTTCAGACACTGATCCATCAAGAGAGAGAGCTTGGAGGCGGCTTGAGAACCAGAGGGAGTATGGAGATATAGTCAGTGCAATCCGTTCTGCCATGCCCGGTGCTGTTGTAGTAGGAGATTATGTTATAGAAAACGGAGATAGGTTTGCAGGTGAGAGGGAAACGGGAAATGGTGGGAGCGACCTTTGGACCACTTTACTATTGTTTCAGATGATTGGCTCTCTTGACAATGGAGGTTCTAGCGCTAGTGGGAGTGGTGGTGGATCAAGATCCCACAGGTCAAGGGCATGGAGGAATCATCGGCGTTCATCTTCAGATAGGCCGTACCTTTGGGGGGAGAATCTATTGGGTCTACAAGATGAGCGCAATAACAACGATGATGAAGAGTTTCGTTTGCAGAATGATGCAGGCGGTGCTTCTACTCCTGTTCCAAGAAGAAGAAGGAGATTTGGACGTCCTAGATCAAGCGGAAATCATCCGCGATAAGCTGAAGCGTCCCGGTGATATCGATATCTCTCGGGTCAGAACCAGGCCGATGCAAAGGGAAAGGTTTTACTAAAAACCCGAGAGGCTTAGGATTGTTTGGTTTTATGTAAATGTCATTTTGAGCCTTGGCTCATTGTATACTACTAAGTATGGCTTCTTATGCAATGTCTTTTGTTACTTAACTCGTGGATTATTTTCTTTTGCGTTGTGATGAAGTTTGTTATTTAGGAAATCGACCACGTATAAATATTTTATCT

SEQ ID NO: 2289 - DNA, 1365 bp, Arabidopsis thaliana
  misc_feature (1)..(1365): Ceres cDNA ID no. 13575879
  misc_feature (1)..(1365): Ceres CLONE  ID no. 1142917
  misc_feature (1)..(1365): Also known as  Ceres CDNA ID no. 23448139
gataaaactcatcattcctcattcatctctaacaatggcgtcttctcgaatcatcatcttctccgttcttcttctctccatcttctcactctcatcatctgcccaaccatctttccgccccaaagctctccttctcccagtaacaaaagacccatctaccctccagtacacaaccgtcatcaaccaacgcacacctctcgtccccgcttccgtcgtattcgacctcggtggtcgagaattctgggtcgactgtgaccaaggctacgtctccaccacttaccgctctcctcgctgcaactccgctgtctgctcacgcgccggctccatcgcctgcggcacatgcttctctcctccgagacctggctgtagtaacaacacttgcggcgcttttccagataactccatcaccggatgggcaacctcgggcgaatttgctttagacgttgtgtctatccagtccactaacggatccaatccgggtcggttcgttaaaatccccaatctaatattcagttgcggatcaacgtctcttcttaaaggactcgctaaaggagccgttggtatggctggaatgggacgtcacaacatcggcttaccgttgcagttcgccgccgcgtttagcttcaaccgcaaattcgccgtgtgtcttacttccggtagaggcgtcgccttcttcggcaacggaccttacgttttcctccccgggatccagatctcaaggcttcaaaagacaccgcttctcatcaatccagggaccactgtttttgagttttcaaaaggcgagaagtcgccggagtattttatcggcgtgacggcgattaagatcgtcgagaaaacacttccaatcgatccaacgcttttgaagataaacgcaagtactggaataggaggaaccaaaatcagctccgtcaatccttacacggtgttggagtcatcgatctacaaagcttttacgtcggagtttattagacaagcagcggcgaggagcatcaagagagtagcgtcggtgaaaccgttcggcgcgtgtttcagcacgaagaacgttggcgtcacgcgcctaggatacgccgtaccggagattcagctcgtgcttcatagcaaagacgtcgtttggagaatctttggagctaactcgatggtgagtgtcagtgatgacgtcatctgtttgggtttcgttgacggaggagtcaacccaggagcctctgtggtgatcggagggttccagttggaggataatttgatcgaatttgatttggcgagtaacaaatttgggtttagttccacgttattgggccgtcaaactaactgcgccaactttaatttcacttccactgcttgattaaatttagttgatgcactttctcc

SEQ ID NO: 2290 - protein, 1365 aa, Arabidopsis thaliana
  misc_feature: PFam Name: Asp; PFam Description: Eukaryotic aspartyl protease
  misc_feature: GI Number: 21537233; NR Description: EDGP precursor
  misc_feature: GI Number: 7488910; NR Description: dermal glycoprotein precursor, extracellular - carrot (fragment)
  misc_feature: GI Number: 32482806; NR Description: putative xyloglucanase
  misc_feature: GI Number: 27372527; NR Description: xyloglucan-specific fungal endoglucanase inhibitor protein precursor [Lycopersicon
  misc_feature: GI Number: 11191819; NR Description: conglutin gamma [Lupinus
GATAAAACTCATCATTCCTCATTCATCTCTAACAATGGCGTCTTCTCGAATCATCATCTTCTCCGTTCTTCTTCTCTCCATCTTCTCACTCTCATCATCTGCCCAACCATCTTTCCGCCCCAAAGCTCTCCTTCTCCCAGTAACAAAAGACCCATCTACCCTCCAGTACACAACCGTCATCAACCAACGCACACCTCTCGTCCCCGCTTCCGTCGTATTCGACCTCGGTGGTCGAGAATTCTGGGTCGACTGTGACCAAGGCTACGTCTCCACCACTTACCGCTCTCCTCGCTGCAACTCCGCTGTCTGCTCACGCGCCGGCTCCATCGCCTGCGGCACATGCTTCTCTCCTCCGAGACCTGGCTGTAGTAACAACACTTGCGGCGCTTTTCCAGATAACTCCATCACCGGATGGGCAACCTCGGGCGAATTTGCTTTAGACGTTGTGTCTATCCAGTCCACTAACGGATCCAATCCGGGTCGGTTCGTTAAAATCCCCAATCTAATATTCAGTTGCGGATCAACGTCTCTTCTTAAAGGACTCGCTAAAGGAGCCGTTGGTATGGCTGGAATGGGACGTCACAACATCGGCTTACCGTTGCAGTTCGCCGCCGCGTTTAGCTTCAACCGCAAATTCGCCGTGTGTCTTACTTCCGGTAGAGGCGTCGCCTTCTTCGGCAACGGACCTTACGTTTTCCTCCCCGGGATCCAGATCTCAAGGCTTCAAAAGACACCGCTTCTCATCAATCCAGGGACCACTGTTTTTGAGTTTTCAAAAGGCGAGAAGTCGCCGGAGTATTTTATCGGCGTGACGGCGATTAAGATCGTCGAGAAAACACTTCCAATCGATCCAACGCTTTTGAAGATAAACGCAAGTACTGGAATAGGAGGAACCAAAATCAGCTCCGTCAATCCTTACACGGTGTTGGAGTCATCGATCTACAAAGCTTTTACGTCGGAGTTTATTAGACAAGCAGCGGCGAGGAGCATCAAGAGAGTAGCGTCGGTGAAACCGTTCGGCGCGTGTTTCAGCACGAAGAACGTTGGCGTCACGCGCCTAGGATACGCCGTACCGGAGATTCAGCTCGTGCTTCATAGCAAAGACGTCGTTTGGAGAATCTTTGGAGCTAACTCGATGGTGAGTGTCAGTGATGACGTCATCTGTTTGGGTTTCGTTGACGGAGGAGTCAACCCAGGAGCCTCTGTGGTGATCGGAGGGTTCCAGTTGGAGGATAATTTGATCGAATTTGATTTGGCGAGTAACAAATTTGGGTTTAGTTCCACGTTATTGGGCCGTCAAACTAACTGCGCCAACTTTAATTTCACTTCCACTGCTTGATTAAATTTAGTTGATGCACTTTCTCC

SEQ ID NO: 2291 - DNA, 4709 bp, Arabidopsis thaliana
  misc_feature (1)..(4709): Ceres cDNA ID no. 13576283
  misc_feature (1)..(4709): Ceres CLONE  ID no. 1148047
  misc_feature (1)..(4709): Also known as  Ceres CDNA ID no. 23653629
gactgtcttcaacattctctttttctatggctcctctccctttcataccggaacaaacccgttcgcaaacgcgtttatcttcagacacaaagaagaagaacagaaacaagaaaacgtcccaaccaccgcctcaaacgcaaaagataaagcagaagacggtaccatcaacatcatcatcgtcgtcatggagccagataaagaaccttttgagttgcaaacaaatcgaagggccacgagtgcacgaaccatcaaagattacgtcatcatcttgtggctcctctctttgtaagtttagtgatgttatttacggtaatgcccgtgtgattcaccgctccgatcactcccctgagagtagcaatcttggacaagatacccggttgttgacccgaaaacccattagtacccgtggatcttcttcatcggttagatccaacggttgtggcgcttacacgtcatattcaacttccaaagctatgcacttcagaaacctctcaggttgctatgagtgtcacatgattgttgatccaagcaggtatccaatagcaccaagaatatgtgcatgtccacagtgtggggaggtcttccctaagcttgaatcattggagcatcatcaagcagttcgtcacgctgtgtcggagttggggccagaggattcagggagaaacatagtggacatcatcttcaaatctagctggttacgtaaagacagtcccatctacaagatcgaacggatattaaaagtccacaacactcaacgaacgatccaacggtttgaagattgtcgcgacgcagtcaagtcccatgcacatgcctctaccagaaaagaggctcggtccgccgccgacggcaacgagcttctccgcttccactgcaccacagtttcttgctccctcggctcacgcggctcgacctccatttgctccgccatccctggctgccgcgtttgcaccattatccgccatggcttccacgccaaaacggtacgtgtaggcaatggtgaaggaaaagaggagattaagggcgtgaggaccactgcaagcagtggaagagcacacgatgcgttgaggtgttttgaccagcggagggcgatgcttgtttgccgtgtgatcgcgggaagagtgaggcgcgtgcagagtgatgtgccggaagatgaaagtggttctggctcgtatgattcggttgcgggggccgctggggtctacacaaaccttgacgacttggttgtgtataatccaaaagctatacttccttgctttgtagttatctacaaaggaaatgtgtatgatcttgctggcaaccttgattttcagggaatgacagttgaagagttgcaaaacttgatgtcctttagatgctctgcaacagatcaggatatgttgactagagaggtaacatccgaagaaaatcaaaaagtgttgtttgcgatgccaagtaacaagtttccgggtcctgacggttacacaagtgagttctttaaagcgacttggtcaatcactggtcaagacttcatcgctgcaatcaaatcttttttcatcaaaggtttccttcctaaagggctcaatgcaacaatcctagcgctcataccgaaaaaagatgaagctaccttgatgcgagattaccgtcccatttcatgttgtaacgtgatttacaaggtaatctctaaaattatagctaatcgtcttaaagtcatgctgccaacctttatcctccaaaatcaatctgcatttgttagagaaaggctcttgatagaaaatgttcttttggctacggagttagtcaaggactaccacaaagattcaatctctcctcgttgtgcgatgaaaatcgatatatcgaaagcatttgattctgtacaatggcaattcctgttgaacacgttagaagctcttaatttcccggaaaatttttgtcattggataaaactctgtatctcgacagccactttctctgtccaagttaacggcgagctggcgggtttctttggtagtaagagaggcctgagacaaggttgtgctctctctccatacctgtttgttatatgcatgaatgttctgtctcatatgattgatgtagctgcagttcaccgaaacattggctatcaccctaaatgcaagaaactcagcctaactcacttatgttttgcggatgacttaatggtgttcattgatgggcagcagagatcagttgaaggagttatcaatattttcaaggagtttgcgggtaaatcagggctgcacataagtttggagaaatcgaccctttatcttgctggagtttcggagctaaatagaaataacattctctccgctttcccgttcgctagtggtcagttaccggttcgttatttgggacttcctcttctaacgaaacagatgactactgcggactattcgcctcttcttgacaaagtgagatcaaagataagctcttggacagctcgttccctctcctatgcgggacgtctagctcttatcaattccgtgattgtaagtttgtcaaatttttggatgtctgcatataggctgccagcaggatgtataaaagagattgagaagctatgttctgctttcttgtggtctggaccggagcttaaccccaagaaagcaaaaataacatggacttcgctatgtaaactgaaacaagaaggaggattgggtatcaaatctctcttggaagcaaataaagttagttgtttgaagctgatttggagactcgtttctcggcagtcttctttgtgggttaattgggtttggacttatattattcggaagggctcattctggtccgcaaatgatcgttctagtctggggtcttggatgtggaagaagttgcttaagtacagagatgtggctaaatctatgtgtaaggttgagataaaaagtggcagctctacttcgttctggtatgataattggtcacagctagggcaactggttgatgttacaaatgctcgtagaacaatagacatggggataccgttagcagctactgtcgcgactgttttggcttctcacaggaccaaacaccatcgtactgcaatctacaacaagatagaggcagagattcagagtattcttcaacgagagagatcaggggcaccagacatttttctgtggcgatcctcaggtgataatttcagacaaagtttcataacaaaagtcacttggcacaacatccgggttattcacacgcataggcaatggtataagggtgtttggttctcatacaacacacccaaatactctttcctgttgtggcttgcgatccatgatagattatccacgggtgatcggatcaaaaagtggaattccggacaacaagtcaattgcgttctctgcggcaacgtcgaagaatcaagaaatcacttattcttctcttgccattacaccactgcaatttgggataatctaacaaggcgtctcctatctcatgagtactcaactgactgggaccgcctattagctctactctgcagctccacaatgtcaaaggactctctctttctgtttcgctacgtcttccaagcatctctctatcacgtctggcgagaaagaaatgcacgacgtcacggagaagcacattccaccaccactagactcatcaaactcatcgacaaaaccgtgcgaaatagaatcagctctataaacgacgttggtgaccatagctacgacaactgccttagagaccccaatggagctgctcttaggtttgtcaatgttctaatgcttaaaactgttttcattcggaatcagatcataaacactgagtggggaggattctctaaggttcttccgcagaccatttttgaccaagagatggatgcggaaagcccgaatcgtggtgaacatttatatgagaagatggtctcagggatgtaccttggtgaaattgtgaggagggttttgctccaaatgtgtgaaactagtgacttgttcggtcaattcgttcctggcggcaatctctccaaaccctttgcactcaagaccgagcatctaaacaaaatgcaagaggacactacagatgatcttcagactgttggattagtcctatacaacattttggaggaaaggaggagagtggtggaagtgtgtgacacagtagtgaaacgcggagggcgtctagcaggagctggtgttaatgcacgaattaaacaaaaagggatcaagccacacgtagttcatatcgcgataaacgagctaggccgttactggaggaaggtcttggcgagacacttcggacggacgagtaaacgagctactcaagatggatgggcaaacgaggtacttcggacggacgggcgaacggatgagctacttgacggaccggctggcgagatacttcggacggctgcttgcgacgggcgaactgatgagctacttgaggcggaccggctggcgagatacttcggacggctgcttgagacgggcgaactgatgagctactctttgtctctaagtgtcctcctcgcgagatacttcggacggaagattgaagaagagaccaaaagaatggattcaggtaaaagaaccgttgtggctatggacggttcactctacgagaactacccacagtatcaacagtatatggaagaagcactagtcgagcttcttggcgataatcgaagttacattgtgatcatacatgccaaagacgtatctgggcttggtgctgctcttttggctgctactaactctatttatagtacttga

SEQ ID NO: 2292 - protein, 4709 aa, Arabidopsis thaliana
  misc_feature: PFam Name: RVT_1; PFam Description: Reverse transcriptase
  misc_feature: PFam Name: Hexokinase_2; PFam Description: Hexokinase
  misc_feature: PFam Name: zf-C2H2; PFam Description: Zinc finger, C2H2 type
  misc_feature: GI Number: 4914318; NR Description: F14N23.4 [Arabidopsis thaliana]
  misc_feature: GI Number: 9802582; NR Description: T2E6.3 [Arabidopsis thaliana]
  misc_feature: GI Number: 8843742; NR Description: non-LTR retroelement
  misc_feature: GI Number: 9758853; NR Description: non-LTR retroelement
  misc_feature: GI Number: 25403380; NR Description: protein F17F8.5 [imported] - Arabidopsis thaliana >gi|9755374|gb|AAF98181.1|
GACTGTCTTCAACATTCTCTTTTTCTATGGCTCCTCTCCCTTTCATACCGGAACAAACCCGTTCGCAAACGCGTTTATCTTCAGACACAAAGAAGAAGAACAGAAACAAGAAAACGTCCCAACCACCGCCTCAAACGCAAAAGATAAAGCAGAAGACGGTACCATCAACATCATCATCGTCGTCATGGAGCCAGATAAAGAACCTTTTGAGTTGCAAACAAATCGAAGGGCCACGAGTGCACGAACCATCAAAGATTACGTCATCATCTTGTGGCTCCTCTCTTTGTAAGTTTAGTGATGTTATTTACGGTAATGCCCGTGTGATTCACCGCTCCGATCACTCCCCTGAGAGTAGCAATCTTGGACAAGATACCCGGTTGTTGACCCGAAAACCCATTAGTACCCGTGGATCTTCTTCATCGGTTAGATCCAACGGTTGTGGCGCTTACACGTCATATTCAACTTCCAAAGCTATGCACTTCAGAAACCTCTCAGGTTGCTATGAGTGTCACATGATTGTTGATCCAAGCAGGTATCCAATAGCACCAAGAATATGTGCATGTCCACAGTGTGGGGAGGTCTTCCCTAAGCTTGAATCATTGGAGCATCATCAAGCAGTTCGTCACGCTGTGTCGGAGTTGGGGCCAGAGGATTCAGGGAGAAACATAGTGGACATCATCTTCAAATCTAGCTGGTTACGTAAAGACAGTCCCATCTACAAGATCGAACGGATATTAAAAGTCCACAACACTCAACGAACGATCCAACGGTTTGAAGATTGTCGCGACGCAGTCAAGTCCCATGCACATGCCTCTACCAGAAAAGAGGCTCGGTCCGCCGCCGACGGCAACGAGCTTCTCCGCTTCCACTGCACCACAGTTTCTTGCTCCCTCGGCTCACGCGGCTCGACCTCCATTTGCTCCGCCATCCCTGGCTGCCGCGTTTGCACCATTATCCGCCATGGCTTCCACGCCAAAACGGTACGTGTAGGCAATGGTGAAGGAAAAGAGGAGATTAAGGGCGTGAGGACCACTGCAAGCAGTGGAAGAGCACACGATGCGTTGAGGTGTTTTGACCAGCGGAGGGCGATGCTTGTTTGCCGTGTGATCGCGGGAAGAGTGAGGCGCGTGCAGAGTGATGTGCCGGAAGATGAAAGTGGTTCTGGCTCGTATGATTCGGTTGCGGGGGCCGCTGGGGTCTACACAAACCTTGACGACTTGGTTGTGTATAATCCAAAAGCTATACTTCCTTGCTTTGTAGTTATCTACAAAGGAAATGTGTATGATCTTGCTGGCAACCTTGATTTTCAGGGAATGACAGTTGAAGAGTTGCAAAACTTGATGTCCTTTAGATGCTCTGCAACAGATCAGGATATGTTGACTAGAGAGGTAACATCCGAAGAAAATCAAAAAGTGTTGTTTGCGATGCCAAGTAACAAGTTTCCGGGTCCTGACGGTTACACAAGTGAGTTCTTTAAAGCGACTTGGTCAATCACTGGTCAAGACTTCATCGCTGCAATCAAATCTTTTTTCATCAAAGGTTTCCTTCCTAAAGGGCTCAATGCAACAATCCTAGCGCTCATACCGAAAAAAGATGAAGCTACCTTGATGCGAGATTACCGTCCCATTTCATGTTGTAACGTGATTTACAAGGTAATCTCTAAAATTATAGCTAATCGTCTTAAAGTCATGCTGCCAACCTTTATCCTCCAAAATCAATCTGCATTTGTTAGAGAAAGGCTCTTGATAGAAAATGTTCTTTTGGCTACGGAGTTAGTCAAGGACTACCACAAAGATTCAATCTCTCCTCGTTGTGCGATGAAAATCGATATATCGAAAGCATTTGATTCTGTACAATGGCAATTCCTGTTGAACACGTTAGAAGCTCTTAATTTCCCGGAAAATTTTTGTCATTGGATAAAACTCTGTATCTCGACAGCCACTTTCTCTGTCCAAGTTAACGGCGAGCTGGCGGGTTTCTTTGGTAGTAAGAGAGGCCTGAGACAAGGTTGTGCTCTCTCTCCATACCTGTTTGTTATATGCATGAATGTTCTGTCTCATATGATTGATGTAGCTGCAGTTCACCGAAACATTGGCTATCACCCTAAATGCAAGAAACTCAGCCTAACTCACTTATGTTTTGCGGATGACTTAATGGTGTTCATTGATGGGCAGCAGAGATCAGTTGAAGGAGTTATCAATATTTTCAAGGAGTTTGCGGGTAAATCAGGGCTGCACATAAGTTTGGAGAAATCGACCCTTTATCTTGCTGGAGTTTCGGAGCTAAATAGAAATAACATTCTCTCCGCTTTCCCGTTCGCTAGTGGTCAGTTACCGGTTCGTTATTTGGGACTTCCTCTTCTAACGAAACAGATGACTACTGCGGACTATTCGCCTCTTCTTGACAAAGTGAGATCAAAGATAAGCTCTTGGACAGCTCGTTCCCTCTCCTATGCGGGACGTCTAGCTCTTATCAATTCCGTGATTGTAAGTTTGTCAAATTTTTGGATGTCTGCATATAGGCTGCCAGCAGGATGTATAAAAGAGATTGAGAAGCTATGTTCTGCTTTCTTGTGGTCTGGACCGGAGCTTAACCCCAAGAAAGCAAAAATAACATGGACTTCGCTATGTAAACTGAAACAAGAAGGAGGATTGGGTATCAAATCTCTCTTGGAAGCAAATAAAGTTAGTTGTTTGAAGCTGATTTGGAGACTCGTTTCTCGGCAGTCTTCTTTGTGGGTTAATTGGGTTTGGACTTATATTATTCGGAAGGGCTCATTCTGGTCCGCAAATGATCGTTCTAGTCTGGGGTCTTGGATGTGGAAGAAGTTGCTTAAGTACAGAGATGTGGCTAAATCTATGTGTAAGGTTGAGATAAAAAGTGGCAGCTCTACTTCGTTCTGGTATGATAATTGGTCACAGCTAGGGCAACTGGTTGATGTTACAAATGCTCGTAGAACAATAGACATGGGGATACCGTTAGCAGCTACTGTCGCGACTGTTTTGGCTTCTCACAGGACCAAACACCATCGTACTGCAATCTACAACAAGATAGAGGCAGAGATTCAGAGTATTCTTCAACGAGAGAGATCAGGGGCACCAGACATTTTTCTGTGGCGATCCTCAGGTGATAATTTCAGACAAAGTTTCATAACAAAAGTCACTTGGCACAACATCCGGGTTATTCACACGCATAGGCAATGGTATAAGGGTGTTTGGTTCTCATACAACACACCCAAATACTCTTTCCTGTTGTGGCTTGCGATCCATGATAGATTATCCACGGGTGATCGGATCAAAAAGTGGAATTCCGGACAACAAGTCAATTGCGTTCTCTGCGGCAACGTCGAAGAATCAAGAAATCACTTATTCTTCTCTTGCCATTACACCACTGCAATTTGGGATAATCTAACAAGGCGTCTCCTATCTCATGAGTACTCAACTGACTGGGACCGCCTATTAGCTCTACTCTGCAGCTCCACAATGTCAAAGGACTCTCTCTTTCTGTTTCGCTACGTCTTCCAAGCATCTCTCTATCACGTCTGGCGAGAAAGAAATGCACGACGTCACGGAGAAGCACATTCCACCACCACTAGACTCATCAAACTCATCGACAAAACCGTGCGAAATAGAATCAGCTCTATAAACGACGTTGGTGACCATAGCTACGACAACTGCCTTAGAGACCCCAATGGAGCTGCTCTTAGGTTTGTCAATGTTCTAATGCTTAAAACTGTTTTCATTCGGAATCAGATCATAAACACTGAGTGGGGAGGATTCTCTAAGGTTCTTCCGCAGACCATTTTTGACCAAGAGATGGATGCGGAAAGCCCGAATCGTGGTGAACATTTATATGAGAAGATGGTCTCAGGGATGTACCTTGGTGAAATTGTGAGGAGGGTTTTGCTCCAAATGTGTGAAACTAGTGACTTGTTCGGTCAATTCGTTCCTGGCGGCAATCTCTCCAAACCCTTTGCACTCAAGACCGAGCATCTAAACAAAATGCAAGAGGACACTACAGATGATCTTCAGACTGTTGGATTAGTCCTATACAACATTTTGGAGGAAAGGAGGAGAGTGGTGGAAGTGTGTGACACAGTAGTGAAACGCGGAGGGCGTCTAGCAGGAGCTGGTGTTAATGCACGAATTAAACAAAAAGGGATCAAGCCACACGTAGTTCATATCGCGATAAACGAGCTAGGCCGTTACTGGAGGAAGGTCTTGGCGAGACACTTCGGACGGACGAGTAAACGAGCTACTCAAGATGGATGGGCAAACGAGGTACTTCGGACGGACGGGCGAACGGATGAGCTACTTGACGGACCGGCTGGCGAGATACTTCGGACGGCTGCTTGCGACGGGCGAACTGATGAGCTACTTGAGGCGGACCGGCTGGCGAGATACTTCGGACGGCTGCTTGAGACGGGCGAACTGATGAGCTACTCTTTGTCTCTAAGTGTCCTCCTCGCGAGATACTTCGGACGGAAGATTGAAGAAGAGACCAAAAGAATGGATTCAGGTAAAAGAACCGTTGTGGCTATGGACGGTTCACTCTACGAGAACTACCCACAGTATCAACAGTATATGGAAGAAGCACTAGTCGAGCTTCTTGGCGATAATCGAAGTTACATTGTGATCATACATGCCAAAGACGTATCTGGGCTTGGTGCTGCTCTTTTGGCTGCTACTAACTCTATTTATAGTACTTGA

SEQ ID NO: 2293 - DNA, 789 bp, Arabidopsis thaliana
  misc_feature (1)..(789): Ceres cDNA ID no. 13576485
  misc_feature (1)..(789): Also known as  Ceres CDNA ID no. 23653629
gcaaatcgtaaaccgccacaaaaccgaaaaaaacactaattgtgctttccctttagattcatttgtattttcttttggagcttttgaacaatggagtcatcacaagcaacgacgaagccaacgagaggagcaggaggaaggaaaggtggagataggaagaagagtgttagtaaatctgttaaagctggtcttcaatttcccgttggtcgtatcgctcgttacttgaagaaaggtcggtacgctctccgatacggttccggtgctccggtttacctcgccgccgttctcgaatacctagccgccgaggtacttgagctagctgggaacgcagcgagagataataagaagaacaggataaaccctaggcatctatgtttagcgataaggaacgatgaggaattggggagattgcttcatggagttactattgctagtggtggtgttcttccaaacattaatccagttcttcttcctaagaaatcaacagcttcttcttctcaagcggagaaagcttctgctaccaaatctcctaagaaggcttgataaagaatagtatcgatgttgctttttggttatattcggatcttagatgaagaagaagaagaagaagaaacaacttgttttttgttttagaggatttgtgtaggtatctgaaatcttcttctctttgttttggtttgtcttatgtaaaaaccatgggaagatgattatgtttgttaacgcaatttgtaatggaaaataattaagttctgggattagtaacttcatctgtctaattaatttctgggt

SEQ ID NO: 2294 - protein, 789 aa, Arabidopsis thaliana
  misc_feature: PFam Name: RVT_1; PFam Description: Reverse transcriptase
  misc_feature: PFam Name: Hexokinase_2; PFam Description: Hexokinase
  misc_feature: PFam Name: zf-C2H2; PFam Description: Zinc finger, C2H2 type
  misc_feature: GI Number: 4914318; NR Description: F14N23.4 [Arabidopsis thaliana]
  misc_feature: GI Number: 9802582; NR Description: T2E6.3 [Arabidopsis thaliana]
  misc_feature: GI Number: 8843742; NR Description: non-LTR retroelement
  misc_feature: GI Number: 9758853; NR Description: non-LTR retroelement
  misc_feature: GI Number: 25403380; NR Description: protein F17F8.5 [imported] - Arabidopsis thaliana >gi|9755374|gb|AAF98181.1|
GCAAATCGTAAACCGCCACAAAACCGAAAAAAACACTAATTGTGCTTTCCCTTTAGATTCATTTGTATTTTCTTTTGGAGCTTTTGAACAATGGAGTCATCACAAGCAACGACGAAGCCAACGAGAGGAGCAGGAGGAAGGAAAGGTGGAGATAGGAAGAAGAGTGTTAGTAAATCTGTTAAAGCTGGTCTTCAATTTCCCGTTGGTCGTATCGCTCGTTACTTGAAGAAAGGTCGGTACGCTCTCCGATACGGTTCCGGTGCTCCGGTTTACCTCGCCGCCGTTCTCGAATACCTAGCCGCCGAGGTACTTGAGCTAGCTGGGAACGCAGCGAGAGATAATAAGAAGAACAGGATAAACCCTAGGCATCTATGTTTAGCGATAAGGAACGATGAGGAATTGGGGAGATTGCTTCATGGAGTTACTATTGCTAGTGGTGGTGTTCTTCCAAACATTAATCCAGTTCTTCTTCCTAAGAAATCAACAGCTTCTTCTTCTCAAGCGGAGAAAGCTTCTGCTACCAAATCTCCTAAGAAGGCTTGATAAAGAATAGTATCGATGTTGCTTTTTGGTTATATTCGGATCTTAGATGAAGAAGAAGAAGAAGAAGAAACAACTTGTTTTTTGTTTTAGAGGATTTGTGTAGGTATCTGAAATCTTCTTCTCTTTGTTTTGGTTTGTCTTATGTAAAAACCATGGGAAGATGATTATGTTTGTTAACGCAATTTGTAATGGAAAATAATTAAGTTCTGGGATTAGTAACTTCATCTGTCTAATTAATTTCTGGGT

SEQ ID NO: 2295 - DNA, 1405 bp, Zea mays
  misc_feature (1)..(1405): Ceres cDNA ID no. 13577701
  misc_feature (1)..(1405): Ceres CLONE  ID no. 336101
  misc_feature (1)..(1405): Also known as  Ceres CDNA ID no. 23762253
gcacgagaccattacctagaacatcctaatcgaaaaacccctaggaaacgacgaccgcaactacataccagccagccgacccgacccccagcagtcttgcaggctacagcccctgcggcaccagagggagcggccgcggcagggcgtcctcgtcgccgcggcagggcgctagggcaggcaggcatgcgctgatggaattcacggcccaggagggggaggagcccgtctcggaggagatgggcgcgagctccgcgccgccgccctgcctcggccccggccgcggcacggggaaccagaaccacgccgccgaggcgacgtaccacgagtgtctgcgcaaccacgcggcggcgctgggcggacacgtcgtcgatggctgcggcgagttcatgcccgaggacgccgacaggctcaagtgcgcagcctgcggctgccaccgcagcttccaccgcaagggcgacgcggggcgccgccaccagctcctgctgccgccgcccgccgcggcggtcccgcgcgtcccgctgctcctgcctccgccccacccctacgcggccggctgctgcccacccccactacgcgtcgccgccgctgttcccgtaccacggcacgcccagcggcaccacgaccgagtcgtccagcgaggagcgtggcccgccgtccgggttcgccgccgcgccgcacgcgcacgcgcagggccacgtccggcggaagcggatccggaccaagttcacgccggagcagaaggagcagatgctggcgttcgcggaacgcctcggctggcggatgcagaagcaggacgacgcgctggtgcagcacttctgcgaccaggtcggcgtccggcggcaggtcttcaaggtctggatgcacaacaacaagcacatcggcagcggcggcaggaggcagccgccgccgcacctgccgcctcccgaggggcagcaacagccccagcagccccagtagccacggtgggagacaaggctcagcagtcagcagcaccaccaccaccaccaccatttgcttaatcccccgcctcatttttttatgggctccgagagggggtgtgggattaaacaagggaagtcaggaggggttcctatcctttcttcccttccgtttttgggttcaccttatccttgattttttgtagtcacttcacgtcttcaccatcctcttttgcttcacgattcttgcttgcatatctttggttttattctgttcttactagcttgggggatcaattggaaggaggaggaggcactgtgcatgttttgtagctacaatcctgctaccttattgccatttagcccccttcggcgagcaaggttaaccaatctaaattccgatctatatttccatcttcacttaatctgttaatcaatagcgaatatagccggtggtctctcctccg

SEQ ID NO: 2296 - protein, 1405 aa, Zea mays
  misc_feature: PFam Name: ZF-HD_dimer; PFam Description: ZF-HD protein
  misc_feature: PFam Name: Homeobox; PFam Description: Homeobox domain
  misc_feature: PFam Name: MARCKS; PFam Description: MARCKS family
  misc_feature: PFam Name: HlyD; PFam Description: HlyD family secretion protein
  misc_feature: GI Number: 5091602; NR Description: 10A19I.6 [Oryza sativa
  misc_feature: GI Number: 50251525; NR Description: putative ZF-HD homeobox
  misc_feature: GI Number: 53689757; NR Description: ZF-HD homeobox
  misc_feature: GI Number: 13277220; NR Description: ZF-HD homeobox protein
  misc_feature: GI Number: 62733875; NR Description: ZF-HD protein dimerisation region, putative [Oryza sativa (japonica
GCACGAGACCATTACCTAGAACATCCTAATCGAAAAACCCCTAGGAAACGACGACCGCAACTACATACCAGCCAGCCGACCCGACCCCCAGCAGTCTTGCAGGCTACAGCCCCTGCGGCACCAGAGGGAGCGGCCGCGGCAGGGCGTCCTCGTCGCCGCGGCAGGGCGCTAGGGCAGGCAGGCATGCGCTGATGGAATTCACGGCCCAGGAGGGGGAGGAGCCCGTCTCGGAGGAGATGGGCGCGAGCTCCGCGCCGCCGCCCTGCCTCGGCCCCGGCCGCGGCACGGGGAACCAGAACCACGCCGCCGAGGCGACGTACCACGAGTGTCTGCGCAACCACGCGGCGGCGCTGGGCGGACACGTCGTCGATGGCTGCGGCGAGTTCATGCCCGAGGACGCCGACAGGCTCAAGTGCGCAGCCTGCGGCTGCCACCGCAGCTTCCACCGCAAGGGCGACGCGGGGCGCCGCCACCAGCTCCTGCTGCCGCCGCCCGCCGCGGCGGTCCCGCGCGTCCCGCTGCTCCTGCCTCCGCCCCACCCCTACGCGGCCGGCTGCTGCCCACCCCCACTACGCGTCGCCGCCGCTGTTCCCGTACCACGGCACGCCCAGCGGCACCACGACCGAGTCGTCCAGCGAGGAGCGTGGCCCGCCGTCCGGGTTCGCCGCCGCGCCGCACGCGCACGCGCAGGGCCACGTCCGGCGGAAGCGGATCCGGACCAAGTTCACGCCGGAGCAGAAGGAGCAGATGCTGGCGTTCGCGGAACGCCTCGGCTGGCGGATGCAGAAGCAGGACGACGCGCTGGTGCAGCACTTCTGCGACCAGGTCGGCGTCCGGCGGCAGGTCTTCAAGGTCTGGATGCACAACAACAAGCACATCGGCAGCGGCGGCAGGAGGCAGCCGCCGCCGCACCTGCCGCCTCCCGAGGGGCAGCAACAGCCCCAGCAGCCCCAGTAGCCACGGTGGGAGACAAGGCTCAGCAGTCAGCAGCACCACCACCACCACCACCATTTGCTTAATCCCCCGCCTCATTTTTTTATGGGCTCCGAGAGGGGGTGTGGGATTAAACAAGGGAAGTCAGGAGGGGTTCCTATCCTTTCTTCCCTTCCGTTTTTGGGTTCACCTTATCCTTGATTTTTTGTAGTCACTTCACGTCTTCACCATCCTCTTTTGCTTCACGATTCTTGCTTGCATATCTTTGGTTTTATTCTGTTCTTACTAGCTTGGGGGATCAATTGGAAGGAGGAGGAGGCACTGTGCATGTTTTGTAGCTACAATCCTGCTACCTTATTGCCATTTAGCCCCCTTCGGCGAGCAAGGTTAACCAATCTAAATTCCGATCTATATTTCCATCTTCACTTAATCTGTTAATCAATAGCGAATATAGCCGGTGGTCTCTCCTCCG

SEQ ID NO: 2297 - DNA, 1429 bp, Arabidopsis thaliana
  misc_feature (1)..(1429): Ceres cDNA ID no. 13578582
  misc_feature (1)..(1429): Ceres CLONE  ID no. 1186357
  misc_feature (1)..(1429): Also known as  Ceres CDNA ID no. 23457537
tacacacactctctctttcctctctcttacaccaaaacctatgacgatgaagagagctttaccatctccttcctcactgctcttcttctttctcctgataacaccactcttcctctgccaagaaaacagagtctctgcctcaatgcctccatctgagtcagaaactctcttcaagatcatggaatcaatgtcttctgatcaacaatggcgtcaatcccacccaaacccttgtgcacctggctcatcttggccaggcattgagtgcaaaaccggtccagaccacttatcacacgtctctcgactcgatttcggctctgctccaaacccctcttgtaaatcctctgcttctttcccttcttcaatcttcactctcccttttctccaatcagtcttcttcttcaactgcttcactcacttcccaaccacaatcatgttccctataaaactcatccctaactcttctcttcaacaacttagcctcagatcaaacccttctctctcaggtcaaatccctcctcgcatttcttctctcaaatctttacaaatcctcactctctcacaaaaccgattaaccggagatatccctccggcgattttctcattgaaaagcctcgtacacctcgatctcagctacaacaagctcacaggtaaaatccctctgcaattagggaatctaaataacctcgttggcttagatttaagctacaattctttaaccggtacaatccctccaacgatctctcaactgggtatgcttcagaaactcgacttgagctcaaattctctcttcggaagaatcccggaaggtgtagaaaagcttcgttcgttgtctttcatggcgttgagcaacaacaaactaaagggagcttttccaaaaggaatctcgaaccttcagagtttgcagtacttcataatggataataacccaatgttcgttgctctccccgttgaattagggtttcttcctaaacttcaagagctccagctcgagaattctggatattccggcgtaatcccggagagttacaccaaattgacgaaccttagctcgttgtctcttgctaacaacagattaaccggcgaaatcccatcagggtttgagtctctgccacacgttttccatctgaatctcagcaggaacttactgatcggcgttgttccgtttgattcaagtttcttaagacggttgggtaagaacttggatttgagcgggaacagaggattgtgtctgaatccggaggatgagtttagtgttgtcaagaccggggttgatgtatgcgggaagaacgttagtagtggtggaggtttatcggtgcattcatcgaagaagaaatctcaagcttctcggtattacagatcttgcttcttcgccaatgctctgtttccgtttgctctgtttctaggtttacatcaacgatgggttctctaa

SEQ ID NO: 2298 - protein, 1429 aa, Arabidopsis thaliana
  misc_feature: PFam Name: LRR_1; PFam Description: Leucine Rich Repeat
  misc_feature: GI Number: 48843812; NR Description: putative leucine-rich
  misc_feature: GI Number: 34910824; NR Description: putative Hcr2-0B [Oryza sativa (japonica cultivar-group)] >gi|12328502|dbj|BAB21161.1| putative Hcr2-0B [Oryza sativa (japonica cultivar-group)] >gi|15289814|dbj|BAB63512.1| putative Hcr2-0B [Oryza sativa
  misc_feature: GI Number: 34912808; NR Description: P0501G01.13 [Oryza sativa (japonica cultivar-group)] >gi|12313679|dbj|BAB21084.1|
  misc_feature: GI Number: 34894182; NR Description: P0439B06.12 [Oryza
  misc_feature: GI Number: 15230865; NR Description: leucine rich repeat
TACACACACTCTCTCTTTCCTCTCTCTTACACCAAAACCTATGACGATGAAGAGAGCTTTACCATCTCCTTCCTCACTGCTCTTCTTCTTTCTCCTGATAACACCACTCTTCCTCTGCCAAGAAAACAGAGTCTCTGCCTCAATGCCTCCATCTGAGTCAGAAACTCTCTTCAAGATCATGGAATCAATGTCTTCTGATCAACAATGGCGTCAATCCCACCCAAACCCTTGTGCACCTGGCTCATCTTGGCCAGGCATTGAGTGCAAAACCGGTCCAGACCACTTATCACACGTCTCTCGACTCGATTTCGGCTCTGCTCCAAACCCCTCTTGTAAATCCTCTGCTTCTTTCCCTTCTTCAATCTTCACTCTCCCTTTTCTCCAATCAGTCTTCTTCTTCAACTGCTTCACTCACTTCCCAACCACAATCATGTTCCCTATAAAACTCATCCCTAACTCTTCTCTTCAACAACTTAGCCTCAGATCAAACCCTTCTCTCTCAGGTCAAATCCCTCCTCGCATTTCTTCTCTCAAATCTTTACAAATCCTCACTCTCTCACAAAACCGATTAACCGGAGATATCCCTCCGGCGATTTTCTCATTGAAAAGCCTCGTACACCTCGATCTCAGCTACAACAAGCTCACAGGTAAAATCCCTCTGCAATTAGGGAATCTAAATAACCTCGTTGGCTTAGATTTAAGCTACAATTCTTTAACCGGTACAATCCCTCCAACGATCTCTCAACTGGGTATGCTTCAGAAACTCGACTTGAGCTCAAATTCTCTCTTCGGAAGAATCCCGGAAGGTGTAGAAAAGCTTCGTTCGTTGTCTTTCATGGCGTTGAGCAACAACAAACTAAAGGGAGCTTTTCCAAAAGGAATCTCGAACCTTCAGAGTTTGCAGTACTTCATAATGGATAATAACCCAATGTTCGTTGCTCTCCCCGTTGAATTAGGGTTTCTTCCTAAACTTCAAGAGCTCCAGCTCGAGAATTCTGGATATTCCGGCGTAATCCCGGAGAGTTACACCAAATTGACGAACCTTAGCTCGTTGTCTCTTGCTAACAACAGATTAACCGGCGAAATCCCATCAGGGTTTGAGTCTCTGCCACACGTTTTCCATCTGAATCTCAGCAGGAACTTACTGATCGGCGTTGTTCCGTTTGATTCAAGTTTCTTAAGACGGTTGGGTAAGAACTTGGATTTGAGCGGGAACAGAGGATTGTGTCTGAATCCGGAGGATGAGTTTAGTGTTGTCAAGACCGGGGTTGATGTATGCGGGAAGAACGTTAGTAGTGGTGGAGGTTTATCGGTGCATTCATCGAAGAAGAAATCTCAAGCTTCTCGGTATTACAGATCTTGCTTCTTCGCCAATGCTCTGTTTCCGTTTGCTCTGTTTCTAGGTTTACATCAACGATGGGTTCTCTAA

SEQ ID NO: 2299 - DNA, 1070 bp, Arabidopsis thaliana
  misc_feature (1)..(1070): Ceres cDNA ID no. 13578948
  misc_feature (1)..(1070): Ceres CLONE  ID no. 1206137
  misc_feature (1)..(1070): Also known as  Ceres CDNA ID no. 23655648
aatctcactttttccctttctctgtacatcatcatccttcaagctcggagctctctcttcccgccggcgatctcctccgcttctctccgattttaagtcgatcgaatggggaaaatcaagaaagtgaatcaaaggggtcatattgctacaccgtatccatcaccatgttgtaagaaagaatgggctggctcaacctgtccagtatgcttggagtctccacacaatgcggttcttctcctgtgttcgtcttatcacaaaggatgccgtccttacatgtgtgctacaagcagccgttttgccaactgccttgatcaatacaggaaatcctacggtaacgaaaactcaggacaacccgagcttttgtgtccactgtgtagaggtcaagtgaaaggctggactgttgtgaaagatgctcggatgcattttaactccaagagaaggacttgtatgcaggataactgttcctttttaggaaatttccgaaagctcaagaaacacatgaaggaaaaacacccacatgcttgcccaagagccattgatccagctttagaaactaaatggaagaggcttgagagggaaagagacagaagagacgtgataagcacgataatgtcatcgacaccaggtgctgttgtgttgggagattatgtgatagagccgcataaccgaggtgtttatgatgaagaagacgaagaagaagattacagctcagatgactctctaagcaacgggatactggatctagaatcatcatggcaaggacaaagccatcatattcggtttcttgatatggaatcaagtgacttcgcatcctcttccagctcccctgcttctccaagccgttcgcttcaccgtttgctctttccaaggaaccagagaggcggcaatagaggagcagtataaaaaggctaacatgactagccaattagccatacacagggaattggaaaaaaaaaactcgcagtcgtccctttcttttatttattttcatgtaaattattgtattctgtgtaattgtattattgtttctgcattgttgtactttaatgaggaatgatctcttatgcctc

SEQ ID NO: 2300 - protein, 1070 aa, Arabidopsis thaliana
  misc_feature: GI Number: 34912600; NR Description: P0046B10.17 [Oryza sativa (japonica cultivar-group)] >gi|11034559|dbj|BAB17083.1| P0410E01.4 [Oryza sativa (japonica cultivar-group)] >gi|21104687|dbj|BAB93277.1| P0046B10.17 [Oryza sativa (japonica
  misc_feature: GI Number: 5103842; NR Description: F9L1.39 [Arabidopsis thaliana]
AATCTCACTTTTTCCCTTTCTCTGTACATCATCATCCTTCAAGCTCGGAGCTCTCTCTTCCCGCCGGCGATCTCCTCCGCTTCTCTCCGATTTTAAGTCGATCGAATGGGGAAAATCAAGAAAGTGAATCAAAGGGGTCATATTGCTACACCGTATCCATCACCATGTTGTAAGAAAGAATGGGCTGGCTCAACCTGTCCAGTATGCTTGGAGTCTCCACACAATGCGGTTCTTCTCCTGTGTTCGTCTTATCACAAAGGATGCCGTCCTTACATGTGTGCTACAAGCAGCCGTTTTGCCAACTGCCTTGATCAATACAGGAAATCCTACGGTAACGAAAACTCAGGACAACCCGAGCTTTTGTGTCCACTGTGTAGAGGTCAAGTGAAAGGCTGGACTGTTGTGAAAGATGCTCGGATGCATTTTAACTCCAAGAGAAGGACTTGTATGCAGGATAACTGTTCCTTTTTAGGAAATTTCCGAAAGCTCAAGAAACACATGAAGGAAAAACACCCACATGCTTGCCCAAGAGCCATTGATCCAGCTTTAGAAACTAAATGGAAGAGGCTTGAGAGGGAAAGAGACAGAAGAGACGTGATAAGCACGATAATGTCATCGACACCAGGTGCTGTTGTGTTGGGAGATTATGTGATAGAGCCGCATAACCGAGGTGTTTATGATGAAGAAGACGAAGAAGAAGATTACAGCTCAGATGACTCTCTAAGCAACGGGATACTGGATCTAGAATCATCATGGCAAGGACAAAGCCATCATATTCGGTTTCTTGATATGGAATCAAGTGACTTCGCATCCTCTTCCAGCTCCCCTGCTTCTCCAAGCCGTTCGCTTCACCGTTTGCTCTTTCCAAGGAACCAGAGAGGCGGCAATAGAGGAGCAGTATAAAAAGGCTAACATGACTAGCCAATTAGCCATACACAGGGAATTGGAAAAAAAAAACTCGCAGTCGTCCCTTTCTTTTATTTATTTTCATGTAAATTATTGTATTCTGTGTAATTGTATTATTGTTTCTGCATTGTTGTACTTTAATGAGGAATGATCTCTTATGCCTC

SEQ ID NO: 2301 - DNA, 1437 bp, Arabidopsis thaliana
  misc_feature (1)..(1437): Ceres cDNA ID no. 13579035
  misc_feature (1)..(1437): Ceres CLONE  ID no. 1210127
  misc_feature (1)..(1437): Also known as  Ceres CDNA ID no. 0
gaacacaaaagaaactctcacattctcaagagtttctttcttctttcaatggctttactaactttcttgccggagaacgcagaggcgccacaaaaacacaagccaacgtctagcaaacgaaagaaacgcgataatcccaccgaccaaacgcagacacagaaacataaaccgcagaaaccgaagaaagcagtacctccgaagcagccatcttcatgggaccaaatcaagaacctattgacttgcaaacaaatcgaagggtcaagagtccatgatccttccaagaactctcaatctggtccgtccatgacaactaacttatctccttccaagcttggctcgtcgtgcagctccatttgcagctttagagacgtggctcacggcaacactcgtgtggttcatagagctgatcactcaccagacgtaggtaactcggctactcctaactcggagactcggcttctgactcggaaacctggtcaacacggttcttcttcgtctcggtctcttacatctggctcaacgagatctaacgccagtgggagttacacgtcatcgtcaacgacttcgtttagagccatgcagttccgtaaactctccggatgttacgaatgtcacatgatcgttgacccgagcaggtatccgatttcgcctagggtttgtgcttgttcccaatgtggagaagttttccccaagcttgaaagcttagagcttcatcaagcagttcgtcacgcagtttcggagttaggtccggaggattcgggtcgaaacatagtggagatcatattcaaatcaagctggcttaaaaaagacagtcccatctgtcagatcgaacggatattaaaagtccacaacactcaacgtacgatccaacggtttgaggattgccgagacgcagtgaaggcgcgtgcacttcaagcaaccagaaaagatgctcgttgtgccgccgacggcaacgagctcttacgttttcactgcaccactctcacttgttcactcggagctcgtggctcttcttctctctgctctaacctccctgtttgtggcgtctgcaccgtgattcgccacggtttccaaggaaaatctggtggcggaggagccaacgtcgcaaacgccggtgtgaggacgacggcgagcagcggaagagctgatgatttgctgaggtgtagcgatgatgcgaggagagtgatgcttgtgtgccgtgtgatcgctgggagagttaagcgagttgatttaccggcggcggatgcttcggctacagcggagaagaagtcaacggtggaggataactcggtggttggagtttcttcgagtggtggtacgtttgactcggtggcggtcaatgctggagtttattcgaatcttgaggagcttgtggtttataacccgagagctatattaccttgcttcgtggttatttacaaagttttagaatcttga

SEQ ID NO: 2302 - protein, 1437 aa, Arabidopsis thaliana
GAACACAAAAGAAACTCTCACATTCTCAAGAGTTTCTTTCTTCTTTCAATGGCTTTACTAACTTTCTTGCCGGAGAACGCAGAGGCGCCACAAAAACACAAGCCAACGTCTAGCAAACGAAAGAAACGCGATAATCCCACCGACCAAACGCAGACACAGAAACATAAACCGCAGAAACCGAAGAAAGCAGTACCTCCGAAGCAGCCATCTTCATGGGACCAAATCAAGAACCTATTGACTTGCAAACAAATCGAAGGGTCAAGAGTCCATGATCCTTCCAAGAACTCTCAATCTGGTCCGTCCATGACAACTAACTTATCTCCTTCCAAGCTTGGCTCGTCGTGCAGCTCCATTTGCAGCTTTAGAGACGTGGCTCACGGCAACACTCGTGTGGTTCATAGAGCTGATCACTCACCAGACGTAGGTAACTCGGCTACTCCTAACTCGGAGACTCGGCTTCTGACTCGGAAACCTGGTCAACACGGTTCTTCTTCGTCTCGGTCTCTTACATCTGGCTCAACGAGATCTAACGCCAGTGGGAGTTACACGTCATCGTCAACGACTTCGTTTAGAGCCATGCAGTTCCGTAAACTCTCCGGATGTTACGAATGTCACATGATCGTTGACCCGAGCAGGTATCCGATTTCGCCTAGGGTTTGTGCTTGTTCCCAATGTGGAGAAGTTTTCCCCAAGCTTGAAAGCTTAGAGCTTCATCAAGCAGTTCGTCACGCAGTTTCGGAGTTAGGTCCGGAGGATTCGGGTCGAAACATAGTGGAGATCATATTCAAATCAAGCTGGCTTAAAAAAGACAGTCCCATCTGTCAGATCGAACGGATATTAAAAGTCCACAACACTCAACGTACGATCCAACGGTTTGAGGATTGCCGAGACGCAGTGAAGGCGCGTGCACTTCAAGCAACCAGAAAAGATGCTCGTTGTGCCGCCGACGGCAACGAGCTCTTACGTTTTCACTGCACCACTCTCACTTGTTCACTCGGAGCTCGTGGCTCTTCTTCTCTCTGCTCTAACCTCCCTGTTTGTGGCGTCTGCACCGTGATTCGCCACGGTTTCCAAGGAAAATCTGGTGGCGGAGGAGCCAACGTCGCAAACGCCGGTGTGAGGACGACGGCGAGCAGCGGAAGAGCTGATGATTTGCTGAGGTGTAGCGATGATGCGAGGAGAGTGATGCTTGTGTGCCGTGTGATCGCTGGGAGAGTTAAGCGAGTTGATTTACCGGCGGCGGATGCTTCGGCTACAGCGGAGAAGAAGTCAACGGTGGAGGATAACTCGGTGGTTGGAGTTTCTTCGAGTGGTGGTACGTTTGACTCGGTGGCGGTCAATGCTGGAGTTTATTCGAATCTTGAGGAGCTTGTGGTTTATAACCCGAGAGCTATATTACCTTGCTTCGTGGTTATTTACAAAGTTTTAGAATCTTGA

SEQ ID NO: 2303 - DNA, 1443 bp, Arabidopsis thaliana
  misc_feature (1)..(1443): Ceres cDNA ID no. 13579328
  misc_feature (1)..(1443): Also known as  Ceres CDNA ID no. 0
atcaaagtttgggataatagtcttatctctttcatccacactaatataaataggatacatacacaacacattacaagaagataaatccaaacttttctttctctctctttcgtttcccattttttctcttattactcatagatcctgattgatctgaaaaaatggtgaagaagcaatcgccattacacgttgtcggtgtgtctgttttgatggtgttgttatgcagtgttaattacagtctctgtgaaaagatcaaaacgtataagctcacaagaggaagcttaagtgttactttcactaactatggtgctgtcatgacctctcttctcctccctgacagacatggaaaacaagacgatgttgttcttggatttgatactgttgatggttacaagaatgatacaacatattttggagcaattgtgggaagagtggctaatagaataggaggtgctaaattcaagttaaatggtcatctctacaaaaccgatcccaacgaaggccgtaacactctccatggtggttcaaagggatttagtgatgtgatttggtcagtccaaaagtatgttcccactagtcacattactttcacatacgatagcttcgacggtgaagaaggttttccgggcaatgtgacggtgaaagtgacgtacatgttgatcggagaaaacaaactcggtgtaaaaatggaagcaaagccactcaacaaacctacaccaatcaacttagctctccacacttactggaacctccacagccacaactccgggaacatcctctcccacaaaattcaactcctcgccggaaaaatcactcccgtcgacgacaaactcattcccaccggagaaatcacctccattaccggaactccttacgatttcctcgagccacgtgagatcggtagccggatccacgaattacccggcggttacgacatcaattacgtgatcgacggaccgatcgggaaacatctgaggaaaactgcggttgtgacggagcaagtcaccgggaggaagatggagctgtggacgaatcagcctggtgttcagttttacacgagtaatatgatgaaacgtgtcgtcggtaaaggtaaagccgtttatgagaaatacggtggcttgtgtttggagactcaaggcttcccagattccgtcaatcacaagaactttccgtcgcagattgttaatcccggcgagagttatttgcatgttatgctcttcagattcactgctcactaatcgggtcgggtcgggtcgggtggggtcgggttattagggcttaatatttccgaataaactcgccaacatcgttgtaatgcaaaattgcaaatgccaataaaaatattcgacttttgcaggaagttgttaaaagttgtttattctcaatggttcgttttgcaaattgttaaaaatattatttttcacaagaaagttctaaatgttt

SEQ ID NO: 2304 - protein, 1443 aa, Arabidopsis thaliana
ATCAAAGTTTGGGATAATAGTCTTATCTCTTTCATCCACACTAATATAAATAGGATACATACACAACACATTACAAGAAGATAAATCCAAACTTTTCTTTCTCTCTCTTTCGTTTCCCATTTTTTCTCTTATTACTCATAGATCCTGATTGATCTGAAAAAATGGTGAAGAAGCAATCGCCATTACACGTTGTCGGTGTGTCTGTTTTGATGGTGTTGTTATGCAGTGTTAATTACAGTCTCTGTGAAAAGATCAAAACGTATAAGCTCACAAGAGGAAGCTTAAGTGTTACTTTCACTAACTATGGTGCTGTCATGACCTCTCTTCTCCTCCCTGACAGACATGGAAAACAAGACGATGTTGTTCTTGGATTTGATACTGTTGATGGTTACAAGAATGATACAACATATTTTGGAGCAATTGTGGGAAGAGTGGCTAATAGAATAGGAGGTGCTAAATTCAAGTTAAATGGTCATCTCTACAAAACCGATCCCAACGAAGGCCGTAACACTCTCCATGGTGGTTCAAAGGGATTTAGTGATGTGATTTGGTCAGTCCAAAAGTATGTTCCCACTAGTCACATTACTTTCACATACGATAGCTTCGACGGTGAAGAAGGTTTTCCGGGCAATGTGACGGTGAAAGTGACGTACATGTTGATCGGAGAAAACAAACTCGGTGTAAAAATGGAAGCAAAGCCACTCAACAAACCTACACCAATCAACTTAGCTCTCCACACTTACTGGAACCTCCACAGCCACAACTCCGGGAACATCCTCTCCCACAAAATTCAACTCCTCGCCGGAAAAATCACTCCCGTCGACGACAAACTCATTCCCACCGGAGAAATCACCTCCATTACCGGAACTCCTTACGATTTCCTCGAGCCACGTGAGATCGGTAGCCGGATCCACGAATTACCCGGCGGTTACGACATCAATTACGTGATCGACGGACCGATCGGGAAACATCTGAGGAAAACTGCGGTTGTGACGGAGCAAGTCACCGGGAGGAAGATGGAGCTGTGGACGAATCAGCCTGGTGTTCAGTTTTACACGAGTAATATGATGAAACGTGTCGTCGGTAAAGGTAAAGCCGTTTATGAGAAATACGGTGGCTTGTGTTTGGAGACTCAAGGCTTCCCAGATTCCGTCAATCACAAGAACTTTCCGTCGCAGATTGTTAATCCCGGCGAGAGTTATTTGCATGTTATGCTCTTCAGATTCACTGCTCACTAATCGGGTCGGGTCGGGTCGGGTGGGGTCGGGTTATTAGGGCTTAATATTTCCGAATAAACTCGCCAACATCGTTGTAATGCAAAATTGCAAATGCCAATAAAAATATTCGACTTTTGCAGGAAGTTGTTAAAAGTTGTTTATTCTCAATGGTTCGTTTTGCAAATTGTTAAAAATATTATTTTTCACAAGAAAGTTCTAAATGTTT

SEQ ID NO: 2305 - DNA, 1513 bp, Zea mays
  misc_feature (1)..(1513): Ceres cDNA ID no. 13580212
  misc_feature (1)..(1513): Ceres CLONE  ID no. 441566
  misc_feature (1)..(1513): Also known as  Ceres CDNA ID no. 13580212
aggatgaatcggaagagagaatcctaccaaacctagctaccaactcgatcgtcgtcatcacgctcgaccgcacaactgcaccaaggggggaggagacctaaaaactactacatcttttagctacacatctagctaaagatcgagaggggtaaataaggacgagcgggcgcgagctagaagagcagctgcaggtactaccatcatcgtcgtcgtcgtcgccaggatgaccgtcgtcgacgccgtcgtctcctccaccgatgccggcgcccctgctgccgccgccaccgcggtaccggcggggaacgggcagaccgtgtgcgtgaccggcgcggccgggtacatcgcctcgtggttggtgaagctgctgctcgagaagggatacactgtgaagggcaccgtcaggaacccagatgacccgaagaacgcgcacctcaaggcgctggacggcgccgccgagcggctgatcctctgcaaggccgatctgctggactacgacgccatctgccgcgccgtgcagggctgccagggcgtcttccacaccgcctcccccgtcaccgacgacccggagcaaatggtggagccggcggtgcgcggcaccgagtacgtgatcaacgcggcggcggaggccggcacggtgcggcgggtggtgttcacgtcgtccatcggcgccgtgaccatggaccccaagcgcgggcccgacgtcgtggtcgacgagtcgtgctggagcgacctcgagttctgcgagaaaaccaggaactggtactgctacggcaaggcggtggcggagcacgcggcgtgggagacggcccggcggcggggcgtggacctggtggtggtgaaccccgtgctggtggtgggccccctgctgcaggcgacggtgaacgccagcatcgcgcacatcctcaagtacctggacggctcggcccgcaccttcgccaacgccgtgcaggcgtacgtggacgtgcgcgacgtggccgacgcgcacctccgcgtcttcgagagcccccgcgcgtccggccgccacctctgcgccgagcgcgtcctccaccgcgaggacgtcgtccgcatcctcgccaagctcttccccgagtaccccgtcccagccaggtgctccgacgaggtgaatccgcggaagcagccgtacaagttctccaaccagaagctccgggacctggggctgcagttccggccggtcagccagtcgctttacgacacggtgaagaacctccaggagaagggacacctgccggtgctcggagagcggacgacgacggaggccgccgacaaggatgcccccacggccgagatgcagcagggagggatcgccatccgtgcctgagagggcgatgccacacatgaacacaaagcaatgttcatactgctgccctgcacctgctgtgtaaacaggcctgtgtttgttctggctgatagtgatgtaccctaagacttgtaacgtcatgttcgttcttgtgaactatagcgagtgaataaaattggttaatgttggatgttc

SEQ ID NO: 2306 - protein, 1513 aa, Zea mays
AGGATGAATCGGAAGAGAGAATCCTACCAAACCTAGCTACCAACTCGATCGTCGTCATCACGCTCGACCGCACAACTGCACCAAGGGGGGAGGAGACCTAAAAACTACTACATCTTTTAGCTACACATCTAGCTAAAGATCGAGAGGGGTAAATAAGGACGAGCGGGCGCGAGCTAGAAGAGCAGCTGCAGGTACTACCATCATCGTCGTCGTCGTCGCCAGGATGACCGTCGTCGACGCCGTCGTCTCCTCCACCGATGCCGGCGCCCCTGCTGCCGCCGCCACCGCGGTACCGGCGGGGAACGGGCAGACCGTGTGCGTGACCGGCGCGGCCGGGTACATCGCCTCGTGGTTGGTGAAGCTGCTGCTCGAGAAGGGATACACTGTGAAGGGCACCGTCAGGAACCCAGATGACCCGAAGAACGCGCACCTCAAGGCGCTGGACGGCGCCGCCGAGCGGCTGATCCTCTGCAAGGCCGATCTGCTGGACTACGACGCCATCTGCCGCGCCGTGCAGGGCTGCCAGGGCGTCTTCCACACCGCCTCCCCCGTCACCGACGACCCGGAGCAAATGGTGGAGCCGGCGGTGCGCGGCACCGAGTACGTGATCAACGCGGCGGCGGAGGCCGGCACGGTGCGGCGGGTGGTGTTCACGTCGTCCATCGGCGCCGTGACCATGGACCCCAAGCGCGGGCCCGACGTCGTGGTCGACGAGTCGTGCTGGAGCGACCTCGAGTTCTGCGAGAAAACCAGGAACTGGTACTGCTACGGCAAGGCGGTGGCGGAGCACGCGGCGTGGGAGACGGCCCGGCGGCGGGGCGTGGACCTGGTGGTGGTGAACCCCGTGCTGGTGGTGGGCCCCCTGCTGCAGGCGACGGTGAACGCCAGCATCGCGCACATCCTCAAGTACCTGGACGGCTCGGCCCGCACCTTCGCCAACGCCGTGCAGGCGTACGTGGACGTGCGCGACGTGGCCGACGCGCACCTCCGCGTCTTCGAGAGCCCCCGCGCGTCCGGCCGCCACCTCTGCGCCGAGCGCGTCCTCCACCGCGAGGACGTCGTCCGCATCCTCGCCAAGCTCTTCCCCGAGTACCCCGTCCCAGCCAGGTGCTCCGACGAGGTGAATCCGCGGAAGCAGCCGTACAAGTTCTCCAACCAGAAGCTCCGGGACCTGGGGCTGCAGTTCCGGCCGGTCAGCCAGTCGCTTTACGACACGGTGAAGAACCTCCAGGAGAAGGGACACCTGCCGGTGCTCGGAGAGCGGACGACGACGGAGGCCGCCGACAAGGATGCCCCCACGGCCGAGATGCAGCAGGGAGGGATCGCCATCCGTGCCTGAGAGGGCGATGCCACACATGAACACAAAGCAATGTTCATACTGCTGCCCTGCACCTGCTGTGTAAACAGGCCTGTGTTTGTTCTGGCTGATAGTGATGTACCCTAAGACTTGTAACGTCATGTTCGTTCTTGTGAACTATAGCGAGTGAATAAAATTGGTTAATGTTGGATGTTC

SEQ ID NO: 2307 - DNA, 1093 bp, Arabidopsis thaliana
  misc_feature (1)..(1093): Ceres cDNA ID no. 13580537
  misc_feature (1)..(1093): Ceres CLONE  ID no. 117537
  misc_feature (1)..(1093): Also known as  Ceres CDNA ID no. 23462894
gtttctcaaaaatcaaaatcccttcctctctctctctcaccgagccggcgagcccgttctctcggtgtttttaaagatgcttatgatgatgatggggagtgagtaatatcagaaatcaagctttttcacaatctcagaaattgtagtagagtttggcgattttatcaacctccggaacaagcttcttcttcttcgttttactcttgtcatccgtaaatgggttgtttccattccacggctgccagagaatttcccgatcacgaaaaccctgtgaagcttgcttctgagactgcttttagtgttagtgaagttgaagcattgtatgaattgttcaagagcataagcagctcggttgttgacgatggcttgataaacaaggaagagtttcaacttgctttgttcaagaacagaaagaaagaaaatttgtttgccaataggatatttgatttatttgatgttaaacgaaaaggcgtaattgattttggagactttgtgagatcactcaatgttttccatcctaatgcttccctagaggagaaaacagactttacctttaggctttacgacatggactgcacaggcttcattgagcgccaagaggtgaagcagatgttgattgcacttctctgcgaatctgaaatgaaactggctgatgatacaatagagatgatacttgatcagacatttgaggacgcagatgtggatcgggatggaaagattgataagacagaatggagcaatttcgttatcaaaaacccatctttgcttaaaatcatgactcttccgtatctcagggatataacgacgacatttccgagtttcgtatttaactcggaggtggacgagattgcgacgtgaaagagacaagacaagctggtttatagagaccaagtcgtaggctggaccaagaataaaaagaagattgattccaacaatgttatatagcaggatcgagctctatttcctttggaatttttagtctattggatttcaatttcatgtattgcgattacttttggctctctttctttaacagttttgaatactcaagttgtagttctacgaaaagattaatataaaaccacaatttctg

SEQ ID NO: 2308 - protein, 1093 aa, Arabidopsis thaliana
  misc_feature: PFam Name: efhand; PFam Description: EF hand
  misc_feature: GI Number: 58532581; NR Description: calcineurin B-like
  misc_feature: GI Number: 42572939; NR Description: calcineurin B-like
  misc_feature: GI Number: 66765939; NR Description: calcium sensor
  misc_feature: GI Number: 22137326; NR Description: calcineurin B [Pisum sativum]
  misc_feature: GI Number: 57472399; NR Description: calcineurin B [Pisum sativum] gi|58397762|gb|AAW73072.1| calcineurin B-like protein
GTTTCTCAAAAATCAAAATCCCTTCCTCTCTCTCTCTCACCGAGCCGGCGAGCCCGTTCTCTCGGTGTTTTTAAAGATGCTTATGATGATGATGGGGAGTGAGTAATATCAGAAATCAAGCTTTTTCACAATCTCAGAAATTGTAGTAGAGTTTGGCGATTTTATCAACCTCCGGAACAAGCTTCTTCTTCTTCGTTTTACTCTTGTCATCCGTAAATGGGTTGTTTCCATTCCACGGCTGCCAGAGAATTTCCCGATCACGAAAACCCTGTGAAGCTTGCTTCTGAGACTGCTTTTAGTGTTAGTGAAGTTGAAGCATTGTATGAATTGTTCAAGAGCATAAGCAGCTCGGTTGTTGACGATGGCTTGATAAACAAGGAAGAGTTTCAACTTGCTTTGTTCAAGAACAGAAAGAAAGAAAATTTGTTTGCCAATAGGATATTTGATTTATTTGATGTTAAACGAAAAGGCGTAATTGATTTTGGAGACTTTGTGAGATCACTCAATGTTTTCCATCCTAATGCTTCCCTAGAGGAGAAAACAGACTTTACCTTTAGGCTTTACGACATGGACTGCACAGGCTTCATTGAGCGCCAAGAGGTGAAGCAGATGTTGATTGCACTTCTCTGCGAATCTGAAATGAAACTGGCTGATGATACAATAGAGATGATACTTGATCAGACATTTGAGGACGCAGATGTGGATCGGGATGGAAAGATTGATAAGACAGAATGGAGCAATTTCGTTATCAAAAACCCATCTTTGCTTAAAATCATGACTCTTCCGTATCTCAGGGATATAACGACGACATTTCCGAGTTTCGTATTTAACTCGGAGGTGGACGAGATTGCGACGTGAAAGAGACAAGACAAGCTGGTTTATAGAGACCAAGTCGTAGGCTGGACCAAGAATAAAAAGAAGATTGATTCCAACAATGTTATATAGCAGGATCGAGCTCTATTTCCTTTGGAATTTTTAGTCTATTGGATTTCAATTTCATGTATTGCGATTACTTTTGGCTCTCTTTCTTTAACAGTTTTGAATACTCAAGTTGTAGTTCTACGAAAAGATTAATATAAAACCACAATTTCTG

SEQ ID NO: 2309 - DNA, 1758 bp, Arabidopsis thaliana
  misc_feature (1)..(1758): Ceres cDNA ID no. 13580639
  misc_feature (1)..(1758): Ceres CLONE  ID no. 42298
  misc_feature (1)..(1758): Also known as  Ceres CDNA ID no. 23463155
aaagcttaacaacctccactagagactttcttgagcaaaaaagattggttataaaggaccaaccattgtcatgttattgagtgtcatttttgtgagggagagaattaagagagcaaaatgagcataaataggaatctgttgaatatcataataatcctttgtatatgtctcaatttgggttgtaacgatggagctcaagaaagagagactgattctcatactatccaagtcagctctctcctcccttcatcatcatcatcttgtgttctttctcccagagcgtctactacaaagtcttcactgcacgtgacgcatagacacggcacgtgttcgcgtctaaacaatggcaaggccacgagtccagaccatgtcgagatcctaagactcgaccaggctcgcgtaaactcaatccactcaaaactatcgaagaaactcgcaacagatcacgtcagtgaaagcaagtcaacggatctaccggctaaagacggaagcacactcggttcaggtaactacatcgtgacggtcggcctcgggacaccaaagaacgatctatcactaatcttcgacactggaagcgatttaacgtggactcagtgtcagccatgtgttcgaacttgctatgaccagaaggaaccaatctttaacccttctaagtctacttcttactacaacgtatcctgctcatcggctgcgtgtggttctctctcttctgctacaggaaacgccggaagctgttcggcttcgaattgcatctacggtattcaatacggcgatcaatcgttctccgtcggatttctcgccaaggagaagtttacactaacgaactccgacgtatttgacggcgtttatttcggttgcggcgagaacaaccaaggacttttcaccggtgtcgccggacttctcggtcttggtcgtgacaagctttcgtttccgtcgcagacggcaacggcttacaataagatcttctcttactgcctcccttcctccgctagctacaccggacatctcacattcggatccgccggaatctccagatccgttaaattcacaccaatttcaaccatcactgatggaacttccttctacggccttaatatcgtcgcaatcaccgtcggcggtcagaaattgccgattccttcaactgtattctctactccgggagctttaatcgattccggcaccgttatcactcgtctcccgccgaaagcctacgcggcgttaagaagctcgttcaaggcgaagatgtcaaagtatccgaccacgtcgggcgtctcgatcttggacacgtgtttcgatctcagcgggtttaagacggtgactatcccgaaagtggcgttctctttcagcggtggcgccgtcgtggagcttggttcgaaagggatattttacgtgtttaagatatctcaggtttgtctggcgtttgcagggaatagcgatgacagtaacgctgccatctttggaaacgttcagcagcaaacgctagaagttgtgtatgatggtgcgggtgggcgggtcgggtttgctccaaacgggtgtagttaagttagttaatgaaaaacagaacggggtaaattttaaatttatggatttggcacaaattagctttatccttaatcaagtgtgtaatttgggtaaagatcggaattcgtgatggtctttgaagtaattgtatagtaataagtttgtgtgcatgatacaacaattacaagaacaaactgtttattgtaaaattttattccaatacaactatacaagatg

SEQ ID NO: 2310 - protein, 1758 aa, Arabidopsis thaliana
  misc_feature: PFam Name: Asp; PFam Description: Eukaryotic aspartyl protease
  misc_feature: GI Number: 24111269; NR Description: At5g10770/T30N20_40 [Arabidopsis thaliana] >gi|18700103|gb|AAL77663.1| AT5g10770/T30N20_40 [Arabidopsis thaliana] >gi|22326716|ref|NP_196638.2| chloroplast nucleoid DNA-binding
  misc_feature: GI Number: 8979711; NR Description: nucleoid DNA-binding protein cnd41-like protein [Arabidopsis thaliana] >gi|11358588|pir||T50786 nucleoid DNA-binding protein cnd41-like
  misc_feature: GI Number: 22136986; NR Description: putative nucleoid DNA-binding protein cnd41 [Arabidopsis thaliana] >gi|18176136|gb|AAL59990.1| putative nucleoid DNA-binding protein cnd41 [Arabidopsis thaliana] >gi|8979710|emb|CAB96831.1|
  misc_feature: GI Number: 24417232; NR Description: unknown [Arabidopsis thaliana]
  misc_feature: GI Number: 7489168; NR Description: nucleoid DNA-binding protein cnd41, chloroplast - common tobacco >gi|2541876|dbj|BAA22813.1| CND41, chloroplast nucleoid DNA binding
AAAGCTTAACAACCTCCACTAGAGACTTTCTTGAGCAAAAAAGATTGGTTATAAAGGACCAACCATTGTCATGTTATTGAGTGTCATTTTTGTGAGGGAGAGAATTAAGAGAGCAAAATGAGCATAAATAGGAATCTGTTGAATATCATAATAATCCTTTGTATATGTCTCAATTTGGGTTGTAACGATGGAGCTCAAGAAAGAGAGACTGATTCTCATACTATCCAAGTCAGCTCTCTCCTCCCTTCATCATCATCATCTTGTGTTCTTTCTCCCAGAGCGTCTACTACAAAGTCTTCACTGCACGTGACGCATAGACACGGCACGTGTTCGCGTCTAAACAATGGCAAGGCCACGAGTCCAGACCATGTCGAGATCCTAAGACTCGACCAGGCTCGCGTAAACTCAATCCACTCAAAACTATCGAAGAAACTCGCAACAGATCACGTCAGTGAAAGCAAGTCAACGGATCTACCGGCTAAAGACGGAAGCACACTCGGTTCAGGTAACTACATCGTGACGGTCGGCCTCGGGACACCAAAGAACGATCTATCACTAATCTTCGACACTGGAAGCGATTTAACGTGGACTCAGTGTCAGCCATGTGTTCGAACTTGCTATGACCAGAAGGAACCAATCTTTAACCCTTCTAAGTCTACTTCTTACTACAACGTATCCTGCTCATCGGCTGCGTGTGGTTCTCTCTCTTCTGCTACAGGAAACGCCGGAAGCTGTTCGGCTTCGAATTGCATCTACGGTATTCAATACGGCGATCAATCGTTCTCCGTCGGATTTCTCGCCAAGGAGAAGTTTACACTAACGAACTCCGACGTATTTGACGGCGTTTATTTCGGTTGCGGCGAGAACAACCAAGGACTTTTCACCGGTGTCGCCGGACTTCTCGGTCTTGGTCGTGACAAGCTTTCGTTTCCGTCGCAGACGGCAACGGCTTACAATAAGATCTTCTCTTACTGCCTCCCTTCCTCCGCTAGCTACACCGGACATCTCACATTCGGATCCGCCGGAATCTCCAGATCCGTTAAATTCACACCAATTTCAACCATCACTGATGGAACTTCCTTCTACGGCCTTAATATCGTCGCAATCACCGTCGGCGGTCAGAAATTGCCGATTCCTTCAACTGTATTCTCTACTCCGGGAGCTTTAATCGATTCCGGCACCGTTATCACTCGTCTCCCGCCGAAAGCCTACGCGGCGTTAAGAAGCTCGTTCAAGGCGAAGATGTCAAAGTATCCGACCACGTCGGGCGTCTCGATCTTGGACACGTGTTTCGATCTCAGCGGGTTTAAGACGGTGACTATCCCGAAAGTGGCGTTCTCTTTCAGCGGTGGCGCCGTCGTGGAGCTTGGTTCGAAAGGGATATTTTACGTGTTTAAGATATCTCAGGTTTGTCTGGCGTTTGCAGGGAATAGCGATGACAGTAACGCTGCCATCTTTGGAAACGTTCAGCAGCAAACGCTAGAAGTTGTGTATGATGGTGCGGGTGGGCGGGTCGGGTTTGCTCCAAACGGGTGTAGTTAAGTTAGTTAATGAAAAACAGAACGGGGTAAATTTTAAATTTATGGATTTGGCACAAATTAGCTTTATCCTTAATCAAGTGTGTAATTTGGGTAAAGATCGGAATTCGTGATGGTCTTTGAAGTAATTGTATAGTAATAAGTTTGTGTGCATGATACAACAATTACAAGAACAAACTGTTTATTGTAAAATTTTATTCCAATACAACTATACAAGATG

SEQ ID NO: 2311 - DNA, 1313 bp, Arabidopsis thaliana
  misc_feature (1)..(1313): Ceres cDNA ID no. 13580671
  misc_feature (1)..(1313): Also known as  Ceres CDNA ID no. 23463155
agacaaaacaaacaaacaaaacttcagtctctgcaaagctccatcctttgtggttgtgtcgtagatagccattcgagtggttaaaagttaaaaacttttatgtccacttgaatccttttttgtttctttttggattttatctgatcactcgttttgtgtctctgaatctctatcccgtggattcgcatctggatttgtttttttttcatttttattcgagcggctaacctttctcggatccatctgatatcgattggattctctctaatcaatcgttgaaatggcggatgcgtggaaggatttagcttcagggactgttggaggagctgctcaactagttgttggtcatccatttgacactatcaaggtcaaacttcagagccaaccgactccagcaccaggccaacttccaaggtacaccggtgcaatcgatgcggttaaacagaccgttgcttctgaaggaaccaaaggtttgtataaaggtatgggagctccacttgcaaccgttgctgccttcaatgcggttttgttcactgtgagaggtcaaatggaagggctgcttaggtctgaagctggagttcctttgaccattagtcaacagtttgtggccggtgcaggcgctggtttcgctgtttcgttccttgcttgtcctaccgagttgatcaagtgcaggttgcaagcacaaggtgcattagctggtgcctctactacaagctcagtggttgcagccgtgaaatacggtggaccaatggatgtagcccgtcatgtcctacgatcagaaggaggagcacgaggtctattcaaaggtttattccctacattcgcccgtgaagtcccgggaaatgcaacaatgtttgcagcctacgaagctttcaagcggtttttagccggtggttcagacacttcaagcttaggacaagggtcattgatcatggcgggtggagtcgctggtgcttctttttggggaatagtatatccgacagatgttgtgaagagtgttcttcaagtcgacgattacaaaaacccgagatacacggggtcgatggatgcttttcggaagattctgaaatctgaaggagttaaaggtttgtataaaggatttggtccagctatggctaggagtgttcctgctaatgctgcttgcttcttggcttatgagatgacaaggtcaagcttgggataaaccggttcggtttgggtttaactgttggttcgatttctgaatgttccattgcgattaacctctctgtttttagatttgattcttaaaaaatttctgcaaaatttatgtaccatttacacagtttatttca

SEQ ID NO: 2312 - protein, 1313 aa, Arabidopsis thaliana
  misc_feature: PFam Name: Asp; PFam Description: Eukaryotic aspartyl protease
  misc_feature: GI Number: 24111269; NR Description: At5g10770/T30N20_40 [Arabidopsis thaliana] >gi|18700103|gb|AAL77663.1| AT5g10770/T30N20_40 [Arabidopsis thaliana] >gi|22326716|ref|NP_196638.2| chloroplast nucleoid DNA-binding
  misc_feature: GI Number: 8979711; NR Description: nucleoid DNA-binding protein cnd41-like protein [Arabidopsis thaliana] >gi|11358588|pir||T50786 nucleoid DNA-binding protein cnd41-like
  misc_feature: GI Number: 22136986; NR Description: putative nucleoid DNA-binding protein cnd41 [Arabidopsis thaliana] >gi|18176136|gb|AAL59990.1| putative nucleoid DNA-binding protein cnd41 [Arabidopsis thaliana] >gi|8979710|emb|CAB96831.1|
  misc_feature: GI Number: 24417232; NR Description: unknown [Arabidopsis thaliana]
  misc_feature: GI Number: 7489168; NR Description: nucleoid DNA-binding protein cnd41, chloroplast - common tobacco >gi|2541876|dbj|BAA22813.1| CND41, chloroplast nucleoid DNA binding
AGACAAAACAAACAAACAAAACTTCAGTCTCTGCAAAGCTCCATCCTTTGTGGTTGTGTCGTAGATAGCCATTCGAGTGGTTAAAAGTTAAAAACTTTTATGTCCACTTGAATCCTTTTTTGTTTCTTTTTGGATTTTATCTGATCACTCGTTTTGTGTCTCTGAATCTCTATCCCGTGGATTCGCATCTGGATTTGTTTTTTTTTCATTTTTATTCGAGCGGCTAACCTTTCTCGGATCCATCTGATATCGATTGGATTCTCTCTAATCAATCGTTGAAATGGCGGATGCGTGGAAGGATTTAGCTTCAGGGACTGTTGGAGGAGCTGCTCAACTAGTTGTTGGTCATCCATTTGACACTATCAAGGTCAAACTTCAGAGCCAACCGACTCCAGCACCAGGCCAACTTCCAAGGTACACCGGTGCAATCGATGCGGTTAAACAGACCGTTGCTTCTGAAGGAACCAAAGGTTTGTATAAAGGTATGGGAGCTCCACTTGCAACCGTTGCTGCCTTCAATGCGGTTTTGTTCACTGTGAGAGGTCAAATGGAAGGGCTGCTTAGGTCTGAAGCTGGAGTTCCTTTGACCATTAGTCAACAGTTTGTGGCCGGTGCAGGCGCTGGTTTCGCTGTTTCGTTCCTTGCTTGTCCTACCGAGTTGATCAAGTGCAGGTTGCAAGCACAAGGTGCATTAGCTGGTGCCTCTACTACAAGCTCAGTGGTTGCAGCCGTGAAATACGGTGGACCAATGGATGTAGCCCGTCATGTCCTACGATCAGAAGGAGGAGCACGAGGTCTATTCAAAGGTTTATTCCCTACATTCGCCCGTGAAGTCCCGGGAAATGCAACAATGTTTGCAGCCTACGAAGCTTTCAAGCGGTTTTTAGCCGGTGGTTCAGACACTTCAAGCTTAGGACAAGGGTCATTGATCATGGCGGGTGGAGTCGCTGGTGCTTCTTTTTGGGGAATAGTATATCCGACAGATGTTGTGAAGAGTGTTCTTCAAGTCGACGATTACAAAAACCCGAGATACACGGGGTCGATGGATGCTTTTCGGAAGATTCTGAAATCTGAAGGAGTTAAAGGTTTGTATAAAGGATTTGGTCCAGCTATGGCTAGGAGTGTTCCTGCTAATGCTGCTTGCTTCTTGGCTTATGAGATGACAAGGTCAAGCTTGGGATAAACCGGTTCGGTTTGGGTTTAACTGTTGGTTCGATTTCTGAATGTTCCATTGCGATTAACCTCTCTGTTTTTAGATTTGATTCTTAAAAAATTTCTGCAAAATTTATGTACCATTTACACAGTTTATTTCA

SEQ ID NO: 2313 - DNA, 3362 bp, Arabidopsis thaliana
  misc_feature (1)..(3362): Ceres cDNA ID no. 13580709
  misc_feature (1)..(3362): Also known as  Ceres CDNA ID no. 23463155
ataggaaacttacatcagatcggagaattaccgcatcagactctatggaaactctcaaagaagtatggtccggtgatgcatttgatgcttggaagagtcccaacagtcgtagtttcttcttcggatacagcaagacaagttttgagagttcatgacctccattgttgtactcgtccaagcttgtcagggccaagagagctttcgtacaactatctggacattgctttctctccttatgatgattattggaaagaagttaggaagctctgtgttcaagaacttttcagtactaaacaagttcactcgattcaacctattaaggacgaggaggtcaagaaaatgatcgattcaattgcggaatcagcctctcagaagaatccggttaacttgaacaataagtgtcttgaattaacagtaagtgtagtatgcaggacagcttttggggttagttttgagggaactgtgctcaacagtgacagattcaacaaaatagtccgcgaggcgctcgagatgttgggaagcttttctgccgcggattttattccgtatgtcggatggatcatcgatgtgttgacgggtttgcaaggaaggagagaaagaagcaagagagatctcaatgcattctttgaacaaatgtttgatttgcataaagagggaaagaaagaagggaatgaagattttgtggacttgctcttaaggttggagaaagaagaggcagttcttggaaatgataaacttacaagaaaccatatcaaagcaatcttgctggtaactaaaacaagatttagctaacaatcctttatgtaatgtagtagtaccaaagagtctgatatgttttgaatgagacaggatgttctacttgcgggaatcgatacttctgcaataacaatgacatgggcaatgacagaacttgcaagaaatccacgagtgatgaagaaagttcaatctgaaataagaactcaaatggggaacagatcaatgataagtttcgaagacatggatcagctagagtatctgaaaatggtgatcaaagaaacatggaggctacatcctacaacacctcttttgcttccaagagaagcaatgtctgaatttgatatcaacggctacactattcctgtcaagacacggcttcatgtgaatgtttgggctattggtcgtgatcctgatacttggaaagaccctgaagtgtttctcccggagaggtttatggataataacattgatgcaaaaggacaacattttgagctgttaccgtttgggggcggtcggagaatctgtcctgcaatatacatggggacaacaatggttgagtttggtctagctaatctcttgtatcattttgactggaagttaccagaaggcgtggaggttaaagatatcgacgtggaagaagctcctggactcactgtaaacaagaaaaacgagctcctacttgtgccagagatgagaagatcgtgtggttgagattagagctgactcatcatatcgacggttatgttgttgttcttgtttgacttttcaaacctaaaaagtatatcttatgaatataaaattaagtttaacgttacgtactacgtagcagagaatatatattgtaagataataataattgaagagagcagcaatgtactagtataatataaagactacacttatggagccactttaattgcaattaaatcagaaatgacaaacatttggcttctgtcacttatcttcgtcatttgtattcttgtagccgtgttcaaccacaagaatcggaggaattatcaacggacaccaccgtctcctcctggctgtcctatcatcggaaacttgcatcaactcggagaattaccacatcaatctctatggaaactctccaaaaagtatggccctgtgatgcttttaaagcttggaagagtaccaacagtcatagtttcttcctctgaaacagcaaaacaagctttgaaaatccatgacctccattgttgtagtcgtccaggctttgcaggggcaagagagctctcttacaactatctagacattgctttttctccttatgatgattattggaaagaagtaaggaagctcgctgttcaagaacttttcagtagtaaacaagttcactctatacaaccgataaaggacgaggaggtcaagaaactgatcgattcaatctccgaatcagctgctcagaagactccgatcaacttgaacaagacattgctggctttaactgttagtgtggtctgcaggacagcgtttagtgtgaattttgagggaactgtgctcaacagtgaacgattcaataacatagtccgtgaggcgctcgagatgttgggaagcttttctgcctcagatttcattccgtatgtcggaaggatcatcgacttgttgacgggtttgcaaggacggcgagagagaagcatgagagatctcgatgctttctatgaacaaatgtttgatctgcataaacagaaaaaggaagaaggtagtgaagactttgtggacttgctgttgaggttggagaaagaagaagctgttcttggaaatgacaagctcactagaaaccatatcaaagcgatattgatggatgttcttctagcaggaatggatacttctgcaataaccatgacatgggcaatggcagaactcgcaaagaatccacgagtgatgaaaaaagttcaatccgaaatcagaagtcaaatcaagaacaaagaaagaatcagctttgatgacactgataagcttgagtacctcaaaatggttatcaaagaaacatggaggttacatcctacaacacctcttctaatcccaagggaagcaatgtctgaatttgagatcaacggctacacgattccagttaagacacggcttcacgtgaatgtatgggctattggtcgtgatcccgatacctggaaagaccctgaagtgtttctcccggagaggtttacggataataatattgatgcaaaaggacagcattttgagctgttaccgtttggaggcggccggagaatgtgtcctgcagtttatatggggacaacaatggtcgagtttggtttggctaatcttttgtatcattttgattggaagttaccagaaggcatgaaggttgacgatattgacatggaagaagctcccggactcactgtcaacaagaaaaacgagcttatacttgtgccaacgaagtttctagatccttaaaataatgtcatcacatggaatatataaaaacatcgcatcttcctttgatgtttaatcagacaggacaaaaaaaaagagtttcttctttttaaataaaatgttttaacgcattacgttttgtaatattgtgctctcaagaatttggttctaagatgggatgatcttgtact

SEQ ID NO: 2314 - protein, 3362 aa, Arabidopsis thaliana
  misc_feature: PFam Name: Asp; PFam Description: Eukaryotic aspartyl protease
  misc_feature: GI Number: 24111269; NR Description: At5g10770/T30N20_40 [Arabidopsis thaliana] >gi|18700103|gb|AAL77663.1| AT5g10770/T30N20_40 [Arabidopsis thaliana] >gi|22326716|ref|NP_196638.2| chloroplast nucleoid DNA-binding
  misc_feature: GI Number: 8979711; NR Description: nucleoid DNA-binding protein cnd41-like protein [Arabidopsis thaliana] >gi|11358588|pir||T50786 nucleoid DNA-binding protein cnd41-like
  misc_feature: GI Number: 22136986; NR Description: putative nucleoid DNA-binding protein cnd41 [Arabidopsis thaliana] >gi|18176136|gb|AAL59990.1| putative nucleoid DNA-binding protein cnd41 [Arabidopsis thaliana] >gi|8979710|emb|CAB96831.1|
  misc_feature: GI Number: 24417232; NR Description: unknown [Arabidopsis thaliana]
  misc_feature: GI Number: 7489168; NR Description: nucleoid DNA-binding protein cnd41, chloroplast - common tobacco >gi|2541876|dbj|BAA22813.1| CND41, chloroplast nucleoid DNA binding
ATAGGAAACTTACATCAGATCGGAGAATTACCGCATCAGACTCTATGGAAACTCTCAAAGAAGTATGGTCCGGTGATGCATTTGATGCTTGGAAGAGTCCCAACAGTCGTAGTTTCTTCTTCGGATACAGCAAGACAAGTTTTGAGAGTTCATGACCTCCATTGTTGTACTCGTCCAAGCTTGTCAGGGCCAAGAGAGCTTTCGTACAACTATCTGGACATTGCTTTCTCTCCTTATGATGATTATTGGAAAGAAGTTAGGAAGCTCTGTGTTCAAGAACTTTTCAGTACTAAACAAGTTCACTCGATTCAACCTATTAAGGACGAGGAGGTCAAGAAAATGATCGATTCAATTGCGGAATCAGCCTCTCAGAAGAATCCGGTTAACTTGAACAATAAGTGTCTTGAATTAACAGTAAGTGTAGTATGCAGGACAGCTTTTGGGGTTAGTTTTGAGGGAACTGTGCTCAACAGTGACAGATTCAACAAAATAGTCCGCGAGGCGCTCGAGATGTTGGGAAGCTTTTCTGCCGCGGATTTTATTCCGTATGTCGGATGGATCATCGATGTGTTGACGGGTTTGCAAGGAAGGAGAGAAAGAAGCAAGAGAGATCTCAATGCATTCTTTGAACAAATGTTTGATTTGCATAAAGAGGGAAAGAAAGAAGGGAATGAAGATTTTGTGGACTTGCTCTTAAGGTTGGAGAAAGAAGAGGCAGTTCTTGGAAATGATAAACTTACAAGAAACCATATCAAAGCAATCTTGCTGGTAACTAAAACAAGATTTAGCTAACAATCCTTTATGTAATGTAGTAGTACCAAAGAGTCTGATATGTTTTGAATGAGACAGGATGTTCTACTTGCGGGAATCGATACTTCTGCAATAACAATGACATGGGCAATGACAGAACTTGCAAGAAATCCACGAGTGATGAAGAAAGTTCAATCTGAAATAAGAACTCAAATGGGGAACAGATCAATGATAAGTTTCGAAGACATGGATCAGCTAGAGTATCTGAAAATGGTGATCAAAGAAACATGGAGGCTACATCCTACAACACCTCTTTTGCTTCCAAGAGAAGCAATGTCTGAATTTGATATCAACGGCTACACTATTCCTGTCAAGACACGGCTTCATGTGAATGTTTGGGCTATTGGTCGTGATCCTGATACTTGGAAAGACCCTGAAGTGTTTCTCCCGGAGAGGTTTATGGATAATAACATTGATGCAAAAGGACAACATTTTGAGCTGTTACCGTTTGGGGGCGGTCGGAGAATCTGTCCTGCAATATACATGGGGACAACAATGGTTGAGTTTGGTCTAGCTAATCTCTTGTATCATTTTGACTGGAAGTTACCAGAAGGCGTGGAGGTTAAAGATATCGACGTGGAAGAAGCTCCTGGACTCACTGTAAACAAGAAAAACGAGCTCCTACTTGTGCCAGAGATGAGAAGATCGTGTGGTTGAGATTAGAGCTGACTCATCATATCGACGGTTATGTTGTTGTTCTTGTTTGACTTTTCAAACCTAAAAAGTATATCTTATGAATATAAAATTAAGTTTAACGTTACGTACTACGTAGCAGAGAATATATATTGTAAGATAATAATAATTGAAGAGAGCAGCAATGTACTAGTATAATATAAAGACTACACTTATGGAGCCACTTTAATTGCAATTAAATCAGAAATGACAAACATTTGGCTTCTGTCACTTATCTTCGTCATTTGTATTCTTGTAGCCGTGTTCAACCACAAGAATCGGAGGAATTATCAACGGACACCACCGTCTCCTCCTGGCTGTCCTATCATCGGAAACTTGCATCAACTCGGAGAATTACCACATCAATCTCTATGGAAACTCTCCAAAAAGTATGGCCCTGTGATGCTTTTAAAGCTTGGAAGAGTACCAACAGTCATAGTTTCTTCCTCTGAAACAGCAAAACAAGCTTTGAAAATCCATGACCTCCATTGTTGTAGTCGTCCAGGCTTTGCAGGGGCAAGAGAGCTCTCTTACAACTATCTAGACATTGCTTTTTCTCCTTATGATGATTATTGGAAAGAAGTAAGGAAGCTCGCTGTTCAAGAACTTTTCAGTAGTAAACAAGTTCACTCTATACAACCGATAAAGGACGAGGAGGTCAAGAAACTGATCGATTCAATCTCCGAATCAGCTGCTCAGAAGACTCCGATCAACTTGAACAAGACATTGCTGGCTTTAACTGTTAGTGTGGTCTGCAGGACAGCGTTTAGTGTGAATTTTGAGGGAACTGTGCTCAACAGTGAACGATTCAATAACATAGTCCGTGAGGCGCTCGAGATGTTGGGAAGCTTTTCTGCCTCAGATTTCATTCCGTATGTCGGAAGGATCATCGACTTGTTGACGGGTTTGCAAGGACGGCGAGAGAGAAGCATGAGAGATCTCGATGCTTTCTATGAACAAATGTTTGATCTGCATAAACAGAAAAAGGAAGAAGGTAGTGAAGACTTTGTGGACTTGCTGTTGAGGTTGGAGAAAGAAGAAGCTGTTCTTGGAAATGACAAGCTCACTAGAAACCATATCAAAGCGATATTGATGGATGTTCTTCTAGCAGGAATGGATACTTCTGCAATAACCATGACATGGGCAATGGCAGAACTCGCAAAGAATCCACGAGTGATGAAAAAAGTTCAATCCGAAATCAGAAGTCAAATCAAGAACAAAGAAAGAATCAGCTTTGATGACACTGATAAGCTTGAGTACCTCAAAATGGTTATCAAAGAAACATGGAGGTTACATCCTACAACACCTCTTCTAATCCCAAGGGAAGCAATGTCTGAATTTGAGATCAACGGCTACACGATTCCAGTTAAGACACGGCTTCACGTGAATGTATGGGCTATTGGTCGTGATCCCGATACCTGGAAAGACCCTGAAGTGTTTCTCCCGGAGAGGTTTACGGATAATAATATTGATGCAAAAGGACAGCATTTTGAGCTGTTACCGTTTGGAGGCGGCCGGAGAATGTGTCCTGCAGTTTATATGGGGACAACAATGGTCGAGTTTGGTTTGGCTAATCTTTTGTATCATTTTGATTGGAAGTTACCAGAAGGCATGAAGGTTGACGATATTGACATGGAAGAAGCTCCCGGACTCACTGTCAACAAGAAAAACGAGCTTATACTTGTGCCAACGAAGTTTCTAGATCCTTAAAATAATGTCATCACATGGAATATATAAAAACATCGCATCTTCCTTTGATGTTTAATCAGACAGGACAAAAAAAAAGAGTTTCTTCTTTTTAAATAAAATGTTTTAACGCATTACGTTTTGTAATATTGTGCTCTCAAGAATTTGGTTCTAAGATGGGATGATCTTGTACT

SEQ ID NO: 2315 - DNA, 1471 bp, Zea mays
  misc_feature (1)..(1471): Ceres cDNA ID no. 13585990
  misc_feature (1)..(1471): Ceres CLONE  ID no. 386209
  misc_feature (1)..(1471): Also known as  Ceres CDNA ID no. 0
gattactacgatccaacagttctagagcaagagagaggaagacacaccgcagagttagcaggctaataacttgcaggagcagcaggaatggcggcgacgcgtcgcctctcttgctttctcctcgccgtgcttctggcaggagtggccgctgccaccgccttcgacgaagcggctgctgccggcttcgggcttggccacggcgcgcgtttcgcgcgcaagcatggacgtgctgccgctgagatgccccagccggagccacaacctaaaactaagccggagccccatatgcagccactgccccagccagaacctaaaccgaaacctatgccacatccagagccaaagcctgaacctcaaccaaagcccaaccctgaacctcaaccaatgcccaagcctcaaccaaaatccaaaccagagccattgcctacaccgaagcctgaacctaagcccgaacctaagccagagcctaagcccgaacctaaaataaaaccaaagccaaaacctgaaccaaaaccagagcctaagccagagcataaacctgagccaaagccagagcctaaacccaaaccgaaaccagagccaaagccagagccacaaccaaaaccagagcctaagccagagcctaaacccgaaccgaaaccggagccaaagccagagccccaacctaagccagagcctaagcctgagccgaaaccagaaccaaagccagagccacaaccaaagcctgagcctaaaccagaaccaaaaccagagccaaagccagagcctaagcccgaaccaaaaccagagccaaagcctgagcctaaacccgaaccaaggccagaacctaagccagagccaaagcctgagccgaaaccgaaaccagatccaaagccagagccacaaccaaagccagagcctaagccagaaccaaaaccagagccaaagccagagcctaagcccgaaccaaaaccagagccaaagcctgagcctaaacccgaaccaagaccagaaccagaaccaaagccagagcctaaacctgaaccaaaaccgaaaccagaaccggagccacaaccaaagccagagcctaagcctgatccaaaaccagagcctaaacccgaaccaaaaccagagccccaaccaaaaccagaacctaagcccgaaccaaaaccacagccagaacctaagcccgagcccaaaccaaagcctgaccctccacacatcccaccagcagctatcaactgaggaagtggctattaacaattattgtagtgtttaaataaaatgccatgttgcagcgtgcttttgtaggtgctgctacttgttgtatctatcctatcttttctttgtcattttttgtatgttatgctattatatgatcttagtgcagtttagcttgttccgtgtatacacgcatttatgcactcagtgggtttttgttatatgttggttgttatgtatatatgttcgctgtttcgagcagctaactaac

SEQ ID NO: 2316 - protein, 1471 aa, Zea mays
GATTACTACGATCCAACAGTTCTAGAGCAAGAGAGAGGAAGACACACCGCAGAGTTAGCAGGCTAATAACTTGCAGGAGCAGCAGGAATGGCGGCGACGCGTCGCCTCTCTTGCTTTCTCCTCGCCGTGCTTCTGGCAGGAGTGGCCGCTGCCACCGCCTTCGACGAAGCGGCTGCTGCCGGCTTCGGGCTTGGCCACGGCGCGCGTTTCGCGCGCAAGCATGGACGTGCTGCCGCTGAGATGCCCCAGCCGGAGCCACAACCTAAAACTAAGCCGGAGCCCCATATGCAGCCACTGCCCCAGCCAGAACCTAAACCGAAACCTATGCCACATCCAGAGCCAAAGCCTGAACCTCAACCAAAGCCCAACCCTGAACCTCAACCAATGCCCAAGCCTCAACCAAAATCCAAACCAGAGCCATTGCCTACACCGAAGCCTGAACCTAAGCCCGAACCTAAGCCAGAGCCTAAGCCCGAACCTAAAATAAAACCAAAGCCAAAACCTGAACCAAAACCAGAGCCTAAGCCAGAGCATAAACCTGAGCCAAAGCCAGAGCCTAAACCCAAACCGAAACCAGAGCCAAAGCCAGAGCCACAACCAAAACCAGAGCCTAAGCCAGAGCCTAAACCCGAACCGAAACCGGAGCCAAAGCCAGAGCCCCAACCTAAGCCAGAGCCTAAGCCTGAGCCGAAACCAGAACCAAAGCCAGAGCCACAACCAAAGCCTGAGCCTAAACCAGAACCAAAACCAGAGCCAAAGCCAGAGCCTAAGCCCGAACCAAAACCAGAGCCAAAGCCTGAGCCTAAACCCGAACCAAGGCCAGAACCTAAGCCAGAGCCAAAGCCTGAGCCGAAACCGAAACCAGATCCAAAGCCAGAGCCACAACCAAAGCCAGAGCCTAAGCCAGAACCAAAACCAGAGCCAAAGCCAGAGCCTAAGCCCGAACCAAAACCAGAGCCAAAGCCTGAGCCTAAACCCGAACCAAGACCAGAACCAGAACCAAAGCCAGAGCCTAAACCTGAACCAAAACCGAAACCAGAACCGGAGCCACAACCAAAGCCAGAGCCTAAGCCTGATCCAAAACCAGAGCCTAAACCCGAACCAAAACCAGAGCCCCAACCAAAACCAGAACCTAAGCCCGAACCAAAACCACAGCCAGAACCTAAGCCCGAGCCCAAACCAAAGCCTGACCCTCCACACATCCCACCAGCAGCTATCAACTGAGGAAGTGGCTATTAACAATTATTGTAGTGTTTAAATAAAATGCCATGTTGCAGCGTGCTTTTGTAGGTGCTGCTACTTGTTGTATCTATCCTATCTTTTCTTTGTCATTTTTTGTATGTTATGCTATTATATGATCTTAGTGCAGTTTAGCTTGTTCCGTGTATACACGCATTTATGCACTCAGTGGGTTTTTGTTATATGTTGGTTGTTATGTATATATGTTCGCTGTTTCGAGCAGCTAACTAAC

SEQ ID NO: 2317 - DNA, 1365 bp, Zea mays
  misc_feature (1)..(1365): Ceres cDNA ID no. 13586619
  misc_feature (1)..(1365): Ceres CLONE  ID no. 503491
  misc_feature (1)..(1365): Also known as  Ceres CDNA ID no. 23818918
tcaaaccatcaatcacagagcaactcgaatagcagctccaacaaaagctcaacgcaccagcagcaatggcgtctcgccgtttcttctacgacgacccctacgactactactacacctccccgtaccactacgcctacccctattaccggtaccagcaccccgatccgtcccgcggcgtcggcgggttcttcccggccgccgcagaagccgcgccggaggcggtgaaggtggacccgcggcccagggtcgagtcttcgaggtcggtctccgttcccgtccgcttcgtcggttccgacccggagccggtgcgcggggcggccaggatgccaccggcggcggtgccgaggaagcgggcgccgtcggcggaagcggcggcggtgctgctgcaggccgcggtgcgcgggttcatggcgaggaagtcggtgcgtgctgttcgcgaggtggagcgtgaggcggcggaggtcggcgagaaggttgcgcgcgaggcggaggcgctgcgcggagacgcgagggcgcggatcgccgtcggggaggcgctgatgaagatgctgctgcggctcgatgcggtgcgcggcgcgcgggaataccggaagagggtcaccaagcgggtcctcgcgctgcaggatgctgttgacgccctcgaaccaaagccgacgccggattcggaggtcgtggcggaggagagcgagtctgaggtgacgtccgagatggcggacgacagcgccgaggcgacggagatgccggtcgccgcggagcacagcggcggcattgaggtgaatgcggcggctgagacggttgccgatatggaggtggacgggggcaaagctgacagcgaggcggtgccagaagcggtgaaggaatccgaaaataagcaggacgacgggcacattaacggcgaccagacggaagtctccaatgagggcgaatgggagatggtggcggatgaagcggagcctacaactgcggcgacgggttccaccgaggcgcccccgcagacaccgatgacgagcgaggtgatgaggccgacagtggaggccggagctgccgacagcgccctggacactcggaaggttatggagatggtcgcggccctgtgcgagcagaacgcgcagcagtgcgcggtgatcggggctctggcggagcgcgtggacgcgcttgagcgcgccgtgcggcgggtggaggacgccgagcgccgccgccggcggggcaagaagctgaagaaggatgggaaggggagcaataggtgctacaccgattgaggacagctctgcttcttatttgtttttacatggttagaccaggaaccttcacgagctgtagaatttagttcttgttggccaaaaaaaaaaaaaaaaaggcttggcg

SEQ ID NO: 2318 - protein, 1365 aa, Zea mays
  misc_feature: GI Number: 4185307; NR Description: unknown [Zea mays]
  misc_feature: GI Number: 4185306; NR Description: unknown [Zea mays]
  misc_feature: GI Number: 66776365; NR Description: PE-PGRS family protein [Anaeromyxobacter dehalogenans 2CP-C] >gi|66857891|ref|ZP_00401930.1| PE-PGRS family protein
  misc_feature: GI Number: 66780099; NR Description: PE-PGRS family protein [Anaeromyxobacter dehalogenans 2CP-C] >gi|66854329|ref|ZP_00398411.1| PE-PGRS family protein
  misc_feature: GI Number: 53718532; NR Description: putative lipoprotein [Burkholderia pseudomallei K96243] >gi|52208946|emb|CAH34885.1|
TCAAACCATCAATCACAGAGCAACTCGAATAGCAGCTCCAACAAAAGCTCAACGCACCAGCAGCAATGGCGTCTCGCCGTTTCTTCTACGACGACCCCTACGACTACTACTACACCTCCCCGTACCACTACGCCTACCCCTATTACCGGTACCAGCACCCCGATCCGTCCCGCGGCGTCGGCGGGTTCTTCCCGGCCGCCGCAGAAGCCGCGCCGGAGGCGGTGAAGGTGGACCCGCGGCCCAGGGTCGAGTCTTCGAGGTCGGTCTCCGTTCCCGTCCGCTTCGTCGGTTCCGACCCGGAGCCGGTGCGCGGGGCGGCCAGGATGCCACCGGCGGCGGTGCCGAGGAAGCGGGCGCCGTCGGCGGAAGCGGCGGCGGTGCTGCTGCAGGCCGCGGTGCGCGGGTTCATGGCGAGGAAGTCGGTGCGTGCTGTTCGCGAGGTGGAGCGTGAGGCGGCGGAGGTCGGCGAGAAGGTTGCGCGCGAGGCGGAGGCGCTGCGCGGAGACGCGAGGGCGCGGATCGCCGTCGGGGAGGCGCTGATGAAGATGCTGCTGCGGCTCGATGCGGTGCGCGGCGCGCGGGAATACCGGAAGAGGGTCACCAAGCGGGTCCTCGCGCTGCAGGATGCTGTTGACGCCCTCGAACCAAAGCCGACGCCGGATTCGGAGGTCGTGGCGGAGGAGAGCGAGTCTGAGGTGACGTCCGAGATGGCGGACGACAGCGCCGAGGCGACGGAGATGCCGGTCGCCGCGGAGCACAGCGGCGGCATTGAGGTGAATGCGGCGGCTGAGACGGTTGCCGATATGGAGGTGGACGGGGGCAAAGCTGACAGCGAGGCGGTGCCAGAAGCGGTGAAGGAATCCGAAAATAAGCAGGACGACGGGCACATTAACGGCGACCAGACGGAAGTCTCCAATGAGGGCGAATGGGAGATGGTGGCGGATGAAGCGGAGCCTACAACTGCGGCGACGGGTTCCACCGAGGCGCCCCCGCAGACACCGATGACGAGCGAGGTGATGAGGCCGACAGTGGAGGCCGGAGCTGCCGACAGCGCCCTGGACACTCGGAAGGTTATGGAGATGGTCGCGGCCCTGTGCGAGCAGAACGCGCAGCAGTGCGCGGTGATCGGGGCTCTGGCGGAGCGCGTGGACGCGCTTGAGCGCGCCGTGCGGCGGGTGGAGGACGCCGAGCGCCGCCGCCGGCGGGGCAAGAAGCTGAAGAAGGATGGGAAGGGGAGCAATAGGTGCTACACCGATTGAGGACAGCTCTGCTTCTTATTTGTTTTTACATGGTTAGACCAGGAACCTTCACGAGCTGTAGAATTTAGTTCTTGTTGGCCAAAAAAAAAAAAAAAAAGGCTTGGCG

SEQ ID NO: 2319 - DNA, 528 bp, Zea mays
  misc_feature (1)..(528): Ceres cDNA ID no. 13587492
  misc_feature (1)..(528): Ceres CLONE  ID no. 443343
  misc_feature (1)..(528): Also known as  Ceres CDNA ID no. 23861453
ttgattgagggagatgaagaaatttcagcaatcgttttggacactgtaaagcgtttagcccaaattcctaaaggagctgaagtcatattcccaccagatggtcaaggatctgtgcaacttggtaaagtggcggctcagtcatcttcattggcacggattcgtattctatctttgatagccaagctcttcactgtttcaagttatactgctactgtcattcgtgattcaaaccttctgagcatatttgaagaggaaataaaagatagaagagatatgcttaaaaccctcagtgcgctggaggtcctatatgagcttgttgaacaccctcacagcaacattttcctgctgaagaccaacttgcttcaactcataattgatatcatcaatgattcctcagctgattctgttatacgatcaagggcagcatcagttagtgggaggcttctttcttcagctgatgctttcacagcaatagataaatcctgtgttaccaatctgcttgtagccatagacagaatttttgaagat

SEQ ID NO: 2320 - protein, 528 aa, Zea mays
  misc_feature: GI Number: 30102760; NR Description: At3g15180 [Arabidopsis thaliana] >gi|18400660|ref|NP_566503.1| proteasome-related
  misc_feature: GI Number: 21593496; NR Description: unknown [Arabidopsis thaliana]
TTGATTGAGGGAGATGAAGAAATTTCAGCAATCGTTTTGGACACTGTAAAGCGTTTAGCCCAAATTCCTAAAGGAGCTGAAGTCATATTCCCACCAGATGGTCAAGGATCTGTGCAACTTGGTAAAGTGGCGGCTCAGTCATCTTCATTGGCACGGATTCGTATTCTATCTTTGATAGCCAAGCTCTTCACTGTTTCAAGTTATACTGCTACTGTCATTCGTGATTCAAACCTTCTGAGCATATTTGAAGAGGAAATAAAAGATAGAAGAGATATGCTTAAAACCCTCAGTGCGCTGGAGGTCCTATATGAGCTTGTTGAACACCCTCACAGCAACATTTTCCTGCTGAAGACCAACTTGCTTCAACTCATAATTGATATCATCAATGATTCCTCAGCTGATTCTGTTATACGATCAAGGGCAGCATCAGTTAGTGGGAGGCTTCTTTCTTCAGCTGATGCTTTCACAGCAATAGATAAATCCTGTGTTACCAATCTGCTTGTAGCCATAGACAGAATTTTTGAAGAT

SEQ ID NO: 2321 - DNA, 1706 bp, Arabidopsis thaliana
  misc_feature (1)..(1706): Ceres cDNA ID no. 13588031
  misc_feature (1)..(1706): Also known as  Ceres CDNA ID no. 23861453
gtcgatttctcttatgctcggattgctaaataattttttttattttttttaatggtttgattctataattctgagaggtttttatcatatggtttagtcttttttggcattttatctgaaaatattatcatcatccacgtggcaaatcctcgtcagccggctcacgagaacctcaattatccaatctttgtatgtcacttgagtctctatatatcaaaccaccgaaaagcacgattgtttatcgtagtgcgttacaagcgttttaagctctcactagcaagcaagtactagcaacaatggcgtcaagcactgcgactatgctcaaagcctcaccggtgaaatctgattgggttaagggacagagtcttctcctccgtcaaccttcctctgtctcagctattcgcagccacgtggcaccttccgctctcaccgtccgagccgcttctgcttacgccgatgagctcgtcaaaaccgctaaaacaatcgcgtctccgggacacggaattatggcgatggatgagtccaacgcgacttgtggaaagcgtttggcgtcaattgggctagagaacacggaggctaaccgtcaagcttacaggacgttgcttgtgtcggctccaggacttggacagtacatctccggagctatcctgttcgaggagactctgtaccaatccaccactgatggcaagaaaatggttgatgttctcgtcgagcagaacatcgtccctggcatcaaagtcgacaagggtttggtgccacttgttgggtcttacgacgagtcatggtgccaaggacttgacggtttagcctctcgcaccgctgcttactaccaacaaggtgctcgtttcgccaaatggcgtactgttgtgagcattccaaatggaccctctgctttggctgttaaagaagcagcttggggacttgctcgctacgcagctatttctcaagacagcggtctggtgccgattgtggagccagagattatgttggacggagaacacggcattgacaggacatacgacgttgcagagaaggtttgggctgaggtcttcttctacctcgctcagaacaacgtcatgttcgaaggtattctcctgaagccaagcatggttactccaggagctgaggccacagacagagctactcctgagcaggttgcttcctacactctcaagctccttcgcaacagaatccctcctgctgtccccggaatcatgttcttgtctggtggacagtccgagttggaggcgaccttgaacttgaacgcaatgaaccaggcaccgaacccatggcacgtgtccttctcctacgcacgtgccttgcagaacacttgcttgaagacatggggaggcaaggaagagaacgtgaaggcggctcaggacattctcttggccagagccaaagccaattcgctggctcagctcgggaaatacactggagaaggcgagtctgaggaagccaaggagggtatgtttgtaaaaggctacacctactaagctatttgtaataatggttccatagatcaaaactcaaaaacttgagcttgattctggtcatttgagttattatactcttcttcaggtataaaagtcagttctgtgttatcatgtgagactagttttgtttcttcatggttaatatcttagtacctactcgttactactaataattgagttagtagtctgtttctatcattgttatcactc

SEQ ID NO: 2322 - protein, 1706 aa, Arabidopsis thaliana
  misc_feature: GI Number: 30102760; NR Description: At3g15180 [Arabidopsis thaliana] >gi|18400660|ref|NP_566503.1| proteasome-related
  misc_feature: GI Number: 21593496; NR Description: unknown [Arabidopsis thaliana]
GTCGATTTCTCTTATGCTCGGATTGCTAAATAATTTTTTTTATTTTTTTTAATGGTTTGATTCTATAATTCTGAGAGGTTTTTATCATATGGTTTAGTCTTTTTTGGCATTTTATCTGAAAATATTATCATCATCCACGTGGCAAATCCTCGTCAGCCGGCTCACGAGAACCTCAATTATCCAATCTTTGTATGTCACTTGAGTCTCTATATATCAAACCACCGAAAAGCACGATTGTTTATCGTAGTGCGTTACAAGCGTTTTAAGCTCTCACTAGCAAGCAAGTACTAGCAACAATGGCGTCAAGCACTGCGACTATGCTCAAAGCCTCACCGGTGAAATCTGATTGGGTTAAGGGACAGAGTCTTCTCCTCCGTCAACCTTCCTCTGTCTCAGCTATTCGCAGCCACGTGGCACCTTCCGCTCTCACCGTCCGAGCCGCTTCTGCTTACGCCGATGAGCTCGTCAAAACCGCTAAAACAATCGCGTCTCCGGGACACGGAATTATGGCGATGGATGAGTCCAACGCGACTTGTGGAAAGCGTTTGGCGTCAATTGGGCTAGAGAACACGGAGGCTAACCGTCAAGCTTACAGGACGTTGCTTGTGTCGGCTCCAGGACTTGGACAGTACATCTCCGGAGCTATCCTGTTCGAGGAGACTCTGTACCAATCCACCACTGATGGCAAGAAAATGGTTGATGTTCTCGTCGAGCAGAACATCGTCCCTGGCATCAAAGTCGACAAGGGTTTGGTGCCACTTGTTGGGTCTTACGACGAGTCATGGTGCCAAGGACTTGACGGTTTAGCCTCTCGCACCGCTGCTTACTACCAACAAGGTGCTCGTTTCGCCAAATGGCGTACTGTTGTGAGCATTCCAAATGGACCCTCTGCTTTGGCTGTTAAAGAAGCAGCTTGGGGACTTGCTCGCTACGCAGCTATTTCTCAAGACAGCGGTCTGGTGCCGATTGTGGAGCCAGAGATTATGTTGGACGGAGAACACGGCATTGACAGGACATACGACGTTGCAGAGAAGGTTTGGGCTGAGGTCTTCTTCTACCTCGCTCAGAACAACGTCATGTTCGAAGGTATTCTCCTGAAGCCAAGCATGGTTACTCCAGGAGCTGAGGCCACAGACAGAGCTACTCCTGAGCAGGTTGCTTCCTACACTCTCAAGCTCCTTCGCAACAGAATCCCTCCTGCTGTCCCCGGAATCATGTTCTTGTCTGGTGGACAGTCCGAGTTGGAGGCGACCTTGAACTTGAACGCAATGAACCAGGCACCGAACCCATGGCACGTGTCCTTCTCCTACGCACGTGCCTTGCAGAACACTTGCTTGAAGACATGGGGAGGCAAGGAAGAGAACGTGAAGGCGGCTCAGGACATTCTCTTGGCCAGAGCCAAAGCCAATTCGCTGGCTCAGCTCGGGAAATACACTGGAGAAGGCGAGTCTGAGGAAGCCAAGGAGGGTATGTTTGTAAAAGGCTACACCTACTAAGCTATTTGTAATAATGGTTCCATAGATCAAAACTCAAAAACTTGAGCTTGATTCTGGTCATTTGAGTTATTATACTCTTCTTCAGGTATAAAAGTCAGTTCTGTGTTATCATGTGAGACTAGTTTTGTTTCTTCATGGTTAATATCTTAGTACCTACTCGTTACTACTAATAATTGAGTTAGTAGTCTGTTTCTATCATTGTTATCACTC

SEQ ID NO: 2323 - DNA, 1532 bp, Arabidopsis thaliana
  misc_feature (1)..(1532): Ceres cDNA ID no. 13588277
  misc_feature (1)..(1532): Ceres CLONE  ID no. 1350686
  misc_feature (1)..(1532): Also known as  Ceres CDNA ID no. 13588277
gagtcctcacttctctcacccacaaagtcacagtaaccagaaacacgttccacatcctatgaatccaatcaaacctcagccactcggagtccgccacgtggtggccatgccttggccaggaagaggccacatcaacccaatgttaaacctctgcaaaagcctcgtccggcgagacccaaacctcaccgtcacattcgtcgtcaccgaagaatggctcgggttcatcgggtccgacccgaaacctaaccggatccatttcgccactctccccaacatcattccctccgagctcgtccgagccaacgacttcatcgccttcatcgacgccgtcctcaccagattagaagagccgttcgaacagctacttgaccgtctaaactctcctcccaccgcaatcatcgccgatacttacatcatttgggcagtacgtgtaggcacaaaaaggaatattccggtggcttctttctggactacgtcagccacgattctctccctcttcattaactccgatcttctcgcaagtcacggccattttccgatcgaaccatcagaatcaaaactagacgagattgttgattacatccccggtttatctccgacaagactcagtgacttacagatcttacacggctatagtcatcaagtcttcaatatattcaaaaagtctttcggtgagctttataaagctaagtatcttctcttcccttctgcttatgagctcgaaccaaaagccattgactttttcacttccaagtttgatttcccggtttactccactggtccgttaatacccttggaagaactatccgttggaaatgagaatagagaacttgattactttaagtggcttgatgagcaacctgaaagctctgttctttacatatctcaagggagttttctttcagtctccgaagctcagatggaggagattgttgtaggagttagagaggctggagttaagttcttttgggtggctcgtgggggtgagttaaagcttaaggaggctcttgaaggtagcttgggtgttgtggtgagctggtgtgatcagctacgtgttttgtgtcatgcggctataggcgggttttggacgcattgcgggtataactcgacattggaagggatatgttcgggagtaccgttgcttacatttcctgttttttgggatcagtttctgaatgctaagatgattgttgaggagtggagagttggaatggggatcgagaggaagaagcagatggagttgttgatagtgagtgatgagatcaaggaattggtaaaaaggtttatggatggagagagtgaagaagggaaagagatgagaagaaggacttgtgatctcagtgagatatgtcgtggagcggttgcgaaaggtggttcttctgatgctaacatcgatgctttcattaaagatattactaagatcgtgtgagttctattgttgttaatgattcaagtctatattagtatttgtataagtttgttaaagattcaaactttgtagagatttaagattgtttgtaaaactgttattt

SEQ ID NO: 2324 - protein, 1532 aa, Arabidopsis thaliana
GAGTCCTCACTTCTCTCACCCACAAAGTCACAGTAACCAGAAACACGTTCCACATCCTATGAATCCAATCAAACCTCAGCCACTCGGAGTCCGCCACGTGGTGGCCATGCCTTGGCCAGGAAGAGGCCACATCAACCCAATGTTAAACCTCTGCAAAAGCCTCGTCCGGCGAGACCCAAACCTCACCGTCACATTCGTCGTCACCGAAGAATGGCTCGGGTTCATCGGGTCCGACCCGAAACCTAACCGGATCCATTTCGCCACTCTCCCCAACATCATTCCCTCCGAGCTCGTCCGAGCCAACGACTTCATCGCCTTCATCGACGCCGTCCTCACCAGATTAGAAGAGCCGTTCGAACAGCTACTTGACCGTCTAAACTCTCCTCCCACCGCAATCATCGCCGATACTTACATCATTTGGGCAGTACGTGTAGGCACAAAAAGGAATATTCCGGTGGCTTCTTTCTGGACTACGTCAGCCACGATTCTCTCCCTCTTCATTAACTCCGATCTTCTCGCAAGTCACGGCCATTTTCCGATCGAACCATCAGAATCAAAACTAGACGAGATTGTTGATTACATCCCCGGTTTATCTCCGACAAGACTCAGTGACTTACAGATCTTACACGGCTATAGTCATCAAGTCTTCAATATATTCAAAAAGTCTTTCGGTGAGCTTTATAAAGCTAAGTATCTTCTCTTCCCTTCTGCTTATGAGCTCGAACCAAAAGCCATTGACTTTTTCACTTCCAAGTTTGATTTCCCGGTTTACTCCACTGGTCCGTTAATACCCTTGGAAGAACTATCCGTTGGAAATGAGAATAGAGAACTTGATTACTTTAAGTGGCTTGATGAGCAACCTGAAAGCTCTGTTCTTTACATATCTCAAGGGAGTTTTCTTTCAGTCTCCGAAGCTCAGATGGAGGAGATTGTTGTAGGAGTTAGAGAGGCTGGAGTTAAGTTCTTTTGGGTGGCTCGTGGGGGTGAGTTAAAGCTTAAGGAGGCTCTTGAAGGTAGCTTGGGTGTTGTGGTGAGCTGGTGTGATCAGCTACGTGTTTTGTGTCATGCGGCTATAGGCGGGTTTTGGACGCATTGCGGGTATAACTCGACATTGGAAGGGATATGTTCGGGAGTACCGTTGCTTACATTTCCTGTTTTTTGGGATCAGTTTCTGAATGCTAAGATGATTGTTGAGGAGTGGAGAGTTGGAATGGGGATCGAGAGGAAGAAGCAGATGGAGTTGTTGATAGTGAGTGATGAGATCAAGGAATTGGTAAAAAGGTTTATGGATGGAGAGAGTGAAGAAGGGAAAGAGATGAGAAGAAGGACTTGTGATCTCAGTGAGATATGTCGTGGAGCGGTTGCGAAAGGTGGTTCTTCTGATGCTAACATCGATGCTTTCATTAAAGATATTACTAAGATCGTGTGAGTTCTATTGTTGTTAATGATTCAAGTCTATATTAGTATTTGTATAAGTTTGTTAAAGATTCAAACTTTGTAGAGATTTAAGATTGTTTGTAAAACTGTTATTT

SEQ ID NO: 2325 - DNA, 1422 bp, Arabidopsis thaliana
  misc_feature (1)..(1422): Ceres cDNA ID no. 13588409
  misc_feature (1)..(1422): Ceres CLONE  ID no. 1348204
  misc_feature (1)..(1422): Also known as  Ceres CDNA ID no. 23467940
aaaacccaaaaccaaacaatccaaacaaaaaacaaagctgcaagctttttgctctctctctctgctttcatggcgtcttttactaacctctctcttctcctcctctttctcttcaccgctacactcatcaccagccaacaaagcgacgacgacgaaaatgcgtcaccacaactcgctctagacccgtcggagcaagaagcggtctaccgagttctcgactcagtcaactcagccatctcatggcgaaccatcttccccgacgacatctgcgcttcaccacctgacggcgtcgtttgcgataacctctacgcttctcaaaacggcgtcgcaacgtctgttcacgtcacggagttccatttaggctacctctcggattacactcaaaaccctccttgctcttctaatgccacgcttgatcctctcctctttactgctttcaaacaccttcgtaagcttttcttctacaaatgcttcaccgacgctcgtgcctcgttgccgttaacagtcccggaggatttcggctctgttctcgaagagttggtgttcatcgaaaacccatctctcgtcggcgagatcggagccatgatcggtaatttcacaaagctgagaagattagttcttaccggtaacgggtttcacgggtcaattccgggtcaaatcggcgatttggtgagtctagaggagattacactctccagaaacagcttgaccggtgggtttccggcgaacgcaacgtctcgtctgaagaatctaaaagttctagactttagccataactttatcaacggaaacgcccctgattccatcggagacttgacagagcttctcaagctagacctcagcttcaatgagttcaccggagaggtcccttccggcgtcggaaatttgaaaaagctcgtatttttagacttgagttacaaccgtttcgggaatttcggcgttcctctgtttctagcggagatgtccagtttgagagaggttcatctgagtgggaacaagctcggtggtcgtataccggcgatttggaagaatctcgagggtatttcggggattggattctcaaggatgggtcttgaaggaaacatcccagcttcaatgggttcgagtcttaaaaatctctgctttctagctcttgacaacaacaatctcgacggacaaatcccggaggagtttgggtttctggactctgctcgtgaaatcaatctagagaacaataacctcaccggaaaagctccattctccgacagtttcagagatagaatcgggaaaaagctcaaactgagcgggaatgtaaatctccaagtcaagaattccgatcctcatctcgccggaagagctctatattcatcggcgagaaaggttttacctttgatttacttcccggcgactttattggctctttacatttcaataacacagtga

SEQ ID NO: 2326 - protein, 1422 aa, Arabidopsis thaliana
  misc_feature: PFam Name: LRR_1; PFam Description: Leucine Rich Repeat
  misc_feature: GI Number: 15236148; NR Description: leucine rich repeat
  misc_feature: GI Number: 51535694; NR Description: leucine-rich repeat protein-like [Oryza sativa (japonica cultivar-group)] >gi|51535491|dbj|BAD37387.1| leucine-rich repeat protein-like
  misc_feature: GI Number: 34910824; NR Description: putative Hcr2-0B [Oryza sativa (japonica cultivar-group)] >gi|12328502|dbj|BAB21161.1| putative Hcr2-0B [Oryza sativa (japonica cultivar-group)] >gi|15289814|dbj|BAB63512.1| putative Hcr2-0B [Oryza sativa
  misc_feature: GI Number: 15230865; NR Description: leucine rich repeat
  misc_feature: GI Number: 34912808; NR Description: P0501G01.13 [Oryza sativa (japonica cultivar-group)] >gi|12313679|dbj|BAB21084.1|
AAAACCCAAAACCAAACAATCCAAACAAAAAACAAAGCTGCAAGCTTTTTGCTCTCTCTCTCTGCTTTCATGGCGTCTTTTACTAACCTCTCTCTTCTCCTCCTCTTTCTCTTCACCGCTACACTCATCACCAGCCAACAAAGCGACGACGACGAAAATGCGTCACCACAACTCGCTCTAGACCCGTCGGAGCAAGAAGCGGTCTACCGAGTTCTCGACTCAGTCAACTCAGCCATCTCATGGCGAACCATCTTCCCCGACGACATCTGCGCTTCACCACCTGACGGCGTCGTTTGCGATAACCTCTACGCTTCTCAAAACGGCGTCGCAACGTCTGTTCACGTCACGGAGTTCCATTTAGGCTACCTCTCGGATTACACTCAAAACCCTCCTTGCTCTTCTAATGCCACGCTTGATCCTCTCCTCTTTACTGCTTTCAAACACCTTCGTAAGCTTTTCTTCTACAAATGCTTCACCGACGCTCGTGCCTCGTTGCCGTTAACAGTCCCGGAGGATTTCGGCTCTGTTCTCGAAGAGTTGGTGTTCATCGAAAACCCATCTCTCGTCGGCGAGATCGGAGCCATGATCGGTAATTTCACAAAGCTGAGAAGATTAGTTCTTACCGGTAACGGGTTTCACGGGTCAATTCCGGGTCAAATCGGCGATTTGGTGAGTCTAGAGGAGATTACACTCTCCAGAAACAGCTTGACCGGTGGGTTTCCGGCGAACGCAACGTCTCGTCTGAAGAATCTAAAAGTTCTAGACTTTAGCCATAACTTTATCAACGGAAACGCCCCTGATTCCATCGGAGACTTGACAGAGCTTCTCAAGCTAGACCTCAGCTTCAATGAGTTCACCGGAGAGGTCCCTTCCGGCGTCGGAAATTTGAAAAAGCTCGTATTTTTAGACTTGAGTTACAACCGTTTCGGGAATTTCGGCGTTCCTCTGTTTCTAGCGGAGATGTCCAGTTTGAGAGAGGTTCATCTGAGTGGGAACAAGCTCGGTGGTCGTATACCGGCGATTTGGAAGAATCTCGAGGGTATTTCGGGGATTGGATTCTCAAGGATGGGTCTTGAAGGAAACATCCCAGCTTCAATGGGTTCGAGTCTTAAAAATCTCTGCTTTCTAGCTCTTGACAACAACAATCTCGACGGACAAATCCCGGAGGAGTTTGGGTTTCTGGACTCTGCTCGTGAAATCAATCTAGAGAACAATAACCTCACCGGAAAAGCTCCATTCTCCGACAGTTTCAGAGATAGAATCGGGAAAAAGCTCAAACTGAGCGGGAATGTAAATCTCCAAGTCAAGAATTCCGATCCTCATCTCGCCGGAAGAGCTCTATATTCATCGGCGAGAAAGGTTTTACCTTTGATTTACTTCCCGGCGACTTTATTGGCTCTTTACATTTCAATAACACAGTGA

SEQ ID NO: 2327 - DNA, 1194 bp, Arabidopsis thaliana
  misc_feature (1)..(1194): Ceres cDNA ID no. 13588747
  misc_feature (1)..(1194): Ceres CLONE  ID no. 1337097
  misc_feature (1)..(1194): Also known as  Ceres CDNA ID no. 23468191
gatccctcgtaactcctatagaaaaacagaagtaaaacaaaaataaaataaaaacacaaagatggagtgctatgagcagagtcgtcagagagctgcgttcgttgtgctgttgtttatcgttatgttgggatcccaggcacaggcccaactacgcactgacttctattcggacagctgtccatcactgctccctacggtgaggcgggtggtgcagcgagaggtggccaaagagcgtcggatagctgcttccctcctccgactattcttccatgattgcttcgtcaacggctgtgatgcgtcaatattattggatgatacacgttcattcctcggagaaaagacggctggacctaacaataattccgttcgaggatatgaagtcatcgacgcaatcaaatcaagggttgagagactctgcccaggcgtggtgtcatgcgctgacatcctggcaatcacggctcgggactcggtccttctaatgggtggccgcggctggagcgtaaaactagggagacgtgattctatcacggcgagcttctccactgctaactccggcgtcctgccacctccaacctctactcttgataaccttattaaccttttccgagcaaacggtttatccccacgcgacatggtggcgctctccggggctcacaccattgggcaagccaggtgcgtcaccttcaggagccggatatataactcaacaaacatcgacctttcatttgccttatccagacggaggagctgccctgcggcaactggctccggcgataacaacgccgccattctcgatctccgcacacctgaaaagttcgacggcagctacttcatgcagcttgtcaaccacaggggacttctcacatcagatcaggtcttgttcaacggaggttccaccgactcgatcgtcgtatcctacagccggagtgtccaagcattctacagagattttgtagcggcgatgataaaaatgggcgacatcagcccactcaccgggtccaatggacagatccgtcgcagctgtcgcaggcccaactaaaatagtctctactattaagcccataataatctcttagtgaactgtttttttcttattttaatgtgcatcattctgatgttattgcgatatgtcaattaattaaaccggaaatatctattgtttaatcgatataatatataatataattaagtaac

SEQ ID NO: 2328 - protein, 1194 aa, Arabidopsis thaliana
  misc_feature: PFam Name: peroxidase; PFam Description: Peroxidase
  misc_feature: GI Number: 30793803; NR Description: putative peroxidase [Arabidopsis thaliana] >gi|8777341|dbj|BAA96931.1| peroxidase [Arabidopsis thaliana] >gi|26451590|dbj|BAC42892.1| putative peroxidase [Arabidopsis thaliana]
  misc_feature: GI Number: 8777340; NR Description: peroxidase [Arabidopsis thaliana] >gi|26397866|sp|Q9LVL2|PE67_ARATH Peroxidase 67 precursor (Atperox P67) (ATP44) >gi|15237187|ref|NP_200647.1| peroxidase,
  misc_feature: GI Number: 21537247; NR Description: peroxidase [Arabidopsis
  misc_feature: GI Number: 19698446; NR Description: class III peroxidase
  misc_feature: GI Number: 32351452; NR Description: class III peroxidase
GATCCCTCGTAACTCCTATAGAAAAACAGAAGTAAAACAAAAATAAAATAAAAACACAAAGATGGAGTGCTATGAGCAGAGTCGTCAGAGAGCTGCGTTCGTTGTGCTGTTGTTTATCGTTATGTTGGGATCCCAGGCACAGGCCCAACTACGCACTGACTTCTATTCGGACAGCTGTCCATCACTGCTCCCTACGGTGAGGCGGGTGGTGCAGCGAGAGGTGGCCAAAGAGCGTCGGATAGCTGCTTCCCTCCTCCGACTATTCTTCCATGATTGCTTCGTCAACGGCTGTGATGCGTCAATATTATTGGATGATACACGTTCATTCCTCGGAGAAAAGACGGCTGGACCTAACAATAATTCCGTTCGAGGATATGAAGTCATCGACGCAATCAAATCAAGGGTTGAGAGACTCTGCCCAGGCGTGGTGTCATGCGCTGACATCCTGGCAATCACGGCTCGGGACTCGGTCCTTCTAATGGGTGGCCGCGGCTGGAGCGTAAAACTAGGGAGACGTGATTCTATCACGGCGAGCTTCTCCACTGCTAACTCCGGCGTCCTGCCACCTCCAACCTCTACTCTTGATAACCTTATTAACCTTTTCCGAGCAAACGGTTTATCCCCACGCGACATGGTGGCGCTCTCCGGGGCTCACACCATTGGGCAAGCCAGGTGCGTCACCTTCAGGAGCCGGATATATAACTCAACAAACATCGACCTTTCATTTGCCTTATCCAGACGGAGGAGCTGCCCTGCGGCAACTGGCTCCGGCGATAACAACGCCGCCATTCTCGATCTCCGCACACCTGAAAAGTTCGACGGCAGCTACTTCATGCAGCTTGTCAACCACAGGGGACTTCTCACATCAGATCAGGTCTTGTTCAACGGAGGTTCCACCGACTCGATCGTCGTATCCTACAGCCGGAGTGTCCAAGCATTCTACAGAGATTTTGTAGCGGCGATGATAAAAATGGGCGACATCAGCCCACTCACCGGGTCCAATGGACAGATCCGTCGCAGCTGTCGCAGGCCCAACTAAAATAGTCTCTACTATTAAGCCCATAATAATCTCTTAGTGAACTGTTTTTTTCTTATTTTAATGTGCATCATTCTGATGTTATTGCGATATGTCAATTAATTAAACCGGAAATATCTATTGTTTAATCGATATAATATATAATATAATTAAGTAAC

SEQ ID NO: 2329 - DNA, 1220 bp, Arabidopsis thaliana
  misc_feature (1)..(1220): Ceres cDNA ID no. 13588846
  misc_feature (1)..(1220): Ceres CLONE  ID no. 1340755
  misc_feature (1)..(1220): Also known as  Ceres CDNA ID no. 23468317
aatcgatctcaaccgtccgatcatccatcttgccatcaccgttcaccaatcttcttcgtctcctctctctttctctctttttgctgtttctagctcctctctctctggatctcgccggcgaaccgtttctcttgggtgtaaacagtagcaatcaagctatagaatctcagatatcgctgaattagctgttggattttatccgccttttcttcgttatccggggctcgggtataaggtttcatcgtcttatttcatctgtaaatgggctgcttccactcaaaggcagcaaaagaatttcgaggacacgaagaccctgttaagcttgcctctgagacagcttttagtgtgagtgaggttgaagcattatttgagctattcaagagcataagcagttcggttgttgatgatggtctgattaacaaggaggagtttcaacttgctttgttcaaaagccggaagagggagaatatatttgctaataggatatttgatatgtttgatgttaaacgaaaaggagtcatcgatttcggggactttgtaagatcactcaatgttttccaccccaatgcttctctagaagacaaaatagattttacgtttaggctttacgacatggactgcacgggttacattgaacgacaagaggtcaagcaaatgttgatcgcgcttctctgcgaatctgaaatgaaactggctgatgaaaccatagagataatactcgataagacatttgaagatgcagacgtgaatcaagatggaaaaattgataaattagagtggagtgatttcgtaaacaaaaatccatcattgcttaagatcatgactcttccatatctcagggatattacgacaacgtttccgagttttgtcttccattcggaggtcgatgagattgccacatgaagaaacaaactggtttaagaccgagtagattgccacgagttggaagaacaagtctgagctaatcggtgtaatcaacatctgtttgtaaacagtagtagagcatattctcttgaaattgtttgggttacttttttcttctcacaacagtttaaaattttgggtttttagcttacaaaaaaaaaaaaaagaagaagcgcgtaatcaccaatccttcacttcatatagttaggaaatgttaatgagtttgtacatattacatcatacgtttgttgtaattgttttttttcaagtaaaaaagtaaagatttgttacgtttc

SEQ ID NO: 2330 - protein, 1220 aa, Arabidopsis thaliana
  misc_feature: PFam Name: efhand; PFam Description: EF hand
  misc_feature: GI Number: 58532581; NR Description: calcineurin B-like
  misc_feature: GI Number: 42572939; NR Description: calcineurin B-like
  misc_feature: GI Number: 66765939; NR Description: calcium sensor
  misc_feature: GI Number: 22137326; NR Description: calcineurin B [Pisum sativum]
  misc_feature: GI Number: 57472399; NR Description: calcineurin B [Pisum sativum] gi|58397762|gb|AAW73072.1| calcineurin B-like protein
AATCGATCTCAACCGTCCGATCATCCATCTTGCCATCACCGTTCACCAATCTTCTTCGTCTCCTCTCTCTTTCTCTCTTTTTGCTGTTTCTAGCTCCTCTCTCTCTGGATCTCGCCGGCGAACCGTTTCTCTTGGGTGTAAACAGTAGCAATCAAGCTATAGAATCTCAGATATCGCTGAATTAGCTGTTGGATTTTATCCGCCTTTTCTTCGTTATCCGGGGCTCGGGTATAAGGTTTCATCGTCTTATTTCATCTGTAAATGGGCTGCTTCCACTCAAAGGCAGCAAAAGAATTTCGAGGACACGAAGACCCTGTTAAGCTTGCCTCTGAGACAGCTTTTAGTGTGAGTGAGGTTGAAGCATTATTTGAGCTATTCAAGAGCATAAGCAGTTCGGTTGTTGATGATGGTCTGATTAACAAGGAGGAGTTTCAACTTGCTTTGTTCAAAAGCCGGAAGAGGGAGAATATATTTGCTAATAGGATATTTGATATGTTTGATGTTAAACGAAAAGGAGTCATCGATTTCGGGGACTTTGTAAGATCACTCAATGTTTTCCACCCCAATGCTTCTCTAGAAGACAAAATAGATTTTACGTTTAGGCTTTACGACATGGACTGCACGGGTTACATTGAACGACAAGAGGTCAAGCAAATGTTGATCGCGCTTCTCTGCGAATCTGAAATGAAACTGGCTGATGAAACCATAGAGATAATACTCGATAAGACATTTGAAGATGCAGACGTGAATCAAGATGGAAAAATTGATAAATTAGAGTGGAGTGATTTCGTAAACAAAAATCCATCATTGCTTAAGATCATGACTCTTCCATATCTCAGGGATATTACGACAACGTTTCCGAGTTTTGTCTTCCATTCGGAGGTCGATGAGATTGCCACATGAAGAAACAAACTGGTTTAAGACCGAGTAGATTGCCACGAGTTGGAAGAACAAGTCTGAGCTAATCGGTGTAATCAACATCTGTTTGTAAACAGTAGTAGAGCATATTCTCTTGAAATTGTTTGGGTTACTTTTTTCTTCTCACAACAGTTTAAAATTTTGGGTTTTTAGCTTACAAAAAAAAAAAAAAGAAGAAGCGCGTAATCACCAATCCTTCACTTCATATAGTTAGGAAATGTTAATGAGTTTGTACATATTACATCATACGTTTGTTGTAATTGTTTTTTTTCAAGTAAAAAAGTAAAGATTTGTTACGTTTC

SEQ ID NO: 2331 - DNA, 1431 bp, Arabidopsis thaliana
  misc_feature (1)..(1431): Ceres cDNA ID no. 13588866
  misc_feature (1)..(1431): Ceres CLONE  ID no. 1347909
  misc_feature (1)..(1431): Also known as  Ceres CDNA ID no. 13588866
ggtcgacgtcgatggggatgagaagtagtggagaatccgctcacattgggattcgtcattcttcttctaaaacccgcaaaatttctccatttctaccaaaaatatccaacttttacttttctttcctgtgaaattatctgctcaaatctttggttcctgacggagatggcggcgatttcaggcatctcctctggtacgttgacgatttcacggcctttggttactcttcgacgctctagagccgccgtttcgtacagctcctctcaccgattgcttcatcatcttcctctctcttctcgtcgtctgctattaaggaacaatcatcgagtccaagcaacgattttgcaagacgatgaagagaaagtggtggtggaggaatcgtttaaagccgagacttctactggtacagaaccacttgaggagccaaatatgagttcttcttcaactagtgcttttgagacatggatcatcaagcttgagcaaggagtgaatgttttccttacagactcggttattaagatacttgacactttgtatcgtgaccgaacatatgcaaggttctttgttcttgagacaattgctagagtgccttattttgcgtttatgtctgtgctacatatgtatgagacctttggttggtggaggagagcagattatttgaaagtacactttgctgagagctggaatgaaatgcatcacttgctcataatggaagaattgggtggaaattcttggtggtttgatcgttttctggctcagcacatagcaaccttctactacttcatgacagtgttcttgtatatcttaagccctagaatggcatatcacttttcggaatgtgtggagagtcatgcatatgagacttatgataaatttctcaaggccagtggagaggagttgaagaatatgcctgcaccggatatcgcagtaaaatactatacgggaggtgacttgtacttatttgatgagttccaaacatcaagaactcccaatactcgaagaccagtaatagaaaatctatacgatgtgtttgtgaacataagagatgatgaagcagaacactgcaagacaatgagagcttgtcagactctaggcagtctgcgttctccacactccattttagaagatgatgatactgaagaagaatcagggtgtgttgttcctgaggaggctcattgcgaaggtattgtagactgcctcaagaaatccattacaagttaataaattagaaagtaaactaaaaaagattatttgtatcagctcatgaacaatagatataatcccatatacttgggaataaaggaataatgtgaaattcccatcgttgtgctagtgtgtgagagaatcaaataccctaatgatgtaaatgtactttgatgagcttaagtcgttgtagaccattttatccatactactagcctttgtggttgc

SEQ ID NO: 2332 - protein, 1431 aa, Arabidopsis thaliana
GGTCGACGTCGATGGGGATGAGAAGTAGTGGAGAATCCGCTCACATTGGGATTCGTCATTCTTCTTCTAAAACCCGCAAAATTTCTCCATTTCTACCAAAAATATCCAACTTTTACTTTTCTTTCCTGTGAAATTATCTGCTCAAATCTTTGGTTCCTGACGGAGATGGCGGCGATTTCAGGCATCTCCTCTGGTACGTTGACGATTTCACGGCCTTTGGTTACTCTTCGACGCTCTAGAGCCGCCGTTTCGTACAGCTCCTCTCACCGATTGCTTCATCATCTTCCTCTCTCTTCTCGTCGTCTGCTATTAAGGAACAATCATCGAGTCCAAGCAACGATTTTGCAAGACGATGAAGAGAAAGTGGTGGTGGAGGAATCGTTTAAAGCCGAGACTTCTACTGGTACAGAACCACTTGAGGAGCCAAATATGAGTTCTTCTTCAACTAGTGCTTTTGAGACATGGATCATCAAGCTTGAGCAAGGAGTGAATGTTTTCCTTACAGACTCGGTTATTAAGATACTTGACACTTTGTATCGTGACCGAACATATGCAAGGTTCTTTGTTCTTGAGACAATTGCTAGAGTGCCTTATTTTGCGTTTATGTCTGTGCTACATATGTATGAGACCTTTGGTTGGTGGAGGAGAGCAGATTATTTGAAAGTACACTTTGCTGAGAGCTGGAATGAAATGCATCACTTGCTCATAATGGAAGAATTGGGTGGAAATTCTTGGTGGTTTGATCGTTTTCTGGCTCAGCACATAGCAACCTTCTACTACTTCATGACAGTGTTCTTGTATATCTTAAGCCCTAGAATGGCATATCACTTTTCGGAATGTGTGGAGAGTCATGCATATGAGACTTATGATAAATTTCTCAAGGCCAGTGGAGAGGAGTTGAAGAATATGCCTGCACCGGATATCGCAGTAAAATACTATACGGGAGGTGACTTGTACTTATTTGATGAGTTCCAAACATCAAGAACTCCCAATACTCGAAGACCAGTAATAGAAAATCTATACGATGTGTTTGTGAACATAAGAGATGATGAAGCAGAACACTGCAAGACAATGAGAGCTTGTCAGACTCTAGGCAGTCTGCGTTCTCCACACTCCATTTTAGAAGATGATGATACTGAAGAAGAATCAGGGTGTGTTGTTCCTGAGGAGGCTCATTGCGAAGGTATTGTAGACTGCCTCAAGAAATCCATTACAAGTTAATAAATTAGAAAGTAAACTAAAAAAGATTATTTGTATCAGCTCATGAACAATAGATATAATCCCATATACTTGGGAATAAAGGAATAATGTGAAATTCCCATCGTTGTGCTAGTGTGTGAGAGAATCAAATACCCTAATGATGTAAATGTACTTTGATGAGCTTAAGTCGTTGTAGACCATTTTATCCATACTACTAGCCTTTGTGGTTGC

SEQ ID NO: 2333 - DNA, 1192 bp, Arabidopsis thaliana
  misc_feature (1)..(1192): Ceres cDNA ID no. 13588886
  misc_feature (1)..(1192): Ceres CLONE  ID no. 1353941
  misc_feature (1)..(1192): Also known as  Ceres CDNA ID no. 23659223
gacagaagtgaagagcaagcagacgaaaaaaatggcgactctgtcttcctatctgttatcttctcctcctctatgcaaatcccgattctcggcaacaagtctcgtctcaggaattgatttcatctctttctctcctcgaacaactctctcctcgtcatccactgtcttgccggcgattctttctctttccgttaaacataatcgccggagaaactcgcttcaagtgaaatcagtagctagcccaacggagacgatttcagaattcgatgagatggtctccggcacgaaacgaaagtattacatgctcggtgggaaaggaggagtgggcaaaactagttgtgctgcttctttagctgtgagattcgccaacaatggacacccaactctggttgtatctacagatccagcacattccttgagcgattcttttgctcaggacttgactggaggaatgcttgtccctgtagaaggacccgaagctcctttatttgctttagaaataaaccctgagaaggctagggaagagtttcgtagtgcctcgcagatgaatggaggaactggggtgaaagattttatggatggtatgggacttggaatgcttgtagaacaggtcattcaattcttggaatcaccagagtataacatgttcaccagaatcgtatttgatactgcaccaacgggtcatacgctaaggctactctctttacctgatttcttggatgcatccattggtaaaatcttgaagcttagacagaaaataacctcggctacttcagcgatcaaatcagtttttgggaaagaagaaaaggggcctgatgctgccgacaaattggaaaaactaagagaaaggatggttaaagttcgcgagcttttccgtgacacagagtcaacagaattcgtcattgtcactatcccaacggtaatggctgtcagcgagtcttctaggttaagtgcttccttgaagaaggaaagtgttcccgtcaaaagactcattgttaatcagcttctcccgccatcctcctcagattgcaaattttgctctattaagagaaaggaccaaatgcgggctcttgatatgatccgggaggattcagaactctctgctttgacactgatggaggctccgctggttgatatggagatcagaggtgtccctgctctgcgcttcttgggcgatatcatttggaaataa

SEQ ID NO: 2334 - protein, 1192 aa, Arabidopsis thaliana
  misc_feature: PFam Name: ArsA_ATPase; PFam Description: Anion-transporting
  misc_feature: GI Number: 5824321; NR Description: ATPase [Solanum tuberosum]
  misc_feature: GI Number: 30681260; NR Description: anion-transporting
  misc_feature: GI Number: 6056208; NR Description: putative ATPase
  misc_feature: GI Number: 50912707; NR Description: putative ATPase [Oryza sativa (japonica cultivar-group)] >gi|46390107|dbj|BAD15543.1| putative ATPase [Oryza sativa (japonica cultivar-group)] >gi|46390644|dbj|BAD16127.1| putative ATPase [Oryza sativa
  misc_feature: GI Number: 9759337; NR Description: arsenite translocating
GACAGAAGTGAAGAGCAAGCAGACGAAAAAAATGGCGACTCTGTCTTCCTATCTGTTATCTTCTCCTCCTCTATGCAAATCCCGATTCTCGGCAACAAGTCTCGTCTCAGGAATTGATTTCATCTCTTTCTCTCCTCGAACAACTCTCTCCTCGTCATCCACTGTCTTGCCGGCGATTCTTTCTCTTTCCGTTAAACATAATCGCCGGAGAAACTCGCTTCAAGTGAAATCAGTAGCTAGCCCAACGGAGACGATTTCAGAATTCGATGAGATGGTCTCCGGCACGAAACGAAAGTATTACATGCTCGGTGGGAAAGGAGGAGTGGGCAAAACTAGTTGTGCTGCTTCTTTAGCTGTGAGATTCGCCAACAATGGACACCCAACTCTGGTTGTATCTACAGATCCAGCACATTCCTTGAGCGATTCTTTTGCTCAGGACTTGACTGGAGGAATGCTTGTCCCTGTAGAAGGACCCGAAGCTCCTTTATTTGCTTTAGAAATAAACCCTGAGAAGGCTAGGGAAGAGTTTCGTAGTGCCTCGCAGATGAATGGAGGAACTGGGGTGAAAGATTTTATGGATGGTATGGGACTTGGAATGCTTGTAGAACAGGTCATTCAATTCTTGGAATCACCAGAGTATAACATGTTCACCAGAATCGTATTTGATACTGCACCAACGGGTCATACGCTAAGGCTACTCTCTTTACCTGATTTCTTGGATGCATCCATTGGTAAAATCTTGAAGCTTAGACAGAAAATAACCTCGGCTACTTCAGCGATCAAATCAGTTTTTGGGAAAGAAGAAAAGGGGCCTGATGCTGCCGACAAATTGGAAAAACTAAGAGAAAGGATGGTTAAAGTTCGCGAGCTTTTCCGTGACACAGAGTCAACAGAATTCGTCATTGTCACTATCCCAACGGTAATGGCTGTCAGCGAGTCTTCTAGGTTAAGTGCTTCCTTGAAGAAGGAAAGTGTTCCCGTCAAAAGACTCATTGTTAATCAGCTTCTCCCGCCATCCTCCTCAGATTGCAAATTTTGCTCTATTAAGAGAAAGGACCAAATGCGGGCTCTTGATATGATCCGGGAGGATTCAGAACTCTCTGCTTTGACACTGATGGAGGCTCCGCTGGTTGATATGGAGATCAGAGGTGTCCCTGCTCTGCGCTTCTTGGGCGATATCATTTGGAAATAA

SEQ ID NO: 2335 - DNA, 970 bp, Arabidopsis thaliana
  misc_feature (1)..(970): Ceres cDNA ID no. 13588904
  misc_feature (1)..(970): Ceres CLONE  ID no. 1348729
  misc_feature (1)..(970): Also known as  Ceres CDNA ID no. 23659246
gactcatcctccggcgggagcaaaattcggtgaaaattcttcttggttctgcagggtttttgaatagtttgtgtattgaagattgtctgaaatggaagcagctattactcagaggattcagtacccatcatgggttgattgtagaaaagttgagtgtaagccgcagcgtggttcattgcggtattctcagcaggttaaggtagatagaaggtttagaggtctttctttggctcgcttgcaacctgaaagaagaaatgatcaacgaagagcagtttctccagcggtttcctgttctgataacaattcctcagcgttgttggagactggaagtgtttatccatttgatgaagatattctcaagagaaaagcagaagaggttaaaccgtatttgaatggacgatctatgtaccttgtcggaatgatgggttctgggaaaacaactgtgggaaagttaatgtccaaagtgctcggttatacgttctttgactgcgacactttgattgaacaggcgatgaatggaacttctgttgcagagatatttgttcatcacggagagaatttttttagaggaaaggagaccgatgcgcttaagaagctctcttcgaggtatcaagttgttgtttccacaggtggaggtgcagttataagacccattaactggaagtatatgcataaaggaatcagcatttggctagatgtgcctctagaagcattagcccatagaatcgctgctgttggaactgattcacgaccactgctacacgatgaatcaggagatgcatactcagtggctttcaaacgtctctcggctatttgggacgagcgcggtgaagcatacacaaacgcaaatgccagagtctccttagaaaatattgcagcaaagcgtggctataaaaatgtctcagatctcacaccaactgaaattgctatcgaggtaagccaggtcctttctcagttacttcatcattaa

SEQ ID NO: 2336 - protein, 970 aa, Arabidopsis thaliana
  misc_feature: PFam Name: SKI; PFam Description: Shikimate kinase
  misc_feature: GI Number: 39104605; NR Description: putative shikimate
  misc_feature: GI Number: 4417286; NR Description: putative shikimate kinase precursor [Arabidopsis thaliana] >gi|25288007|pir||A84607 probable shikimate kinase precursor [imported] - Arabidopsis thaliana >gi|20137565|sp|Q9SJ05|AROK_ARATH Probable shikimate
  misc_feature: GI Number: 30681570; NR Description: shikimate kinase,
  misc_feature: GI Number: 42570867; NR Description: shikimate kinase,
  misc_feature: GI Number: 19349; NR Description: shikimate kinase precursor [Lycopersicon esculentum] >gi|114200|sp|Q00497|AROK_LYCES Shikimate kinase, chloroplast precursor >gi|100253|pir||S21584 shikimate
GACTCATCCTCCGGCGGGAGCAAAATTCGGTGAAAATTCTTCTTGGTTCTGCAGGGTTTTTGAATAGTTTGTGTATTGAAGATTGTCTGAAATGGAAGCAGCTATTACTCAGAGGATTCAGTACCCATCATGGGTTGATTGTAGAAAAGTTGAGTGTAAGCCGCAGCGTGGTTCATTGCGGTATTCTCAGCAGGTTAAGGTAGATAGAAGGTTTAGAGGTCTTTCTTTGGCTCGCTTGCAACCTGAAAGAAGAAATGATCAACGAAGAGCAGTTTCTCCAGCGGTTTCCTGTTCTGATAACAATTCCTCAGCGTTGTTGGAGACTGGAAGTGTTTATCCATTTGATGAAGATATTCTCAAGAGAAAAGCAGAAGAGGTTAAACCGTATTTGAATGGACGATCTATGTACCTTGTCGGAATGATGGGTTCTGGGAAAACAACTGTGGGAAAGTTAATGTCCAAAGTGCTCGGTTATACGTTCTTTGACTGCGACACTTTGATTGAACAGGCGATGAATGGAACTTCTGTTGCAGAGATATTTGTTCATCACGGAGAGAATTTTTTTAGAGGAAAGGAGACCGATGCGCTTAAGAAGCTCTCTTCGAGGTATCAAGTTGTTGTTTCCACAGGTGGAGGTGCAGTTATAAGACCCATTAACTGGAAGTATATGCATAAAGGAATCAGCATTTGGCTAGATGTGCCTCTAGAAGCATTAGCCCATAGAATCGCTGCTGTTGGAACTGATTCACGACCACTGCTACACGATGAATCAGGAGATGCATACTCAGTGGCTTTCAAACGTCTCTCGGCTATTTGGGACGAGCGCGGTGAAGCATACACAAACGCAAATGCCAGAGTCTCCTTAGAAAATATTGCAGCAAAGCGTGGCTATAAAAATGTCTCAGATCTCACACCAACTGAAATTGCTATCGAGGTAAGCCAGGTCCTTTCTCAGTTACTTCATCATTAA

SEQ ID NO: 2337 - DNA, 998 bp, Zea mays
  misc_feature (1)..(998): Ceres cDNA ID no. 13589427
  misc_feature (1)..(998): Ceres CLONE  ID no. 282069
  misc_feature (1)..(998): Also known as  Ceres CDNA ID no. 23828144
gccagttcgccacctcctttgctctcgcctcgcgcgcgctcccccccgcgcatcgtgccgttcgccaccgcaccgcgccgatggaggtcgccgccgtgcccagatccgccgcggcctgccgtgcggcgcccctgctcccggccgtccgagccgctgcgtgccacctggccctgccccggcgcgcgttctccgcatccgtcgcggcggcaccggcgccgcgccgcctcgccgctcgtcgcgctgcggatggtgacagcgtggagacggcgccggaggcggtccccattgagaaaaggttccctcccttcccgagcgtcatggacatcaaccagatccgcgagatcctcccccacaggttcccattccttttggttgatagagtaattaaatacaaggctggagaatatgcagtggggatcaagaatgttacaataaatgataatttcttcccaggacattttcctgaacgccccataatgcccggctgtcctcatggtcgaggctatggcccaggttgggggtctggtgatgctgcaacctgaagttggtggatctcgagacaacttctttttcgccgggattgacaaagttaggttcaggaagccagtgattgctggcgatacactgatcatgaggatgacactgactaagtatcagaagaggtttggactcgccaagatggaaggaaaagcttatgttggtggtgacctagtttgtgaaggggagttcctcctagtcagcgcaaccgagtagtgcaaagacacttcatgattctctgggaagaatcattggttggaatcagatctggttggatgtttgaaagaaccgagttttgaactaattatacaatcggcagttgaggcgatcctttacctgttcttaagcatgttgttgagtccatgtggtgatttctatcggttaccaagggcccaaggctgaatccacgccatgttatgttgcaattgaggattacaatatattgggtaattgtttgatgg

SEQ ID NO: 2338 - protein, 998 aa, Zea mays
  misc_feature: PFam Name: FabA; PFam Description: FabA-like domain
  misc_feature: PFam Name: 4HBT; PFam Description: Thioesterase superfamily
  misc_feature: GI Number: 50931539; NR Description: putative beta-hydroxyacyl-ACP dehydratase [Oryza sativa (japonica cultivar-group)] >gi|49328184|gb|AAT58880.1| putative beta-hydroxyacyl-ACP dehydratase [Oryza sativa (japonica
  misc_feature: GI Number: 21928166; NR Description: At2g22230/T26C19.11 [Arabidopsis thaliana] >gi|20198153|gb|AAD23619.2| putative beta-hydroxyacyl-ACP dehydratase [Arabidopsis thaliana] >gi|25090441|gb|AAN72302.1| At2g22230/T26C19.11 [Arabidopsis
  misc_feature: GI Number: 21592599; NR Description: putative
  misc_feature: GI Number: 14334124; NR Description: putative 3-keto-acyl-ACP
  misc_feature: GI Number: 25319393; NR Description: probable
GCCAGTTCGCCACCTCCTTTGCTCTCGCCTCGCGCGCGCTCCCCCCCGCGCATCGTGCCGTTCGCCACCGCACCGCGCCGATGGAGGTCGCCGCCGTGCCCAGATCCGCCGCGGCCTGCCGTGCGGCGCCCCTGCTCCCGGCCGTCCGAGCCGCTGCGTGCCACCTGGCCCTGCCCCGGCGCGCGTTCTCCGCATCCGTCGCGGCGGCACCGGCGCCGCGCCGCCTCGCCGCTCGTCGCGCTGCGGATGGTGACAGCGTGGAGACGGCGCCGGAGGCGGTCCCCATTGAGAAAAGGTTCCCTCCCTTCCCGAGCGTCATGGACATCAACCAGATCCGCGAGATCCTCCCCCACAGGTTCCCATTCCTTTTGGTTGATAGAGTAATTAAATACAAGGCTGGAGAATATGCAGTGGGGATCAAGAATGTTACAATAAATGATAATTTCTTCCCAGGACATTTTCCTGAACGCCCCATAATGCCCGGCTGTCCTCATGGTCGAGGCTATGGCCCAGGTTGGGGGTCTGGTGATGCTGCAACCTGAAGTTGGTGGATCTCGAGACAACTTCTTTTTCGCCGGGATTGACAAAGTTAGGTTCAGGAAGCCAGTGATTGCTGGCGATACACTGATCATGAGGATGACACTGACTAAGTATCAGAAGAGGTTTGGACTCGCCAAGATGGAAGGAAAAGCTTATGTTGGTGGTGACCTAGTTTGTGAAGGGGAGTTCCTCCTAGTCAGCGCAACCGAGTAGTGCAAAGACACTTCATGATTCTCTGGGAAGAATCATTGGTTGGAATCAGATCTGGTTGGATGTTTGAAAGAACCGAGTTTTGAACTAATTATACAATCGGCAGTTGAGGCGATCCTTTACCTGTTCTTAAGCATGTTGTTGAGTCCATGTGGTGATTTCTATCGGTTACCAAGGGCCCAAGGCTGAATCCACGCCATGTTATGTTGCAATTGAGGATTACAATATATTGGGTAATTGTTTGATGG

SEQ ID NO: 2339 - DNA, 2077 bp, Arabidopsis thaliana
  misc_feature (1)..(2077): Ceres cDNA ID no. 13591413
  misc_feature (1)..(2077): Ceres CLONE  ID no. 142019
  misc_feature (1)..(2077): Also known as  Ceres CDNA ID no. 23471137
actctttcctttttggtgcgttattctaagagccctagtcagaattcaaacatttggcaatgaaatcatacaaacttaataaccctaatttactcatctccacgcacacacataataaactcttcttatcctcttctccattcaatctcttattctcttttccttccttcatataccttaaacagcaacgttctctgttcttcttcttctttttcttcctctgtttttctttcacaacttccatgttggactcggacacagacacggactcaggtcctgtggttgcaacaaccaaactcgtcactttcctccagcgtgtgcagcacacggcacttcgatcataccctaaaaaacaaacgcctgatcccaaatcctacattgatctatctctcaaacgtccctacagtctctccaccatcgaatcagccttcgatgatctcacgagcgagtcacatgaccagccagtgccagtggagacgcttgaaaagttcgtcaaggaatattttgacggtgcaggggaggatctgctgcaccacgaaccagtagatttcgtctcagatccctccggcttcctctccaacgtggagaacgaagaagtcagagaatgggcgcgtgaggtacacggtctttggagaaatctgagctgcagagtctctgactcagtaagagagtctgccgaccggcacacgcttctaccgttgccggaaccggttatcattcccggttcgagattcagagaagtctattactgggattcttattgggtcatcaaaggacttatgacgagtcaaatgttcactaccgccaaaggtttagtgacgaatctgatgtcacttgtggagacttatggttacgctttgaacggtgctagagcttattatactaacagaagccaaccacctttgttgagctccatggtctatgaaatttataatgtgacaaaagatgaagaacttgtgaggaaagcaatccctctgcttctcaaagagtacgagttttggaactcaggaaaacataaagtggttattcgagacgctaatggttatgatcacgttttgagccgttattatgctatgtggaacaagccaaggcctgaatcctctgttttcgatgaagaatctgcttcagggttctcgactatgttagagaaacaacggttccatcgagatatagccacggctgctgaatcaggatgcgatttcagcacgcgatggatgagggatcctcctaatttcacaacgatggctacaacatcagtggttcctgttgatctaaatgtttttcttctcaagatggaactcgatatagcgttcatgatgaaggtttctggagatcaaaatggttcagaccgttttgtgaaagcgtcaaaagcgagagagaaagcgtttcaaaccgtgttttggaacgagaaagcagggcaatggctggattactggctttcctccagtggtgaggaatctgagacatggaaggctgagaaccaaaacaccaacgtctttgcgtctaactttgcaccaatctggattaattccatcaattcagatgaaaatcttgtcaagaaagttgtgacagctcttaagaactcagggctcattgctcccgctggaatcctaacttctttgacaaactcaggacaacaatgggattctccgaatggatgggcaccgcaacaagagatgatcgtcacagggctcggaagatcgagtgtaaaagaagctaaagagatggcagaggatattgcaaggagatggatcaaaagcaactatcttgtctacaagaaaagtgggactatacatgagaagctcaaagttacagagcttggtgaatatggtggtggaggagaatatatgccacagaccggattcggatggtcaaatggagttatcttagcattcttggaggaatatggatggccctctcatcttagcattgaagcctagatttactaagtttattgaaagttaaataacggaattagacattttatgttacaaaaactttggtagatttgatcgtagtggattatttcttggggttttctgtcagaacgttttagagttacaaatgttttatgacc

SEQ ID NO: 2340 - protein, 2077 aa, Arabidopsis thaliana
  misc_feature: PFam Name: Trehalase; PFam Description: Trehalase
  misc_feature: GI Number: 38564246; NR Description: At4g24040 [Arabidopsis thaliana] >gi|26451847|dbj|BAC43016.1| putative trehalase [Arabidopsis thaliana] >gi|7269253|emb|CAB81322.1| trehalase-like protein [Arabidopsis thaliana] >gi|5668632|emb|CAB51647.1|
  misc_feature: GI Number: 37536152; NR Description: putative trehalase [Oryza sativa (japonica cultivar-group)] >gi|10122053|gb|AAG13442.1| putative trehalase [Oryza sativa (japonica cultivar-group)] >gi|31433112|gb|AAP54665.1| putative
  misc_feature: GI Number: 4559292; NR Description: trehalase 1 GMTRE1
  misc_feature: GI Number: 2262112; NR Description: trehalase precusor isolog
  misc_feature: GI Number: 6651011; NR Description: trehalase; Tre
ACTCTTTCCTTTTTGGTGCGTTATTCTAAGAGCCCTAGTCAGAATTCAAACATTTGGCAATGAAATCATACAAACTTAATAACCCTAATTTACTCATCTCCACGCACACACATAATAAACTCTTCTTATCCTCTTCTCCATTCAATCTCTTATTCTCTTTTCCTTCCTTCATATACCTTAAACAGCAACGTTCTCTGTTCTTCTTCTTCTTTTTCTTCCTCTGTTTTTCTTTCACAACTTCCATGTTGGACTCGGACACAGACACGGACTCAGGTCCTGTGGTTGCAACAACCAAACTCGTCACTTTCCTCCAGCGTGTGCAGCACACGGCACTTCGATCATACCCTAAAAAACAAACGCCTGATCCCAAATCCTACATTGATCTATCTCTCAAACGTCCCTACAGTCTCTCCACCATCGAATCAGCCTTCGATGATCTCACGAGCGAGTCACATGACCAGCCAGTGCCAGTGGAGACGCTTGAAAAGTTCGTCAAGGAATATTTTGACGGTGCAGGGGAGGATCTGCTGCACCACGAACCAGTAGATTTCGTCTCAGATCCCTCCGGCTTCCTCTCCAACGTGGAGAACGAAGAAGTCAGAGAATGGGCGCGTGAGGTACACGGTCTTTGGAGAAATCTGAGCTGCAGAGTCTCTGACTCAGTAAGAGAGTCTGCCGACCGGCACACGCTTCTACCGTTGCCGGAACCGGTTATCATTCCCGGTTCGAGATTCAGAGAAGTCTATTACTGGGATTCTTATTGGGTCATCAAAGGACTTATGACGAGTCAAATGTTCACTACCGCCAAAGGTTTAGTGACGAATCTGATGTCACTTGTGGAGACTTATGGTTACGCTTTGAACGGTGCTAGAGCTTATTATACTAACAGAAGCCAACCACCTTTGTTGAGCTCCATGGTCTATGAAATTTATAATGTGACAAAAGATGAAGAACTTGTGAGGAAAGCAATCCCTCTGCTTCTCAAAGAGTACGAGTTTTGGAACTCAGGAAAACATAAAGTGGTTATTCGAGACGCTAATGGTTATGATCACGTTTTGAGCCGTTATTATGCTATGTGGAACAAGCCAAGGCCTGAATCCTCTGTTTTCGATGAAGAATCTGCTTCAGGGTTCTCGACTATGTTAGAGAAACAACGGTTCCATCGAGATATAGCCACGGCTGCTGAATCAGGATGCGATTTCAGCACGCGATGGATGAGGGATCCTCCTAATTTCACAACGATGGCTACAACATCAGTGGTTCCTGTTGATCTAAATGTTTTTCTTCTCAAGATGGAACTCGATATAGCGTTCATGATGAAGGTTTCTGGAGATCAAAATGGTTCAGACCGTTTTGTGAAAGCGTCAAAAGCGAGAGAGAAAGCGTTTCAAACCGTGTTTTGGAACGAGAAAGCAGGGCAATGGCTGGATTACTGGCTTTCCTCCAGTGGTGAGGAATCTGAGACATGGAAGGCTGAGAACCAAAACACCAACGTCTTTGCGTCTAACTTTGCACCAATCTGGATTAATTCCATCAATTCAGATGAAAATCTTGTCAAGAAAGTTGTGACAGCTCTTAAGAACTCAGGGCTCATTGCTCCCGCTGGAATCCTAACTTCTTTGACAAACTCAGGACAACAATGGGATTCTCCGAATGGATGGGCACCGCAACAAGAGATGATCGTCACAGGGCTCGGAAGATCGAGTGTAAAAGAAGCTAAAGAGATGGCAGAGGATATTGCAAGGAGATGGATCAAAAGCAACTATCTTGTCTACAAGAAAAGTGGGACTATACATGAGAAGCTCAAAGTTACAGAGCTTGGTGAATATGGTGGTGGAGGAGAATATATGCCACAGACCGGATTCGGATGGTCAAATGGAGTTATCTTAGCATTCTTGGAGGAATATGGATGGCCCTCTCATCTTAGCATTGAAGCCTAGATTTACTAAGTTTATTGAAAGTTAAATAACGGAATTAGACATTTTATGTTACAAAAACTTTGGTAGATTTGATCGTAGTGGATTATTTCTTGGGGTTTTCTGTCAGAACGTTTTAGAGTTACAAATGTTTTATGACC

SEQ ID NO: 2341 - DNA, 1706 bp, Arabidopsis thaliana
  misc_feature (1)..(1706): Ceres cDNA ID no. 13591581
  misc_feature (1)..(1706): Ceres CLONE  ID no. 1337183
  misc_feature (1)..(1706): Also known as  Ceres CDNA ID no. 23486804
gtcgatttctcttatgctcggattgctaaataatttattttatttttttaaatggtttgattctataattgtgagaggtttttatcatatggtttagtcttttttggcattttatctgaaaatattatcatcatccacgtggcaaatcctcgtcagccggctcacgagaacctcaattatccaatctttgtatgtcacttgagtctctatatatcaaaccaccgaaaagcacgattgtttatcgtagtgcgttacaagcgttttaagctctcactagcaagcaagtactagcaacaatggcgtcaagcactgcgactatgctcaaagcctcaccggtgaaatctgattgggttaagggacagagtcttctcctccgtcaaccttcctctgtctcagctattcgcagccacgtggcaccttccgctctcaccgtccgagccgcttctgcttacgccgatgagctcgtcaaaaccgctaaaacaatcgcgtctccgggacacggaattatggcgatggatgagtccaacgcgacttgtggaaagcgtttggcgtcaattgggctagagaacacggaggctaaccgtcaagcttacaggacgttgcttgtgtcggctccaggacttggacagtacatctccggagctatcctgttcgaggagactctgtaccaatccaccactgatggcaagaaaatggttgatgttctcgtcgagcagaacatcgtccctggcatcaaagtcgacaagggtttggtgccacttgttgggtcttacgacgagtcatggtgccaaggacttgacggtttagcctctcgcaccgctgcttactaccaacaaggtgctcgtttcgccaaatggcgtactgttgtgagcattccaaatggaccctctgctttggctgttaaagaagcagcttggggacttgctcgctacgcagctatttctcaagacagcggtctggtgccgattgtggagccagagattatgttggacggagaacacggcattgacaggacatacgacgttgcagagaaggtttgggctgaggtcttcttctacctcgctcagaacaacgtcatgttcgaaggtattctcctgaagccaagcatggttactccaggagctgaggccacagacagagctactcctgagcaggttgcttcctacactctcaagctccttcgcaacagaatccctcccgctgtccccggaatcatgttcttgtctggtggacagtccgagttggaggcgaccttgaacttgaacgcaatgaaccaggcaccgaacccatggcacgtgtccttctcctacgcacgtgccttgcagaacacttgcttgaagacatggggaggcaaggaagagaacgtgaaggcggctcaggacattctcttggccagagccaaagccaattcgctggctcagctcgggaaatacactggagaaggcgagtctgaggaagccaaggagggtatgtttgtaaaaggctacacctactaagctatttgtaataatggttccatagatcaaaactcaaaaacttgagcttgattctggtcatttgagttattatactcttcttcaggtataaaagtcagttctgtgttatcatgtgagactagttttgtttcttcatggttaatatcttagtacctactcgttactactaataattgagttagtagtctgtttctatcattgttatcactc

SEQ ID NO: 2342 - protein, 1706 aa, Arabidopsis thaliana
  misc_feature: PFam Name: Glycolytic; PFam Description:
  misc_feature: GI Number: 16226653; NR Description: AT4g38970/F19H22_70
  misc_feature: GI Number: 53828647; NR Description: At4g38970 [Arabidopsis thaliana] >gi|18420348|ref|NP_568049.1| fructose-bisphosphate
  misc_feature: GI Number: 1781348; NR Description: homologous to plastidic aldolases [Solanum tuberosum] >gi|7436610|pir||T07418 probable fructose-bisphosphate aldolase (EC 4.1.2.13) precursor, chloroplast
  misc_feature: GI Number: 21311559; NR Description: latex plastidic
  misc_feature: GI Number: 4827251; NR Description: plastidic aldolase
GTCGATTTCTCTTATGCTCGGATTGCTAAATAATTTATTTTATTTTTTTAAATGGTTTGATTCTATAATTGTGAGAGGTTTTTATCATATGGTTTAGTCTTTTTTGGCATTTTATCTGAAAATATTATCATCATCCACGTGGCAAATCCTCGTCAGCCGGCTCACGAGAACCTCAATTATCCAATCTTTGTATGTCACTTGAGTCTCTATATATCAAACCACCGAAAAGCACGATTGTTTATCGTAGTGCGTTACAAGCGTTTTAAGCTCTCACTAGCAAGCAAGTACTAGCAACAATGGCGTCAAGCACTGCGACTATGCTCAAAGCCTCACCGGTGAAATCTGATTGGGTTAAGGGACAGAGTCTTCTCCTCCGTCAACCTTCCTCTGTCTCAGCTATTCGCAGCCACGTGGCACCTTCCGCTCTCACCGTCCGAGCCGCTTCTGCTTACGCCGATGAGCTCGTCAAAACCGCTAAAACAATCGCGTCTCCGGGACACGGAATTATGGCGATGGATGAGTCCAACGCGACTTGTGGAAAGCGTTTGGCGTCAATTGGGCTAGAGAACACGGAGGCTAACCGTCAAGCTTACAGGACGTTGCTTGTGTCGGCTCCAGGACTTGGACAGTACATCTCCGGAGCTATCCTGTTCGAGGAGACTCTGTACCAATCCACCACTGATGGCAAGAAAATGGTTGATGTTCTCGTCGAGCAGAACATCGTCCCTGGCATCAAAGTCGACAAGGGTTTGGTGCCACTTGTTGGGTCTTACGACGAGTCATGGTGCCAAGGACTTGACGGTTTAGCCTCTCGCACCGCTGCTTACTACCAACAAGGTGCTCGTTTCGCCAAATGGCGTACTGTTGTGAGCATTCCAAATGGACCCTCTGCTTTGGCTGTTAAAGAAGCAGCTTGGGGACTTGCTCGCTACGCAGCTATTTCTCAAGACAGCGGTCTGGTGCCGATTGTGGAGCCAGAGATTATGTTGGACGGAGAACACGGCATTGACAGGACATACGACGTTGCAGAGAAGGTTTGGGCTGAGGTCTTCTTCTACCTCGCTCAGAACAACGTCATGTTCGAAGGTATTCTCCTGAAGCCAAGCATGGTTACTCCAGGAGCTGAGGCCACAGACAGAGCTACTCCTGAGCAGGTTGCTTCCTACACTCTCAAGCTCCTTCGCAACAGAATCCCTCCCGCTGTCCCCGGAATCATGTTCTTGTCTGGTGGACAGTCCGAGTTGGAGGCGACCTTGAACTTGAACGCAATGAACCAGGCACCGAACCCATGGCACGTGTCCTTCTCCTACGCACGTGCCTTGCAGAACACTTGCTTGAAGACATGGGGAGGCAAGGAAGAGAACGTGAAGGCGGCTCAGGACATTCTCTTGGCCAGAGCCAAAGCCAATTCGCTGGCTCAGCTCGGGAAATACACTGGAGAAGGCGAGTCTGAGGAAGCCAAGGAGGGTATGTTTGTAAAAGGCTACACCTACTAAGCTATTTGTAATAATGGTTCCATAGATCAAAACTCAAAAACTTGAGCTTGATTCTGGTCATTTGAGTTATTATACTCTTCTTCAGGTATAAAAGTCAGTTCTGTGTTATCATGTGAGACTAGTTTTGTTTCTTCATGGTTAATATCTTAGTACCTACTCGTTACTACTAATAATTGAGTTAGTAGTCTGTTTCTATCATTGTTATCACTC

SEQ ID NO: 2343 - DNA, 1869 bp, Arabidopsis thaliana
  misc_feature (1)..(1869): Ceres cDNA ID no. 13591695
  misc_feature (1)..(1869): Ceres CLONE  ID no. 1161334
  misc_feature (1)..(1869): Also known as  Ceres CDNA ID no. 13591695
tctttcatcgtcctcaccggaacgcgcctactctctttccacatcgtacgtttcctctctctaaattcttcaactttaaaggtgataaaaattgaatctttcccacaacccacaagaaaattcgaatcctttctctctttctatctcttagtcacgctttcgatcagcaatctcctcgaattctggttggttccgtctctgttttctgtacacaaagccctgctgctgttgatacacgtgagccgccattaatgcccctttgttttcttcttccagctgatttaggaagttggtgatcaaattacatctagtgtttgtttccgccagctgaagtgaatcaaaatgtttagttttggccgagcaagaagccaagggaggcaaaacagatctatgtctcttggaggactggattatgcagaccccaagaagaaaaacaattacttgggaaagattcttttgacagcttctcttacagccttgtgcattttcatgctcaagcaatctccaacattcaatactcctagcgtgttttctcgacatgagccaggggttacacatgttttggtcactggtggtgctgggtatattggttcacatgcagctctaaggcttctaaaggaatcatatcgagtaaccattgtggacaatctatcacggggcaatctcgctgcagtcaggattttgcaagaactatttccggaacctggaaggcttcaatttatttatgctgatcttggagatgccaaagctgtcaacaagatattcacagagaatgcctttgacgctgtgatgcatttcgctgctgttgcatatgttggggaaagcacacaattccctcttaagtattatcacaatattacatcgaacactttggtagtattagagacaatggctgctcatggagtaaagactttgatatattcaagcacttgtgcaacgtatggggagcctgatattatgccaattacagaggaaactcctcaggtgccaatcaacccatatggtaaggccaagaagatggcagaagatatcattttggatttctcgaaaaactcagatatggcagttatgatcctaagatatttcaatgtgattgggtccgatccagagggcagattgggtgaagccccaagacctgagctgcgagagcatggacgcatctccggtgcttgttttgatgcagcacgtggcatcatgcctggcctacagatcaaaggaacagactacaaaaccgctgatggaacttgcgtacgggattacattgatgtcactgatttggttgatgctcatgttaaagctcttcaaaaggcaaaaccacgcaaagttggaatctacaatgttggcaccgggaaaggtagctcggtgaaagagtttgttgaggcgtgcaagaaagcaactggtgttgagatcaagatcgactatttgcctagacgtgcaggtgattacgctgaggtttacagtgatccaagcaagattaggaaggaacttaactggacagctaagcacactaatctcaaagagagtcttgagactgcatggagatggcagaagctgcaccgtaatggctatggcttaacaacctcatcggtctcggtttactgactttgttcattcctttggtgatggacggagattttgattccagatggtattgaggagagaagcgtaggagatgatgatggtttatatataaatataacacaagatatattatccatattatgaaaaaatgatatcacatgacgagatttttgattgatattcattttgtaatggctttaggttcttttaggaagcagccattcattagtatatgtacctctcacaatatttattgattagtcttaataatatatagcattcctggct

SEQ ID NO: 2344 - protein, 1869 aa, Arabidopsis thaliana
TCTTTCATCGTCCTCACCGGAACGCGCCTACTCTCTTTCCACATCGTACGTTTCCTCTCTCTAAATTCTTCAACTTTAAAGGTGATAAAAATTGAATCTTTCCCACAACCCACAAGAAAATTCGAATCCTTTCTCTCTTTCTATCTCTTAGTCACGCTTTCGATCAGCAATCTCCTCGAATTCTGGTTGGTTCCGTCTCTGTTTTCTGTACACAAAGCCCTGCTGCTGTTGATACACGTGAGCCGCCATTAATGCCCCTTTGTTTTCTTCTTCCAGCTGATTTAGGAAGTTGGTGATCAAATTACATCTAGTGTTTGTTTCCGCCAGCTGAAGTGAATCAAAATGTTTAGTTTTGGCCGAGCAAGAAGCCAAGGGAGGCAAAACAGATCTATGTCTCTTGGAGGACTGGATTATGCAGACCCCAAGAAGAAAAACAATTACTTGGGAAAGATTCTTTTGACAGCTTCTCTTACAGCCTTGTGCATTTTCATGCTCAAGCAATCTCCAACATTCAATACTCCTAGCGTGTTTTCTCGACATGAGCCAGGGGTTACACATGTTTTGGTCACTGGTGGTGCTGGGTATATTGGTTCACATGCAGCTCTAAGGCTTCTAAAGGAATCATATCGAGTAACCATTGTGGACAATCTATCACGGGGCAATCTCGCTGCAGTCAGGATTTTGCAAGAACTATTTCCGGAACCTGGAAGGCTTCAATTTATTTATGCTGATCTTGGAGATGCCAAAGCTGTCAACAAGATATTCACAGAGAATGCCTTTGACGCTGTGATGCATTTCGCTGCTGTTGCATATGTTGGGGAAAGCACACAATTCCCTCTTAAGTATTATCACAATATTACATCGAACACTTTGGTAGTATTAGAGACAATGGCTGCTCATGGAGTAAAGACTTTGATATATTCAAGCACTTGTGCAACGTATGGGGAGCCTGATATTATGCCAATTACAGAGGAAACTCCTCAGGTGCCAATCAACCCATATGGTAAGGCCAAGAAGATGGCAGAAGATATCATTTTGGATTTCTCGAAAAACTCAGATATGGCAGTTATGATCCTAAGATATTTCAATGTGATTGGGTCCGATCCAGAGGGCAGATTGGGTGAAGCCCCAAGACCTGAGCTGCGAGAGCATGGACGCATCTCCGGTGCTTGTTTTGATGCAGCACGTGGCATCATGCCTGGCCTACAGATCAAAGGAACAGACTACAAAACCGCTGATGGAACTTGCGTACGGGATTACATTGATGTCACTGATTTGGTTGATGCTCATGTTAAAGCTCTTCAAAAGGCAAAACCACGCAAAGTTGGAATCTACAATGTTGGCACCGGGAAAGGTAGCTCGGTGAAAGAGTTTGTTGAGGCGTGCAAGAAAGCAACTGGTGTTGAGATCAAGATCGACTATTTGCCTAGACGTGCAGGTGATTACGCTGAGGTTTACAGTGATCCAAGCAAGATTAGGAAGGAACTTAACTGGACAGCTAAGCACACTAATCTCAAAGAGAGTCTTGAGACTGCATGGAGATGGCAGAAGCTGCACCGTAATGGCTATGGCTTAACAACCTCATCGGTCTCGGTTTACTGACTTTGTTCATTCCTTTGGTGATGGACGGAGATTTTGATTCCAGATGGTATTGAGGAGAGAAGCGTAGGAGATGATGATGGTTTATATATAAATATAACACAAGATATATTATCCATATTATGAAAAAATGATATCACATGACGAGATTTTTGATTGATATTCATTTTGTAATGGCTTTAGGTTCTTTTAGGAAGCAGCCATTCATTAGTATATGTACCTCTCACAATATTTATTGATTAGTCTTAATAATATATAGCATTCCTGGCT

SEQ ID NO: 2345 - DNA, 1654 bp, Arabidopsis thaliana
  misc_feature (1)..(1654): Ceres cDNA ID no. 13591733
  misc_feature (1)..(1654): Ceres CLONE  ID no. 1201947
  misc_feature (1)..(1654): Also known as  Ceres CDNA ID no. 23656376
ggaacaacaaacaaaaagcgtatatttttctctctatcaagattcaagccgtgagctagaaggctaaaaccctcttcttatagatttcaaagcaaccattttcgaactctgtttgattccactgtcgatttaatcatcttacctaatggccggaagggctgcgacgtcgtcggcgaaatgggcgagagagtttttgttcagaagggtttcgtctaatcctcttggagctacccgtaactgttcttcggttcctggagcttcttctgcaccgaaagtccctcatttttccaagagaggaaggatattgacaggagctaccattggtctggccatagctggaggagcttatgttagtactgcagatgaagcaaccttctgtgggtggctattcaacgcaacaaaggttgtgaatcctttctttgctcttctggatgctgagtttgcgcataagctggctgtttcagctgcagctcgcgggtgggtacctagagaaaagaggcctgatccagcaatcttgggacttgaagtttggggaaggaaattctcaaacccaattgggcttgctgctggatttgacaaaaacgctgaggctactgagggactgctagggatgggatttggctttgttgaggtaggctctgtaactcctgttccacaagaaggcaatccgaaaccacgtatcttcagactaagccaagaaggagctattatcaataggtgtggatttaatagcgaagggattgttgtcgttgcaaagcggttgggtgctcaacatggtaaaagaatgttggctgaaacatcagctacttcgtcatctccaagtgatgatgtaaaaccagggggaaaatctggacctggtattcttggggtcaaccttggaaagaacaagacgagtgaggatgctgctgctgactatgtccaaggagttcataacttatcccagtatgctgattacttggtgatcaatgtttcatcacccaatactgcaggactgcgcatgcttcaaggaaggaaacagttgaaggaccttgtaaagaaggttcaagctgctcgggatgagatgcaatggggtgatgaaggtcctcctcctcttcttgtgaagattgctcctgatctgtccagaggagagcttgaagatattgcagcggtggctcttgctctgcacttggatgggctgatcatatcaaatacaacagtctcaaggcctgatgctgtaagcaacaaccccgtggcaacagaaacaggtggtttgagcgggaaaccgctctttgctctctccaccaacatgttgagagatatgtacactttgacacgaggaaagattccattgataggctgtggcggggttagtagtggtgaggatgcttacaagaaaataagagctggagctactcttgttcagctgtacacgggatttgcctatggaggacctgccctcatcccacaaataaaggaggaactggtgaaatgcttagaaagggatggcttcaagtcgatccatgaagcaattggtgctgatcacagatgataaaactcaaagagcaatacgctgcggaaagatcccttttcttaaaacaacaaaacaagttgtatttaaagttcattgattcagttgtctctttctacccccaacaataacatcatcgtttttgcc

SEQ ID NO: 2346 - protein, 1654 aa, Arabidopsis thaliana
  misc_feature: PFam Name: DHO_dh; PFam Description: Dihydroorotate dehydrogenase
  misc_feature: GI Number: 16449; NR Description: dihydroorotate dehydrogenase [Arabidopsis thaliana] >gi|478676|pir||S23762 dihydroorotate oxidase (EC 1.3.3.1) precursor - Arabidopsis
  misc_feature: GI Number: 9909094; NR Description: dihydroorotate
  misc_feature: GI Number: 10177819; NR Description: dihydroorotate
  misc_feature: GI Number: 18420660; NR Description: dihydroorotate dehydrogenase, mitochondrial / dihydroorotate oxidase / DHOdehase (PYRD) [Arabidopsis thaliana] gi|26454657|sp|P32746|PYRD_ARATH Dihydroorotate dehydrogenase, mitochondrial precursor
  misc_feature: GI Number: 46201853; NR Description: COG0167: Dihydroorotate
GGAACAACAAACAAAAAGCGTATATTTTTCTCTCTATCAAGATTCAAGCCGTGAGCTAGAAGGCTAAAACCCTCTTCTTATAGATTTCAAAGCAACCATTTTCGAACTCTGTTTGATTCCACTGTCGATTTAATCATCTTACCTAATGGCCGGAAGGGCTGCGACGTCGTCGGCGAAATGGGCGAGAGAGTTTTTGTTCAGAAGGGTTTCGTCTAATCCTCTTGGAGCTACCCGTAACTGTTCTTCGGTTCCTGGAGCTTCTTCTGCACCGAAAGTCCCTCATTTTTCCAAGAGAGGAAGGATATTGACAGGAGCTACCATTGGTCTGGCCATAGCTGGAGGAGCTTATGTTAGTACTGCAGATGAAGCAACCTTCTGTGGGTGGCTATTCAACGCAACAAAGGTTGTGAATCCTTTCTTTGCTCTTCTGGATGCTGAGTTTGCGCATAAGCTGGCTGTTTCAGCTGCAGCTCGCGGGTGGGTACCTAGAGAAAAGAGGCCTGATCCAGCAATCTTGGGACTTGAAGTTTGGGGAAGGAAATTCTCAAACCCAATTGGGCTTGCTGCTGGATTTGACAAAAACGCTGAGGCTACTGAGGGACTGCTAGGGATGGGATTTGGCTTTGTTGAGGTAGGCTCTGTAACTCCTGTTCCACAAGAAGGCAATCCGAAACCACGTATCTTCAGACTAAGCCAAGAAGGAGCTATTATCAATAGGTGTGGATTTAATAGCGAAGGGATTGTTGTCGTTGCAAAGCGGTTGGGTGCTCAACATGGTAAAAGAATGTTGGCTGAAACATCAGCTACTTCGTCATCTCCAAGTGATGATGTAAAACCAGGGGGAAAATCTGGACCTGGTATTCTTGGGGTCAACCTTGGAAAGAACAAGACGAGTGAGGATGCTGCTGCTGACTATGTCCAAGGAGTTCATAACTTATCCCAGTATGCTGATTACTTGGTGATCAATGTTTCATCACCCAATACTGCAGGACTGCGCATGCTTCAAGGAAGGAAACAGTTGAAGGACCTTGTAAAGAAGGTTCAAGCTGCTCGGGATGAGATGCAATGGGGTGATGAAGGTCCTCCTCCTCTTCTTGTGAAGATTGCTCCTGATCTGTCCAGAGGAGAGCTTGAAGATATTGCAGCGGTGGCTCTTGCTCTGCACTTGGATGGGCTGATCATATCAAATACAACAGTCTCAAGGCCTGATGCTGTAAGCAACAACCCCGTGGCAACAGAAACAGGTGGTTTGAGCGGGAAACCGCTCTTTGCTCTCTCCACCAACATGTTGAGAGATATGTACACTTTGACACGAGGAAAGATTCCATTGATAGGCTGTGGCGGGGTTAGTAGTGGTGAGGATGCTTACAAGAAAATAAGAGCTGGAGCTACTCTTGTTCAGCTGTACACGGGATTTGCCTATGGAGGACCTGCCCTCATCCCACAAATAAAGGAGGAACTGGTGAAATGCTTAGAAAGGGATGGCTTCAAGTCGATCCATGAAGCAATTGGTGCTGATCACAGATGATAAAACTCAAAGAGCAATACGCTGCGGAAAGATCCCTTTTCTTAAAACAACAAAACAAGTTGTATTTAAAGTTCATTGATTCAGTTGTCTCTTTCTACCCCCAACAATAACATCATCGTTTTTGCC

SEQ ID NO: 2347 - DNA, 1266 bp, Arabidopsis thaliana
  misc_feature (1)..(1266): Ceres cDNA ID no. 13591891
  misc_feature (1)..(1266): Ceres CLONE  ID no. 1204072
  misc_feature (1)..(1266): Also known as  Ceres CDNA ID no. 13653504
ggccgtctctcttcaacctcttcccctccactttgcttctctctctcctccccgggggttttacagtcatatcatcgtcggagactctgcgattcttcacggaatcgtatttctctctcagcgatttttttcgattctcgaagctgcaaggaccacccatcaaacattgaaactcaagcgggagaaattttctggctcgggagggaaactatggagccctaatgcccattttctgctgtctatgagggttgttgggatatcgattaacggcccctatcgaaaaaaataagggttgttattattttcatttcgcttcatgttcaaggttatgtttggatgatagatacattttgactttctcatacaatgagtacacgaagaaatggcatttccaagcatcagcgaggtgataaattttgtggtgaagggccaaactggatactaattgcagggggtgcattgttgagcacattgtccattcgctttggatacaagctaaagcagtcgcttgattcgaaacctcaatcaaatggctctgctggattaaaacgaactgagagtgtggaaggaaaagaggtgacaagcgagcaaatgatatccgcatctgacacttcactgcctcttgtgacagttcctgctccatcgagcaaagagaatggagtcatgtgggcaacttctcctgatcgcctggaacttcccccaagaccatacaatcacaattcaaactgctcagattctccttgcgtatctgaaaccagctcagacattttcagcaaacgagaagtaatacagaaactaaggcagcagctgaagagacgggatgacatgatacaggaaatgcaagaacagattctagagctgcaaaactcgtataacgcacagacggcacactcaagccatctccaggcacagctagacacactgaacagagatctgtttgaatcagaaagagaagttcaaagactgagaaaggcaattgctgatcacagcgtgggatgtggcgcggacagcaatggcaagacatctccggttggaccttggaatggcgggtttatggacagcgaaagcaattatgagtcacaagaaaagagcctaagggatggagaaagagtagagatgttgagaaaggaagtgagtgagcttaaagaagtgatagatgggaaagagtatctacttagaagctataaggagcagaagattgagctttcgcagaaggtaaaagagttgcagcagagactggactcacagctccaaaacttattgtag

SEQ ID NO: 2348 - protein, 1266 aa, Arabidopsis thaliana
  misc_feature: GI Number: 21536672; NR Description: unknown [Arabidopsis thaliana]
GGCCGTCTCTCTTCAACCTCTTCCCCTCCACTTTGCTTCTCTCTCTCCTCCCCGGGGGTTTTACAGTCATATCATCGTCGGAGACTCTGCGATTCTTCACGGAATCGTATTTCTCTCTCAGCGATTTTTTTCGATTCTCGAAGCTGCAAGGACCACCCATCAAACATTGAAACTCAAGCGGGAGAAATTTTCTGGCTCGGGAGGGAAACTATGGAGCCCTAATGCCCATTTTCTGCTGTCTATGAGGGTTGTTGGGATATCGATTAACGGCCCCTATCGAAAAAAATAAGGGTTGTTATTATTTTCATTTCGCTTCATGTTCAAGGTTATGTTTGGATGATAGATACATTTTGACTTTCTCATACAATGAGTACACGAAGAAATGGCATTTCCAAGCATCAGCGAGGTGATAAATTTTGTGGTGAAGGGCCAAACTGGATACTAATTGCAGGGGGTGCATTGTTGAGCACATTGTCCATTCGCTTTGGATACAAGCTAAAGCAGTCGCTTGATTCGAAACCTCAATCAAATGGCTCTGCTGGATTAAAACGAACTGAGAGTGTGGAAGGAAAAGAGGTGACAAGCGAGCAAATGATATCCGCATCTGACACTTCACTGCCTCTTGTGACAGTTCCTGCTCCATCGAGCAAAGAGAATGGAGTCATGTGGGCAACTTCTCCTGATCGCCTGGAACTTCCCCCAAGACCATACAATCACAATTCAAACTGCTCAGATTCTCCTTGCGTATCTGAAACCAGCTCAGACATTTTCAGCAAACGAGAAGTAATACAGAAACTAAGGCAGCAGCTGAAGAGACGGGATGACATGATACAGGAAATGCAAGAACAGATTCTAGAGCTGCAAAACTCGTATAACGCACAGACGGCACACTCAAGCCATCTCCAGGCACAGCTAGACACACTGAACAGAGATCTGTTTGAATCAGAAAGAGAAGTTCAAAGACTGAGAAAGGCAATTGCTGATCACAGCGTGGGATGTGGCGCGGACAGCAATGGCAAGACATCTCCGGTTGGACCTTGGAATGGCGGGTTTATGGACAGCGAAAGCAATTATGAGTCACAAGAAAAGAGCCTAAGGGATGGAGAAAGAGTAGAGATGTTGAGAAAGGAAGTGAGTGAGCTTAAAGAAGTGATAGATGGGAAAGAGTATCTACTTAGAAGCTATAAGGAGCAGAAGATTGAGCTTTCGCAGAAGGTAAAAGAGTTGCAGCAGAGACTGGACTCACAGCTCCAAAACTTATTGTAG

SEQ ID NO: 2349 - DNA, 1832 bp, Arabidopsis thaliana
  misc_feature (1)..(1832): Ceres cDNA ID no. 13592103
  misc_feature (1)..(1832): Ceres CLONE  ID no. 207107
  misc_feature (1)..(1832): Also known as  Ceres CDNA ID no. 23652460
aatatctcctagtctcaactctcaaatagagagagaaaaacagaaagacagagagaggttctatatattatagataaagtacattacacaattgtacaagtggaaaaatcatcacggatctctcttcaaatatataaagaagatttgtatatcaaactctctaagcttttgttgagccatggctgtgatgaagataaaaggagcagcgaccgtagcaggaacatggctgaacgaagccgttagcttcgtcgtgttctgtatcttagacatcgttgattcatttctttgtctcctctacaaagcagctgattatctcttcgaagccgagtggaagccttgctattgcttgtcggacaaggaacccatcaccacaactcgagggaagatccttttgtctcacaataatggcgagtccaagatcctcactctttctccgcttcaagaactcggcggacgttccaagattgagctggaggatatctccgagaccctttacacacgtccttctcttatttccgacatctcaaccatctccgttaacgagctcaataagcggttcgttaaggttactcggtcagagtctgagtgtagcggccataatgagaagaccaagaacaaaaggaggagatcattaacgaagtcaagcttgacggtgaacttcacggtcgttgagatgcttcggggaaagatcagaccgcagaatttgaaccacgatatctctcgatggtcggattgtgattgtgggttttgtacatcgtgggcctctacttctgacaaaaaccattccctctttgtcaaaactcaaatcccaaatggggtaacagcgaaagaggatgttcttttcatacatggtttcatatcttcatcagcgttttggacggagacggtgtttccaagcctgtcagcctcctcctcgactcatagactcttcgccgtggatcttctaggattcggaaagagtccaaagccagctgattcactctacacgttgagagaacacgtagagatgatcgagaaatctgtcttacacaaatacaatgtgaagtctttccacatcgtggctcactctttgggatgcattttggcgcttagcctagccgctagacatggcggcttaatcaagtcgcttaccctccttgctccgccgtactatccagtaccgaagggagagaaaaagccgaggcagtacgtgatgaagaaggtggcgccgaggaaggtttggccaccaatagctctcggagcgtcgatggcttgttggtacgaacacattagccgtaccatttgtctcctcatatgcaaacaccaccgtgtttggcaattcatcgccggtgtcttgacccgaaacaacaggactgtaaactttttaattgaaggtttcatgtgtcacacacacaacgcagcatggcatactctacataacattatatgtgggacaggaagcaaactcgatacgtatctagacatcgtacgagataaactaaagtgcaacgtgaccatcttccacggaggagacgacgaactcatccctgtcgagtgtagctacaacgttaaacagcgaattcctcgggcacgagttaaggttattgagcacaaagatcatatcactatggtcgttggcagacaagatgagtttgccagagagctccaagagatttggaagacttcttcttgctaaaattatgtttgatgagagaacttgtgatttattatgattgttctatgtaatgggttggtaaaaatattcttaagagttttataattacaaattaaggaaatccttatgtatcatgagataatccaggaaatggagtattaaataataatttcgcatc

SEQ ID NO: 2350 - protein, 1832 aa, Arabidopsis thaliana
  misc_feature: PFam Name: Abhydrolase_1; PFam Description: alpha/beta
  misc_feature: PFam Name: Gp_dh_C; PFam Description: Glyceraldehyde
  misc_feature: PFam Name: Gp_dh_N; PFam Description: Glyceraldehyde
  misc_feature: GI Number: 22655450; NR Description: At3g26650/MLJ15_5 [Arabidopsis thaliana] >gi|11994300|dbj|BAB01730.1| glyceralehyde-3-phosphate dehydrogenase subunit [Arabidopsis thaliana] >gi|19715651|gb|AAL91645.1| AT3g26650/MLJ15_5
  misc_feature: GI Number: 6633825; NR Description: F1N19.24 [Arabidopsis thaliana]
  misc_feature: GI Number: 22240; NR Description: GADPH (383 AA) [Zea mays]
  misc_feature: GI Number: 1402885; NR Description: glyceraldehyde-3-phosphate dehydrogenase (NADP+) (phosphorylating) [Arabidopsis thaliana] >gi|2117520|pir||JQ1285 glyceraldehyde-3-phosphate dehydrogenase (NADP) (phosphorylating)
  misc_feature: GI Number: 12159; NR Description: glyceraldehyde-3-phosphate dehydrogenase [Pisum sativum] >gi|120658|sp|P12858|G3PA_PEA Glyceraldehyde-3-phosphate dehydrogenase A, chloroplast precursor (NADP-dependent glyceraldehydephosphate dehydrogenase subunit A)
AATATCTCCTAGTCTCAACTCTCAAATAGAGAGAGAAAAACAGAAAGACAGAGAGAGGTTCTATATATTATAGATAAAGTACATTACACAATTGTACAAGTGGAAAAATCATCACGGATCTCTCTTCAAATATATAAAGAAGATTTGTATATCAAACTCTCTAAGCTTTTGTTGAGCCATGGCTGTGATGAAGATAAAAGGAGCAGCGACCGTAGCAGGAACATGGCTGAACGAAGCCGTTAGCTTCGTCGTGTTCTGTATCTTAGACATCGTTGATTCATTTCTTTGTCTCCTCTACAAAGCAGCTGATTATCTCTTCGAAGCCGAGTGGAAGCCTTGCTATTGCTTGTCGGACAAGGAACCCATCACCACAACTCGAGGGAAGATCCTTTTGTCTCACAATAATGGCGAGTCCAAGATCCTCACTCTTTCTCCGCTTCAAGAACTCGGCGGACGTTCCAAGATTGAGCTGGAGGATATCTCCGAGACCCTTTACACACGTCCTTCTCTTATTTCCGACATCTCAACCATCTCCGTTAACGAGCTCAATAAGCGGTTCGTTAAGGTTACTCGGTCAGAGTCTGAGTGTAGCGGCCATAATGAGAAGACCAAGAACAAAAGGAGGAGATCATTAACGAAGTCAAGCTTGACGGTGAACTTCACGGTCGTTGAGATGCTTCGGGGAAAGATCAGACCGCAGAATTTGAACCACGATATCTCTCGATGGTCGGATTGTGATTGTGGGTTTTGTACATCGTGGGCCTCTACTTCTGACAAAAACCATTCCCTCTTTGTCAAAACTCAAATCCCAAATGGGGTAACAGCGAAAGAGGATGTTCTTTTCATACATGGTTTCATATCTTCATCAGCGTTTTGGACGGAGACGGTGTTTCCAAGCCTGTCAGCCTCCTCCTCGACTCATAGACTCTTCGCCGTGGATCTTCTAGGATTCGGAAAGAGTCCAAAGCCAGCTGATTCACTCTACACGTTGAGAGAACACGTAGAGATGATCGAGAAATCTGTCTTACACAAATACAATGTGAAGTCTTTCCACATCGTGGCTCACTCTTTGGGATGCATTTTGGCGCTTAGCCTAGCCGCTAGACATGGCGGCTTAATCAAGTCGCTTACCCTCCTTGCTCCGCCGTACTATCCAGTACCGAAGGGAGAGAAAAAGCCGAGGCAGTACGTGATGAAGAAGGTGGCGCCGAGGAAGGTTTGGCCACCAATAGCTCTCGGAGCGTCGATGGCTTGTTGGTACGAACACATTAGCCGTACCATTTGTCTCCTCATATGCAAACACCACCGTGTTTGGCAATTCATCGCCGGTGTCTTGACCCGAAACAACAGGACTGTAAACTTTTTAATTGAAGGTTTCATGTGTCACACACACAACGCAGCATGGCATACTCTACATAACATTATATGTGGGACAGGAAGCAAACTCGATACGTATCTAGACATCGTACGAGATAAACTAAAGTGCAACGTGACCATCTTCCACGGAGGAGACGACGAACTCATCCCTGTCGAGTGTAGCTACAACGTTAAACAGCGAATTCCTCGGGCACGAGTTAAGGTTATTGAGCACAAAGATCATATCACTATGGTCGTTGGCAGACAAGATGAGTTTGCCAGAGAGCTCCAAGAGATTTGGAAGACTTCTTCTTGCTAAAATTATGTTTGATGAGAGAACTTGTGATTTATTATGATTGTTCTATGTAATGGGTTGGTAAAAATATTCTTAAGAGTTTTATAATTACAAATTAAGGAAATCCTTATGTATCATGAGATAATCCAGGAAATGGAGTATTAAATAATAATTTCGCATC

SEQ ID NO: 2351 - DNA, 2659 bp, Arabidopsis thaliana
  misc_feature (1)..(2659): Ceres cDNA ID no. 13592197
  misc_feature (1)..(2659): Ceres CLONE  ID no. 1202413
  misc_feature (1)..(2659): Also known as  Ceres CDNA ID no. 23655548
ggtgaatgtaaaaaacaagaaaaaaaataaaatttatttttctctctcgcttggttcaaccgtggttgttcatcggaaaaatatcttcggcttcaatttcgttcgatttaccctaaattctcgactagtgttcgtcaatcccacttccaattccacatttcaaaccttttcaggaagttgaaatcaaaagcatgaatgcttaaacagtttacgcattattgcgaaatgcaagccgagctgatacccgaaggtcctaacggtgagggccgtttatcaaaccagaacagcaaccctaatttactctcttctgcttctatcagtattactcagtttcctgctaagaagccgactaggcaatgggctgcttggacacatcaagaagaggaaagtttcttcactgctcttcgtcaagttggaaagaattttgagaagataacttctcgtgttcagagcaaaaacaaggaccaggtcaggcattactattatcgtttagtgaggcgtatgaacaaacttttgggcccggatctgagccttgatgccaagaacccaaaggacaccaatgctgcaatgctacgatggtggtctttgcttgaaaagtatagctgcaaagcttcaaaacttcatctcaagccccggagattcaaactatttatagaggccttggaacaccaattgctgaaagaccgcagaaagagcataagaaaacggacttgccagggagaaaatctctcttctgcttccctcggaaacatctcaagtcatagtagagaaagaggattggataaccgtccatttaaacttattctctccgacggccaaaatgttaaaaagctagggcctggaagagcatctaccaaacatggtgaaagcttaagtgtcaaccttggtgacgaaaaagaagacacagcctttgggagaggtggaaggcaacggcgaaaacaaggttatagaaaatgggaaaaagctgcaatagatggggtctctctggttgctgatgctgcagagcatttggaacgaacatcaattgacaaagatatggatgatcaaacagatttaggtcccacaagatatttaaccggaaagtctccactttctctatgctcagctggtgatgttcctctcagtgatgccaatatgcagttttctgccaagcttaaacttcagctgttcccgattgatgaatgtactcgaagatccttggaaatggataagcacaatccgcatcttgaacttactcttagtaatcgcaagaagatatcatctgtacttgaacatctcaatcgcaaatggggaagctcaagttgtgcgactggagagctattgctatttccttacaacgcacgaaaagaaactgtaacgtgccatcagaggtggacccatgactcttttctaagcgcagcagaagtgcattcaatggtcggaagtccttcggttttccgcttaaggtatggttggtttgtccatgatgcgtcaggttctattatttctcaagttccaacttcagatccttgcccttcactcgaggatgacatgaatgtggataggttgaacgaggtcaacatgctccttactgaatcaggacccttgtctgtgcattcaactgctgaacaaacgacatctgtagagcccagtcagggtctagtatgtgcatctggtgtccatgatcgtcccgcaagatctagagatgattatgaacctgcttcaacgagtattactccacttgagcatttgagcggcggtaatgcacaatcaccaggagaatgggctgatagtcttactaacataagtataggtgatctactttctgaagtgcccgatgacatagatagtgatggtgttgatccacctgccaccgaaggttcacattacctccttcgagatgtcccatttacctctgactcttttgatgctgcaattgctgctcatatactaagacaccagaacaagccaagtgctcaactaccgctgacttctggctcttcctctctgtgggatgatgaagaaacacgtgatgccttctctttccaaaaaaatcgtttcgcaaattccaccgagctggctagtgttgcttctcctaaaggtgttggcagagtaaatggagagccttcacagttggtggaggcttcatccggcgatgagggatcttataaccctcatgacgatggagatccaatggaagagggtccagcagaccctcatacgatggattctccagggaagaccccttgtggacttgcggatgtatactggcccgactcgttaggaccactggatttagacattagatcgtcaaagtatacagatgatttgatccttagtgagagcctcgggggattgagccgtctgatagcaaccagccttgatgcgtttcagaactgctcgctctttgggttcgacaataagaaggacaagtctaacatggtatgaaatggaaccaaagctaaagcatggggtccaaatgttgatagttgaaaaagaaagtgacttcttgccttttgaaaaaagaaacttttatcaccaactgatagcttcactgtacaaaaatttgatgtaaccttttactcttcctttcacacattcttttgtgttgatacatgtttctctgtgtacacttttactgttaatttacatgtttatttggctaccatgccttctttct

SEQ ID NO: 2352 - protein, 2659 aa, Arabidopsis thaliana
  misc_feature: PFam Name: Myb_DNA-binding; PFam Description: Myb-like
  misc_feature: GI Number: 30686982; NR Description: myb family transcription
  misc_feature: GI Number: 22218300; NR Description: myb/SANT domain protein
  misc_feature: GI Number: 34913318; NR Description: putative myb/SANT domain protein [Oryza sativa (japonica cultivar-group)] >gi|22093830|dbj|BAC07117.1| putative myb/SANT domain protein
  misc_feature: GI Number: 34906224; NR Description: P0666G04.18 [Oryza sativa (japonica cultivar-group)] >gi|13122435|dbj|BAB32916.1|
GGTGAATGTAAAAAACAAGAAAAAAAATAAAATTTATTTTTCTCTCTCGCTTGGTTCAACCGTGGTTGTTCATCGGAAAAATATCTTCGGCTTCAATTTCGTTCGATTTACCCTAAATTCTCGACTAGTGTTCGTCAATCCCACTTCCAATTCCACATTTCAAACCTTTTCAGGAAGTTGAAATCAAAAGCATGAATGCTTAAACAGTTTACGCATTATTGCGAAATGCAAGCCGAGCTGATACCCGAAGGTCCTAACGGTGAGGGCCGTTTATCAAACCAGAACAGCAACCCTAATTTACTCTCTTCTGCTTCTATCAGTATTACTCAGTTTCCTGCTAAGAAGCCGACTAGGCAATGGGCTGCTTGGACACATCAAGAAGAGGAAAGTTTCTTCACTGCTCTTCGTCAAGTTGGAAAGAATTTTGAGAAGATAACTTCTCGTGTTCAGAGCAAAAACAAGGACCAGGTCAGGCATTACTATTATCGTTTAGTGAGGCGTATGAACAAACTTTTGGGCCCGGATCTGAGCCTTGATGCCAAGAACCCAAAGGACACCAATGCTGCAATGCTACGATGGTGGTCTTTGCTTGAAAAGTATAGCTGCAAAGCTTCAAAACTTCATCTCAAGCCCCGGAGATTCAAACTATTTATAGAGGCCTTGGAACACCAATTGCTGAAAGACCGCAGAAAGAGCATAAGAAAACGGACTTGCCAGGGAGAAAATCTCTCTTCTGCTTCCCTCGGAAACATCTCAAGTCATAGTAGAGAAAGAGGATTGGATAACCGTCCATTTAAACTTATTCTCTCCGACGGCCAAAATGTTAAAAAGCTAGGGCCTGGAAGAGCATCTACCAAACATGGTGAAAGCTTAAGTGTCAACCTTGGTGACGAAAAAGAAGACACAGCCTTTGGGAGAGGTGGAAGGCAACGGCGAAAACAAGGTTATAGAAAATGGGAAAAAGCTGCAATAGATGGGGTCTCTCTGGTTGCTGATGCTGCAGAGCATTTGGAACGAACATCAATTGACAAAGATATGGATGATCAAACAGATTTAGGTCCCACAAGATATTTAACCGGAAAGTCTCCACTTTCTCTATGCTCAGCTGGTGATGTTCCTCTCAGTGATGCCAATATGCAGTTTTCTGCCAAGCTTAAACTTCAGCTGTTCCCGATTGATGAATGTACTCGAAGATCCTTGGAAATGGATAAGCACAATCCGCATCTTGAACTTACTCTTAGTAATCGCAAGAAGATATCATCTGTACTTGAACATCTCAATCGCAAATGGGGAAGCTCAAGTTGTGCGACTGGAGAGCTATTGCTATTTCCTTACAACGCACGAAAAGAAACTGTAACGTGCCATCAGAGGTGGACCCATGACTCTTTTCTAAGCGCAGCAGAAGTGCATTCAATGGTCGGAAGTCCTTCGGTTTTCCGCTTAAGGTATGGTTGGTTTGTCCATGATGCGTCAGGTTCTATTATTTCTCAAGTTCCAACTTCAGATCCTTGCCCTTCACTCGAGGATGACATGAATGTGGATAGGTTGAACGAGGTCAACATGCTCCTTACTGAATCAGGACCCTTGTCTGTGCATTCAACTGCTGAACAAACGACATCTGTAGAGCCCAGTCAGGGTCTAGTATGTGCATCTGGTGTCCATGATCGTCCCGCAAGATCTAGAGATGATTATGAACCTGCTTCAACGAGTATTACTCCACTTGAGCATTTGAGCGGCGGTAATGCACAATCACCAGGAGAATGGGCTGATAGTCTTACTAACATAAGTATAGGTGATCTACTTTCTGAAGTGCCCGATGACATAGATAGTGATGGTGTTGATCCACCTGCCACCGAAGGTTCACATTACCTCCTTCGAGATGTCCCATTTACCTCTGACTCTTTTGATGCTGCAATTGCTGCTCATATACTAAGACACCAGAACAAGCCAAGTGCTCAACTACCGCTGACTTCTGGCTCTTCCTCTCTGTGGGATGATGAAGAAACACGTGATGCCTTCTCTTTCCAAAAAAATCGTTTCGCAAATTCCACCGAGCTGGCTAGTGTTGCTTCTCCTAAAGGTGTTGGCAGAGTAAATGGAGAGCCTTCACAGTTGGTGGAGGCTTCATCCGGCGATGAGGGATCTTATAACCCTCATGACGATGGAGATCCAATGGAAGAGGGTCCAGCAGACCCTCATACGATGGATTCTCCAGGGAAGACCCCTTGTGGACTTGCGGATGTATACTGGCCCGACTCGTTAGGACCACTGGATTTAGACATTAGATCGTCAAAGTATACAGATGATTTGATCCTTAGTGAGAGCCTCGGGGGATTGAGCCGTCTGATAGCAACCAGCCTTGATGCGTTTCAGAACTGCTCGCTCTTTGGGTTCGACAATAAGAAGGACAAGTCTAACATGGTATGAAATGGAACCAAAGCTAAAGCATGGGGTCCAAATGTTGATAGTTGAAAAAGAAAGTGACTTCTTGCCTTTTGAAAAAAGAAACTTTTATCACCAACTGATAGCTTCACTGTACAAAAATTTGATGTAACCTTTTACTCTTCCTTTCACACATTCTTTTGTGTTGATACATGTTTCTCTGTGTACACTTTTACTGTTAATTTACATGTTTATTTGGCTACCATGCCTTCTTTCT

SEQ ID NO: 2353 - DNA, 1620 bp, Arabidopsis thaliana
  misc_feature (1)..(1620): Ceres cDNA ID no. 13592581
  misc_feature (1)..(1620): Ceres CLONE  ID no. 145633
aattacctatcttgcttcttcaatatttaatttatatttattatagcatcacttccaaaaaaaaatcagaagaagaagatagagagaaagaaagagagagatatcgacaacaacaatggaagattcaagcaaaaaaagccaaaagaagaagaagaacaaaagcaagaacaacatcccaactgtttggttctcactcaagaaatccctccactgtaaatccgaaccatctgatgtccacgacccaatatccaccactaaacagcaacaacacctctccacaatctccaccaagaaaatctccggcatatcatccggcggagccgccgtatgcggtggtggtttatcaggatgttcaagatcaatagcaaatctcaaagacgtaatccatggaagcaaaagacatttcgagaaaccaccaataagtagtcctcgttctattggaagcaatgagtttctaaatcctataactcatgaagttattcttagtaactcaacttgtgagcttaagatcactggtgtcggagacatggcttcacctgtcggagcagcggattccggcggaggtggcggtggaggaaatggtcggtctacgacttatgtagggatgcttagaccaggaacaccgatgcattatcttaaccattcagcttcttacaggagccaaacaagaaagggttcgtttgctttgtcggagagagatcgaggaggaggaggaggaggagaagggttagggtttcatacaaacagaagggtttcattggagatgaacagagaatccaccattaatggaggcaacaattcctctgtttcttgtcataaatgtggtgaacagttcaataagcttgaagctgctgaagctcatcatctctctaaacatgccgtaacggagcttgtagaaggagattcatcaagaaaaatagtggagataatctgcagaacaagctggttaaagtcagagaaccaatgtggaagaatcgatagagttttaaaagtacacaacatgcagaagacattagctagattcgaggaatacagagaaacagttaaaatcagagcaagcaaacttcagaagaagcatccaagatgtctcgcagacggtaacgagctacttaggttccacggaaccaccgtggcttgtggtttaggtataaacgggtcaacaagtgtttgcacggcggagaaatgttgtgtctgtcggattatacgaaacgggttctcgtcgaaacgggagaagaataatggggttggtgttttcacggcgtctactagtggaagagcgttcgagtcgattttggttaacggtggagatgagagtggagatgttgatcggacggtgaggaaagtgttgattgtgtgtagggttatcgccggaagagttcatcggccggtggagaatgtggaggagatgaatgggttgatgagtgggtttgattctttggctggcaaagttggtttgtatacaaatgtggaggagctttatttgcttaatcctaaagctttgcttccttgctttgtggtcatttgcaagccctaaaacatttagcatgttggggaaaaagattgaattttcttttgttgataaatttatgtatcgtataatgagaattgaaatcaataggt

SEQ ID NO: 2354 - protein, 472 aa, Arabidopsis thaliana
  misc_feature: PFam Name: zf-C2H2; PFam Description: Zinc finger, C2H2 type
  misc_feature: GI Number: 34910152; NR Description: B1070A12.19 [Oryza sativa (japonica cultivar-group)] >gi|20804915|dbj|BAB92595.1|
  misc_feature: GI Number: 52076893; NR Description: zinc finger (C2H2 type) protein-like [Oryza sativa (japonica cultivar-group)] >gi|52076647|dbj|BAD45547.1| zinc finger (C2H2 type) protein-like
  misc_feature: GI Number: 5777616; NR Description: CAA30374.1 protein [Oryza
  misc_feature: GI Number: 9802582; NR Description: T2E6.3 [Arabidopsis thaliana]
  misc_feature: GI Number: 6554199; NR Description: T23J18.16 [Arabidopsis
MEDSSKKSQKKKKNKSKNNIPTVWFSLKKSLHCKSEPSDVHDPISTTKQQQHLSTISTKKISGISSGGAAVCGGGLSGCSRSIANLKDVIHGSKRHFEKPPISSPRSIGSNEFLNPITHEVILSNSTCELKITGVGDMASPVGAADSGGGGGGGNGRSTTYVGMLRPGTPMHYLNHSASYRSQTRKGSFALSERDRGGGGGGEGLGFHTNRRVSLEMNRESTINGGNNSSVSCHKCGEQFNKLEAAEAHHLSKHAVTELVEGDSSRKIVEIICRTSWLKSENQCGRIDRVLKVHNMQKTLARFEEYRETVKIRASKLQKKHPRCLADGNELLRFHGTTVACGLGINGSTSVCTAEKCCVCRIIRNGFSSKREKNNGVGVFTASTSGRAFESILVNGGDESGDVDRTVRKVLIVCRVIAGRVHRPVENVEEMNGLMSGFDSLAGKVGLYTNVEELYLLNPKALLPCFVVICKP

SEQ ID NO: 2355 - DNA, 1038 bp, Arabidopsis thaliana
  misc_feature (1)..(1038): Ceres cDNA ID no. 13592611
  misc_feature (1)..(1038): Ceres CLONE  ID no. 1353179
  misc_feature (1)..(1038): Also known as  Ceres CDNA ID no. 13592611
tcaagtgaagcagaatcaaagttgccacttagtccggaagactgtgattgtgattttgaatgaactcatggaacaagtttcctctagatcaagctctctcactgtcggagagcaattctgcgccgtctttatacctttctttgccattatcgatgtcctagtttcctccgtcggacaatgcttcgattgccgcagcacatcgcctcggacatgtcagcacgcggatctggaacgtcttgctcgtgaatctcaattttcagtcaatgaagttgaagctttgtatgagctattcaagaaattgagctgttcaattattgatgacggcttgattcacaaggaagagcttagactggcgctgttccaagctccatatggtgagaacctctttcttgatagggtttttgatttgttcgatgaaaagaagaatggggttattgagtttgaggaattcatccatgcactcagtgtctttcatccctatgcatcaatccaggagaagaccgattttgcatttaggctctatgatctaagacaaactggattcattgagcgagaagaggtgcaacaaatggtttctgctattctcttggaatctgatatgatgctatccgatgaacttctgaccatgattattgataaaacatttgctgatgcagattctgacaaagacggtaaaattagtaaggatgaatggaatgtctatgtgcataaacatcctagcttgttgaagaatatgactcttccttacctaaaggatgtgacgacagcattcccaagttttatattcaacactgaggttgaagactgaggcacaactgtccatgcaacaccggtcatcttttttctgcttggtcctgtaattcgagtgagattgtcatagcgcaagagcagaacgaggaaagaaggttttccttattttattttaagccaacgtagttgatgattattagctgtaagtaaaattgtcaagcactttgctttgttttgatgactttactgtaattgttccattgaaagtaatgaagcatttttcttttc

SEQ ID NO: 2356 - protein, 1038 aa, Arabidopsis thaliana
TCAAGTGAAGCAGAATCAAAGTTGCCACTTAGTCCGGAAGACTGTGATTGTGATTTTGAATGAACTCATGGAACAAGTTTCCTCTAGATCAAGCTCTCTCACTGTCGGAGAGCAATTCTGCGCCGTCTTTATACCTTTCTTTGCCATTATCGATGTCCTAGTTTCCTCCGTCGGACAATGCTTCGATTGCCGCAGCACATCGCCTCGGACATGTCAGCACGCGGATCTGGAACGTCTTGCTCGTGAATCTCAATTTTCAGTCAATGAAGTTGAAGCTTTGTATGAGCTATTCAAGAAATTGAGCTGTTCAATTATTGATGACGGCTTGATTCACAAGGAAGAGCTTAGACTGGCGCTGTTCCAAGCTCCATATGGTGAGAACCTCTTTCTTGATAGGGTTTTTGATTTGTTCGATGAAAAGAAGAATGGGGTTATTGAGTTTGAGGAATTCATCCATGCACTCAGTGTCTTTCATCCCTATGCATCAATCCAGGAGAAGACCGATTTTGCATTTAGGCTCTATGATCTAAGACAAACTGGATTCATTGAGCGAGAAGAGGTGCAACAAATGGTTTCTGCTATTCTCTTGGAATCTGATATGATGCTATCCGATGAACTTCTGACCATGATTATTGATAAAACATTTGCTGATGCAGATTCTGACAAAGACGGTAAAATTAGTAAGGATGAATGGAATGTCTATGTGCATAAACATCCTAGCTTGTTGAAGAATATGACTCTTCCTTACCTAAAGGATGTGACGACAGCATTCCCAAGTTTTATATTCAACACTGAGGTTGAAGACTGAGGCACAACTGTCCATGCAACACCGGTCATCTTTTTTCTGCTTGGTCCTGTAATTCGAGTGAGATTGTCATAGCGCAAGAGCAGAACGAGGAAAGAAGGTTTTCCTTATTTTATTTTAAGCCAACGTAGTTGATGATTATTAGCTGTAAGTAAAATTGTCAAGCACTTTGCTTTGTTTTGATGACTTTACTGTAATTGTTCCATTGAAAGTAATGAAGCATTTTTCTTTTC

SEQ ID NO: 2357 - DNA, 1516 bp, Arabidopsis thaliana
  misc_feature (1)..(1516): Ceres cDNA ID no. 13592681
  misc_feature (1)..(1516): Ceres CLONE  ID no. 1342335
  misc_feature (1)..(1516): Also known as  Ceres CDNA ID no. 13592681
actactctcttcttcacctcctcaagtcacagtgaccaaaatcacacacttcacaagaaacaacctatggatccaaatgaatctccaccaaaccaatttcgccacgtggtggccatgccttatccaggtcgaggacacatcaaccctatgatgaacctctgcaaacgccttgtccgtcgataccctaaccttcacgtcaccttcgtcgtcacagaagaatggctcgggtttattggacccgacccgaaacccgaccggatccatttctccactctccctaatctcatcccttccgagcttgtcagggccaaagacttcataggcttcattgatgccgtctacacaagattggaagaaccattcgagaagcttcttgacagcctcaattcaccacctccgagtgtaatattcgccgacacttacgtcatttgggctgtgcgagtcggcagaaaaaggaatattccggtggtttctctctggaccatgtcagccacgattctctccttcttcctccactctgatctactcataagtcatggccatgctctgttcgaaccatcagaagaagaggttgttgattacgtccccggtttatctccgacgaaactccgagatttgccgccgatatttgacggttacagcgaccgagtcttcaagacagctaagttgtgtttcgatgaactaccaggagctaggtctttactcttcaccaccgcctatgagcttgaacacaaagctattgacgctttcacctccaagctcgatatcccggtctacgctattggtcctttaataccttttgaagaactttctgttcaaaatgataacaaggaacctaattacatccagtggcttgaggaacaaccggaaggctctgttctttacatatctcagggaagttttctttcggtctcggaagctcagatggaggaaatagtgaaaggactgagagaaagtggagtccggtttctttgggtggctcgtgggggcgagttaaagcttaaggaggctcttgaaggtagcttaggtgtagtggtgagctggtgtgatcagcttcgggtgctgtgtcacaaagctgtaggcgggttttggactcattgcgggtttaactcgacattggaagggatatattcaggagtaccaatgctagcgtttccgttgttttgggatcagattctgaacgctaagatgattgttgaggactggagagtcggaatgaggatcgagaggacgaaaaagaatgagttgttgatagggagagaggagatcaaggaagtagtgaagaggtttatggatagagagagtgaagaagggaaagagatgagaagaagggcttgtgaccttagtgaaatcagtcgaggagctgttgcgaaaagcggttcgtctaatgtaaacatcgatgagttcgttcggcatattaccaatacaaattaaggctcaaagaggttttattgtttcaatacaatgtaaggctcaatggcatgctcactaaatcatatgtatcttttgaatgact

SEQ ID NO: 2358 - protein, 1516 aa, Arabidopsis thaliana
ACTACTCTCTTCTTCACCTCCTCAAGTCACAGTGACCAAAATCACACACTTCACAAGAAACAACCTATGGATCCAAATGAATCTCCACCAAACCAATTTCGCCACGTGGTGGCCATGCCTTATCCAGGTCGAGGACACATCAACCCTATGATGAACCTCTGCAAACGCCTTGTCCGTCGATACCCTAACCTTCACGTCACCTTCGTCGTCACAGAAGAATGGCTCGGGTTTATTGGACCCGACCCGAAACCCGACCGGATCCATTTCTCCACTCTCCCTAATCTCATCCCTTCCGAGCTTGTCAGGGCCAAAGACTTCATAGGCTTCATTGATGCCGTCTACACAAGATTGGAAGAACCATTCGAGAAGCTTCTTGACAGCCTCAATTCACCACCTCCGAGTGTAATATTCGCCGACACTTACGTCATTTGGGCTGTGCGAGTCGGCAGAAAAAGGAATATTCCGGTGGTTTCTCTCTGGACCATGTCAGCCACGATTCTCTCCTTCTTCCTCCACTCTGATCTACTCATAAGTCATGGCCATGCTCTGTTCGAACCATCAGAAGAAGAGGTTGTTGATTACGTCCCCGGTTTATCTCCGACGAAACTCCGAGATTTGCCGCCGATATTTGACGGTTACAGCGACCGAGTCTTCAAGACAGCTAAGTTGTGTTTCGATGAACTACCAGGAGCTAGGTCTTTACTCTTCACCACCGCCTATGAGCTTGAACACAAAGCTATTGACGCTTTCACCTCCAAGCTCGATATCCCGGTCTACGCTATTGGTCCTTTAATACCTTTTGAAGAACTTTCTGTTCAAAATGATAACAAGGAACCTAATTACATCCAGTGGCTTGAGGAACAACCGGAAGGCTCTGTTCTTTACATATCTCAGGGAAGTTTTCTTTCGGTCTCGGAAGCTCAGATGGAGGAAATAGTGAAAGGACTGAGAGAAAGTGGAGTCCGGTTTCTTTGGGTGGCTCGTGGGGGCGAGTTAAAGCTTAAGGAGGCTCTTGAAGGTAGCTTAGGTGTAGTGGTGAGCTGGTGTGATCAGCTTCGGGTGCTGTGTCACAAAGCTGTAGGCGGGTTTTGGACTCATTGCGGGTTTAACTCGACATTGGAAGGGATATATTCAGGAGTACCAATGCTAGCGTTTCCGTTGTTTTGGGATCAGATTCTGAACGCTAAGATGATTGTTGAGGACTGGAGAGTCGGAATGAGGATCGAGAGGACGAAAAAGAATGAGTTGTTGATAGGGAGAGAGGAGATCAAGGAAGTAGTGAAGAGGTTTATGGATAGAGAGAGTGAAGAAGGGAAAGAGATGAGAAGAAGGGCTTGTGACCTTAGTGAAATCAGTCGAGGAGCTGTTGCGAAAAGCGGTTCGTCTAATGTAAACATCGATGAGTTCGTTCGGCATATTACCAATACAAATTAAGGCTCAAAGAGGTTTTATTGTTTCAATACAATGTAAGGCTCAATGGCATGCTCACTAAATCATATGTATCTTTTGAATGACT

SEQ ID NO: 2359 - DNA, 1479 bp, Arabidopsis thaliana
  misc_feature (1)..(1479): Ceres cDNA ID no. 13592772
  misc_feature (1)..(1479): Ceres CLONE  ID no. 124883
  misc_feature (1)..(1479): Also known as  Ceres CDNA ID no. 13592772
acacacatataacaatctcttcttctctgacattacacaatggtggtttgagtttacagaagataataatggggaaaactagcaaatggtttcgaagtctcttaaccggaaagaaagagagaacaaaggaacatatcattcaaagcgagtgtgtattcacttcttccattccaggcactcctaaggagaaacgtcgatggagttttcgacgttcttcagcaactggaccaccgccaccagcttgtgctattacactgaaagattcaccaccaccgccgccaccaccacctccacctccaccgctacaacaaccatttgtggtcgaaatcgtggacaatgaagatgaacaaatcaagaacgtttcagctgaagagattgaagaatttgcagcaataaagattcaagcgtgctatcgttctcatttggcgaggaaagcattaagagcattaaaagggttagtgaaattacaagcactagtgagaggtcatttagtaaggaaacaagcaacagctacacttagatgtatgcaagcattaataacacttcaagccaaagctcgagaacagaggattcgtatgatcggaggagattcaacaaatccaagaacatcgattcacaaaaccaggatcaataacttttaccacgagaatgaagaaaacatcaagattgtggaaatggacattcaatcgaaaatgtactctccggctccttcggctttaaccgagatgagtcctcgcgcgtatagtagccatttcgaggattgtaactcattcaacacagctcaaagtagtccacaatgtttcagcagattcaaagagtattacaatggagatactttgtcttcttatgattaccctctcttccctaattacatggctaatactcagtcttctaaagccaaggctcggtctcaaagtgcgccgaagcagagacctcctgagatctatgagaagcagatgagtgggaggagaagatcttcgatggaagcaccgaggaataacggtgtcccgagagctgtaaggatgcagagatcttcatctcaactagggtcaaacacagccaaggaaagtcaacaacatcatcatcatcagtactatccgtggatggcgataaagctcgatagatctaatatttcgcttatggagagcgaatgcggatctacaagtaccgttatgactaataccaactacggtagacatgttgatgttcagggaaacaacaacatgtactgaacactgtgctttagaatttgagagattgctggaaaaataggcaagcctaaaaaacgaagaggacaggtttataggagtttttttatgatgatggagatttaacaatctctatatgtaaagcaaaaaatgtagtagactgtagaagtgactcatctcgtcttaaattttgatttttcctttttaattatcattcgaattaacgttaacagtatttgtcaaattcatggatgttactatgttcaaaacc

SEQ ID NO: 2360 - protein, 1479 aa, Arabidopsis thaliana
ACACACATATAACAATCTCTTCTTCTCTGACATTACACAATGGTGGTTTGAGTTTACAGAAGATAATAATGGGGAAAACTAGCAAATGGTTTCGAAGTCTCTTAACCGGAAAGAAAGAGAGAACAAAGGAACATATCATTCAAAGCGAGTGTGTATTCACTTCTTCCATTCCAGGCACTCCTAAGGAGAAACGTCGATGGAGTTTTCGACGTTCTTCAGCAACTGGACCACCGCCACCAGCTTGTGCTATTACACTGAAAGATTCACCACCACCGCCGCCACCACCACCTCCACCTCCACCGCTACAACAACCATTTGTGGTCGAAATCGTGGACAATGAAGATGAACAAATCAAGAACGTTTCAGCTGAAGAGATTGAAGAATTTGCAGCAATAAAGATTCAAGCGTGCTATCGTTCTCATTTGGCGAGGAAAGCATTAAGAGCATTAAAAGGGTTAGTGAAATTACAAGCACTAGTGAGAGGTCATTTAGTAAGGAAACAAGCAACAGCTACACTTAGATGTATGCAAGCATTAATAACACTTCAAGCCAAAGCTCGAGAACAGAGGATTCGTATGATCGGAGGAGATTCAACAAATCCAAGAACATCGATTCACAAAACCAGGATCAATAACTTTTACCACGAGAATGAAGAAAACATCAAGATTGTGGAAATGGACATTCAATCGAAAATGTACTCTCCGGCTCCTTCGGCTTTAACCGAGATGAGTCCTCGCGCGTATAGTAGCCATTTCGAGGATTGTAACTCATTCAACACAGCTCAAAGTAGTCCACAATGTTTCAGCAGATTCAAAGAGTATTACAATGGAGATACTTTGTCTTCTTATGATTACCCTCTCTTCCCTAATTACATGGCTAATACTCAGTCTTCTAAAGCCAAGGCTCGGTCTCAAAGTGCGCCGAAGCAGAGACCTCCTGAGATCTATGAGAAGCAGATGAGTGGGAGGAGAAGATCTTCGATGGAAGCACCGAGGAATAACGGTGTCCCGAGAGCTGTAAGGATGCAGAGATCTTCATCTCAACTAGGGTCAAACACAGCCAAGGAAAGTCAACAACATCATCATCATCAGTACTATCCGTGGATGGCGATAAAGCTCGATAGATCTAATATTTCGCTTATGGAGAGCGAATGCGGATCTACAAGTACCGTTATGACTAATACCAACTACGGTAGACATGTTGATGTTCAGGGAAACAACAACATGTACTGAACACTGTGCTTTAGAATTTGAGAGATTGCTGGAAAAATAGGCAAGCCTAAAAAACGAAGAGGACAGGTTTATAGGAGTTTTTTTATGATGATGGAGATTTAACAATCTCTATATGTAAAGCAAAAAATGTAGTAGACTGTAGAAGTGACTCATCTCGTCTTAAATTTTGATTTTTCCTTTTTAATTATCATTCGAATTAACGTTAACAGTATTTGTCAAATTCATGGATGTTACTATGTTCAAAACC

SEQ ID NO: 2361 - DNA, 1925 bp, Arabidopsis thaliana
  misc_feature (1)..(1925): Ceres cDNA ID no. 13592848
  misc_feature (1)..(1925): Ceres CLONE  ID no. 151694
  misc_feature (1)..(1925): Also known as  Ceres CDNA ID no. 23649490
ctcctccatttttgctacatttttttttctttgattaaaaacattttttctatttttcgttttttgctatttccttgtaacttaaaagaagaaaaaatgagaggtagcggagcaaagatcgccggcgttttgccgttgtttatgctattcatcgccggaacaatctccgcctttgaagacatagagaggttgaggatttggccgttaccggcacaagttagccacggtggccggagaatgtatctaagtggagatttcaagcttgttacggagggaagcaaatatggagacgcctcagggattttgaaagaaggatttgatagaatgcttggtgttgtgaggctgagccacgtcatctccggtgaccggaattcttcaggcaccggtggatctgctttgcttcagggacttcacgtcatcatctcctcctctaccgatgagttggaatatggagcagacgagtcgtacaaattagtggttccatctccagagaagccgtcttatgcacaacttgaggccaagagtgtttatggtgcattgcacggtctacagacatttagccagttatgtcattttaatttgaagaaaaaggtcatagagattctaatgactccatggaatatcatagaccagcctagattctcttaccgtggccttttaatcgatacatcccgacattatttgccacttccggttataaagaacgtgattgattccatgacatatgccaaacttaatgtgttacattggcacattgtggatacacaatcatttcctttagagataccttcttacccaaagctatggaacggcgcttactcttcctctcagcgatacaccttcgaagacgctgctgaaatcgtcaattatgctcggcgacgagggatccatgtcttggctgagattgatgttccaggacatgctctctcatggggaaagggatatcctgccttgtggccctccaagaattgtcaagaaccacttgacgtgagcagtgacttcacattcaaagtcattgatggcattctctctgatttcagcaagatctttaagtttaaatttgtccacttgggtggtgatgaagtaaatacaacttgttggtctgcaacaccgcgaatagcccaatggcttaaaaaacatcggatgagtgaaaaagaagcctatcaatatttcgtgttgcgggcgcaaaaaatcgccttgtctcacggatatgaaattatcaactgggaagagaccttcatcaattttggaagcaaattaaaccggaaaaccgtggttcacaactggcttaacacaggacttgttgagaatgtgactgcgtccggtttaaggtgtatagttagtaaccaagaattttggtatttggatcatatagacgcaccttggcaaggcttttacgcaaacgagccatttcaaaacataacggataaaaagcaacaaagtctagtacttggtggcgaggtttgcatgtggggtgaacatattgatgcttctgacattgaacaaaccatttggcctcgcgctgccgcagctgcagagcggttgtggacaccctatgcaaaattggctaaaaatcccaacaatgtaacgacgaggttggctcacttcagatgtctattgaatcaaagaggagttgcagctgcacctttggttggtggcggacgagttgtgccttttgaaccaggttcttgtctcgctcagtgattcgaaagattagcattgtagaatatattacagtcagcaacaccttggtcaattcaggttgaaatgaacccctacaaaaaagggatactttgaatttttttcttggttgattttttagtggtagaaatattccttcttacaatttgggaataattgttgcaacattcatgtataaaaggccttaccaatttcaggcttgaataagaatacatagtttgcac

SEQ ID NO: 2362 - protein, 1925 aa, Arabidopsis thaliana
  misc_feature: PFam Name: Glyco_hydro_20; PFam Description: Glycosyl
  misc_feature: PFam Name: Glyco_hydro_20b; PFam Description: Glycosyl
  misc_feature: GI Number: 23463073; NR Description: At1g65600/F5I14_13 [Arabidopsis thaliana] >gi|22135811|gb|AAM91092.1| At1g65600/F5I14_13 [Arabidopsis thaliana] >gi|30697215|ref|NP_176737.2| glycosyl hydrolase family 20
  misc_feature: GI Number: 34907528; NR Description: beta-N-acetylhexosaminidase -like protein [Oryza sativa (japonica cultivar-group)] >gi|20161257|dbj|BAB90183.1| beta-N-acetylhexosaminidase -like protein [Oryza sativa (japonica
  misc_feature: GI Number: 7019659; NR Description: beta-N-acetylhexosaminidase-like protein [Arabidopsis thaliana] >gi|11264425|pir||T47665 beta-N-acetylhexosaminidase-like protein -
  misc_feature: GI Number: 30694211; NR Description: glycosyl hydrolase
  misc_feature: GI Number: 24030299; NR Description: putative beta-N-acetylhexosaminidase [Arabidopsis thaliana] >gi|21537026|gb|AAM61367.1| beta-N-acetylhexosaminidase-like
CTCCTCCATTTTTGCTACATTTTTTTTTCTTTGATTAAAAACATTTTTTCTATTTTTCGTTTTTTGCTATTTCCTTGTAACTTAAAAGAAGAAAAAATGAGAGGTAGCGGAGCAAAGATCGCCGGCGTTTTGCCGTTGTTTATGCTATTCATCGCCGGAACAATCTCCGCCTTTGAAGACATAGAGAGGTTGAGGATTTGGCCGTTACCGGCACAAGTTAGCCACGGTGGCCGGAGAATGTATCTAAGTGGAGATTTCAAGCTTGTTACGGAGGGAAGCAAATATGGAGACGCCTCAGGGATTTTGAAAGAAGGATTTGATAGAATGCTTGGTGTTGTGAGGCTGAGCCACGTCATCTCCGGTGACCGGAATTCTTCAGGCACCGGTGGATCTGCTTTGCTTCAGGGACTTCACGTCATCATCTCCTCCTCTACCGATGAGTTGGAATATGGAGCAGACGAGTCGTACAAATTAGTGGTTCCATCTCCAGAGAAGCCGTCTTATGCACAACTTGAGGCCAAGAGTGTTTATGGTGCATTGCACGGTCTACAGACATTTAGCCAGTTATGTCATTTTAATTTGAAGAAAAAGGTCATAGAGATTCTAATGACTCCATGGAATATCATAGACCAGCCTAGATTCTCTTACCGTGGCCTTTTAATCGATACATCCCGACATTATTTGCCACTTCCGGTTATAAAGAACGTGATTGATTCCATGACATATGCCAAACTTAATGTGTTACATTGGCACATTGTGGATACACAATCATTTCCTTTAGAGATACCTTCTTACCCAAAGCTATGGAACGGCGCTTACTCTTCCTCTCAGCGATACACCTTCGAAGACGCTGCTGAAATCGTCAATTATGCTCGGCGACGAGGGATCCATGTCTTGGCTGAGATTGATGTTCCAGGACATGCTCTCTCATGGGGAAAGGGATATCCTGCCTTGTGGCCCTCCAAGAATTGTCAAGAACCACTTGACGTGAGCAGTGACTTCACATTCAAAGTCATTGATGGCATTCTCTCTGATTTCAGCAAGATCTTTAAGTTTAAATTTGTCCACTTGGGTGGTGATGAAGTAAATACAACTTGTTGGTCTGCAACACCGCGAATAGCCCAATGGCTTAAAAAACATCGGATGAGTGAAAAAGAAGCCTATCAATATTTCGTGTTGCGGGCGCAAAAAATCGCCTTGTCTCACGGATATGAAATTATCAACTGGGAAGAGACCTTCATCAATTTTGGAAGCAAATTAAACCGGAAAACCGTGGTTCACAACTGGCTTAACACAGGACTTGTTGAGAATGTGACTGCGTCCGGTTTAAGGTGTATAGTTAGTAACCAAGAATTTTGGTATTTGGATCATATAGACGCACCTTGGCAAGGCTTTTACGCAAACGAGCCATTTCAAAACATAACGGATAAAAAGCAACAAAGTCTAGTACTTGGTGGCGAGGTTTGCATGTGGGGTGAACATATTGATGCTTCTGACATTGAACAAACCATTTGGCCTCGCGCTGCCGCAGCTGCAGAGCGGTTGTGGACACCCTATGCAAAATTGGCTAAAAATCCCAACAATGTAACGACGAGGTTGGCTCACTTCAGATGTCTATTGAATCAAAGAGGAGTTGCAGCTGCACCTTTGGTTGGTGGCGGACGAGTTGTGCCTTTTGAACCAGGTTCTTGTCTCGCTCAGTGATTCGAAAGATTAGCATTGTAGAATATATTACAGTCAGCAACACCTTGGTCAATTCAGGTTGAAATGAACCCCTACAAAAAAGGGATACTTTGAATTTTTTTCTTGGTTGATTTTTTAGTGGTAGAAATATTCCTTCTTACAATTTGGGAATAATTGTTGCAACATTCATGTATAAAAGGCCTTACCAATTTCAGGCTTGAATAAGAATACATAGTTTGCAC

SEQ ID NO: 2363 - DNA, 1601 bp, Arabidopsis thaliana
  misc_feature (1)..(1601): Ceres cDNA ID no. 13592957
  misc_feature (1)..(1601): Ceres CLONE  ID no. 257067
  misc_feature (1)..(1601): Also known as  Ceres CDNA ID no. 23472427
actttaagctcttcttcactcacactctctcaaaaatcaccaaacgaaactcttcactctctccaacaatggccaagaagatgagttctctcatcatcatcttcaacattctccttctcctcacaactcaaacccacgcgcacaacgtcacgcgcctcctagcaaaccacccatcattctcttccttcagccatttcctaacacaaacacacctcgccgacgaaatcaaccggagaagaaccataaccgtttgcgcagtagataacgccgccatgtcagcattaacctctaaaggctatacactctcaactctcaaaaacattctctccctccacgtccttttagattacttcggaaccaaaaaactccaccagatccgtgacggctctgctctcgccgctactctgtttcaagccaccggagctgctcctggaacctcaggattcgttaacataacggatctgagaggtggtaaagttgggtttggtcctgacggtggagatctgtcttctttctttgttaaatctattgaagaagttccgtataacatctccattattcagatcagtagagttttaccgtcggagactgcggcggctccgactcctgctccggcggagatgaatcttaccggaataatgtcggctcatggatgcaaagtgtttgctgagactcttctcactaaccctggagcttcaaaaacctatcaggagagtttagaaggaggcatgacagtgttctgtccaggagatgatgcaatgaaaggtttcttgcccaaatacaagaacttgacagctccaaagaaagaagcatttctcgatttcctcgctgtcccgacatattactcaatggcgatgctcaaatccaacaatggtccgatgaacacacttgcgacagatggagctaacaagtttgagcttactgtacagaacgatggagagaaggttaccctcaagacaaggatcaacactgtcaagatcgttgatactcttattgatgagcagcctttagctatatatgcgactgataaggttttgttgcctaaagagttgtttaaggcttcggctgttgaagctccggctcctgctccggcaccagaggatggtgatgttgcggattctccaaaagcggctaaagggaaagcgaaaggaaagaagaagaaggctgcaccgtcgccagataatgatccttttggtgactcggattcgcctgccgaagggcctgacggagaggccgatgatgcgacggcagatgatgcttgtgcggttaggatcatcggaggagctaaggctggtttggtggtgagcttgctctgcttgtttgcttcttcttggcttctatagtttcacttcttgtttcttcgattcttccatgttttttttttttttgtgaatcttttatttatggtttttgggggagagtaaatgaggattatttatttccctctattgttgagtttttttatttatttaaaagttggttgtcgaattaaatagtcggtagtttatatatttgtgtgttcttgtttcacgtgtttgtttagttgatgatgtaaacaagtcctgattttggtgatcttgtcatatttttcttgtttttgt

SEQ ID NO: 2364 - protein, 1601 aa, Arabidopsis thaliana
  misc_feature: PFam Name: Fasciclin; PFam Description: Fasciclin domain
  misc_feature: GI Number: 21593810; NR Description: putative pollen surface
  misc_feature: GI Number: 22655474; NR Description: At4g12730/T20K18_80 [Arabidopsis thaliana] >gi|4586249|emb|CAB40990.1| putative pollen surface protein [Arabidopsis thaliana] >gi|7267974|emb|CAB78315.1| putative pollen surface protein
  misc_feature: GI Number: 13377778; NR Description: fasciclin-like
  misc_feature: GI Number: 21618321; NR Description: unknown [Arabidopsis thaliana]
  misc_feature: GI Number: 21595125; NR Description: endosperm-specific
ACTTTAAGCTCTTCTTCACTCACACTCTCTCAAAAATCACCAAACGAAACTCTTCACTCTCTCCAACAATGGCCAAGAAGATGAGTTCTCTCATCATCATCTTCAACATTCTCCTTCTCCTCACAACTCAAACCCACGCGCACAACGTCACGCGCCTCCTAGCAAACCACCCATCATTCTCTTCCTTCAGCCATTTCCTAACACAAACACACCTCGCCGACGAAATCAACCGGAGAAGAACCATAACCGTTTGCGCAGTAGATAACGCCGCCATGTCAGCATTAACCTCTAAAGGCTATACACTCTCAACTCTCAAAAACATTCTCTCCCTCCACGTCCTTTTAGATTACTTCGGAACCAAAAAACTCCACCAGATCCGTGACGGCTCTGCTCTCGCCGCTACTCTGTTTCAAGCCACCGGAGCTGCTCCTGGAACCTCAGGATTCGTTAACATAACGGATCTGAGAGGTGGTAAAGTTGGGTTTGGTCCTGACGGTGGAGATCTGTCTTCTTTCTTTGTTAAATCTATTGAAGAAGTTCCGTATAACATCTCCATTATTCAGATCAGTAGAGTTTTACCGTCGGAGACTGCGGCGGCTCCGACTCCTGCTCCGGCGGAGATGAATCTTACCGGAATAATGTCGGCTCATGGATGCAAAGTGTTTGCTGAGACTCTTCTCACTAACCCTGGAGCTTCAAAAACCTATCAGGAGAGTTTAGAAGGAGGCATGACAGTGTTCTGTCCAGGAGATGATGCAATGAAAGGTTTCTTGCCCAAATACAAGAACTTGACAGCTCCAAAGAAAGAAGCATTTCTCGATTTCCTCGCTGTCCCGACATATTACTCAATGGCGATGCTCAAATCCAACAATGGTCCGATGAACACACTTGCGACAGATGGAGCTAACAAGTTTGAGCTTACTGTACAGAACGATGGAGAGAAGGTTACCCTCAAGACAAGGATCAACACTGTCAAGATCGTTGATACTCTTATTGATGAGCAGCCTTTAGCTATATATGCGACTGATAAGGTTTTGTTGCCTAAAGAGTTGTTTAAGGCTTCGGCTGTTGAAGCTCCGGCTCCTGCTCCGGCACCAGAGGATGGTGATGTTGCGGATTCTCCAAAAGCGGCTAAAGGGAAAGCGAAAGGAAAGAAGAAGAAGGCTGCACCGTCGCCAGATAATGATCCTTTTGGTGACTCGGATTCGCCTGCCGAAGGGCCTGACGGAGAGGCCGATGATGCGACGGCAGATGATGCTTGTGCGGTTAGGATCATCGGAGGAGCTAAGGCTGGTTTGGTGGTGAGCTTGCTCTGCTTGTTTGCTTCTTCTTGGCTTCTATAGTTTCACTTCTTGTTTCTTCGATTCTTCCATGTTTTTTTTTTTTTTGTGAATCTTTTATTTATGGTTTTTGGGGGAGAGTAAATGAGGATTATTTATTTCCCTCTATTGTTGAGTTTTTTTATTTATTTAAAAGTTGGTTGTCGAATTAAATAGTCGGTAGTTTATATATTTGTGTGTTCTTGTTTCACGTGTTTGTTTAGTTGATGATGTAAACAAGTCCTGATTTTGGTGATCTTGTCATATTTTTCTTGTTTTTGT

SEQ ID NO: 2365 - DNA, 1840 bp, Arabidopsis thaliana
  misc_feature (1)..(1840): Ceres cDNA ID no. 13592995
  misc_feature (1)..(1840): Ceres CLONE  ID no. 151971
aagcacagcaaataatatcagaacacatttttttctttttataatttaatcaattaaatcaccaaactcaattaaataaaaagaaaaaattattattatcccttcttcttcttcttcttcgtcttcgtctttgattctcctgattcatgtcgcttaaatttttagcgatcttcgaatcccattttccttcgggaatctgacattttttctcgggaaattttttacccaaatcggagtaaagtatcgaatctagagaatccgctatggatgagacctattttgatctattgaatttctttaagaatccctcttttacagagacatttgtcgacatcttactatgcgcagttccgatttggctcgccgttatgatcgggttattaatcggatggtcttggcgtccaagatggaccggtttgatctatttagggtttcgttctaagcttcggtttttatggaccgcaccgcctgggtttggtgctcgtcggctttggcttgctttcaccgctctctctgctttctccgtttgccgaaccatctggtcaaggaatgacaccagagctaataaatcggcgaccggttcagcttcgtcgcagacgcctgttgaggataatgatgaatcaggattggcctcaagaggtagcgataacgggacggtgacagaggatattgtgacagagaatgatttagagcatctgcttcagctgcttgaagttggaaatgcagctttggaatggcaatctatgatggataagactactccaaatatgagctaccaggcttggcgtcatgagcctgagacaggtcctgttatttatcgcagccggactgtgtttgaggatgcaactccagatattgttagggatttcttctgggatgatgagtttcgacctaaatgggatttcatgcttgccaacttcaaaacgttggaggaggacactcagacaggaacaatgattgttcagtggagaaaaaagtttccttttttctgtagtgaccgagagtatatcattggccggagaatatgggagtctgggaagaagtattattgtgtcacaaagggagttccttatccagctctaccaaagcgtgataagccaaggcgtgttgagctttatttctcaagttgggttatcagagcggttgaatcccgaaaaggagatggacagcaaacggcttgtgaagtttcccttgtccactacgaagacatgggcatcccaaaagacgtagcaaagttaggtgtccgtcatggcatgtggggagctgtcaagaagctaaactccggtttacgagcgtaccaatccgccagaaaatcagactcatctctatctcggatcgcccaaatggcaagaatctctacaaaactgaacatgaattctgcagaatcatcttcaagagatgaagacagaagcagagcaatggaatatgcgagacaacgggaccatttgagaatggactggaaatgggttgttgtaggaggtgtcgcattggcttgtggcctacactctgggatcattggcaaggctttactggctggagctggccagagactggctcgtaggtgagaaaccttgtattcttattatatcttcccttgacagaaaagagaaacatatgcatataactaagggaaatgtattatttttgcaactcctctgagaagggcatgtggttttggtggtgaaccatgtagagtagtagctttaaactatggagtcataagttatttgagttctatcttgtaccacaggatagtgagatatgtattttataaactatatgaatctacatagcttctaaaagcttaaattctttgcatgtgatgcacttcgtatctccc

SEQ ID NO: 2366 - protein, 433 aa, Arabidopsis thaliana
  misc_feature: PFam Name: START; PFam Description: START domain
  misc_feature: GI Number: 46798907; NR Description: membrane related protein
  misc_feature: GI Number: 18033654; NR Description: putative nodule membrane
  misc_feature: GI Number: 10178166; NR Description: membrane related
  misc_feature: GI Number: 18423599; NR Description: membrane related
  misc_feature: GI Number: 50904921; NR Description: putative membrane related protein CP5 [Oryza sativa (japonica cultivar-group)] >gi|41053035|dbj|BAD07966.1| putative membrane related protein CP5
MDETYFDLLNFFKNPSFTETFVDILLCAVPIWLAVMIGLLIGWSWRPRWTGLIYLGFRSKLRFLWTAPPGFGARRLWLAFTALSAFSVCRTIWSRNDTRANKSATGSASSQTPVEDNDESGLASRGSDNGTVTEDIVTENDLEHLLQLLEVGNAALEWQSMMDKTTPNMSYQAWRHEPETGPVIYRSRTVFEDATPDIVRDFFWDDEFRPKWDFMLANFKTLEEDTQTGTMIVQWRKKFPFFCSDREYIIGRRIWESGKKYYCVTKGVPYPALPKRDKPRRVELYFSSWVIRAVESRKGDGQQTACEVSLVHYEDMGIPKDVAKLGVRHGMWGAVKKLNSGLRAYQSARKSDSSLSRIAQMARISTKLNMNSAESSSRDEDRSRAMEYARQRDHLRMDWKWVVVGGVALACGLHSGIIGKALLAGAGQRLARR

SEQ ID NO: 2367 - DNA, 1199 bp, Arabidopsis thaliana
  misc_feature (1)..(1199): Ceres cDNA ID no. 13593116
  misc_feature (1)..(1199): Also known as  Ceres CDNA ID no. 23472427
ttcctcttcttttctcttctccttccacttccacttcttctatctctcacaattcagcaatggcttcttctatagttacctctagcttgaagcctttagccatggccgattcttcctcttctaccattttctcccatccttccatctcctctaccatctcttcctccagaattcgcagctccagtgtttccctccttaccggacgcattaacctgcccctctctttctctcgcgtctctctatctcttaaaaccaaaacccaccttaaaaaatccccctttgtctccttcgttgcccagacttcggattgggctgaagaaggtggagaaggaagcgtcgctgttgaggagaccgagaacagtttagagtcacaagatgtgagcgaaggagatgagagcgaaggagatgcgagcgaaggagatgtgagcgaaggagatgagagcgaaggagatgtgagcgaaggagctgtgagcgaaagagctgagttcccggagccatcggaagaagccaagcttttcgtcggaaatttggcttatgatgttaatagccaagctttggctatgctctttgagcaagccggtactgttgaaatcgccgaggttatatacaatagggaaactgaccagagtcgtgggtttggatttgtgacaatgagttctgtggacgaagctgagacagctgtggagaagttcaaccgttatgatcttaacggacgtctactaactgtaaacaaggcagctccaagaggatcacgtccagaacgtgcgcctcgggtatatgaacctgcattcagagtatatgtagggaatctaccatgggatgtggacaatggccgtctagaacagcttttcagtgagcatggtaaagttgtggaagctagggtggtttacgaccgtgagacaggtcgttcacgtggattcgggtttgtcacaatgtctgacgtggatgaactcaacgaagccatctctgccctcgatggacagaacttggagggtagagcaatcagagtgaatgtagcggaagagcgtcctccaaggcgtggatattaaagctgagatctagctgtgccctctctctctccctatcttgcattttgtttagacgagattcttacactcttcaacgattgtttttggctgaactctgaatgtgaaagttaagctgcttctaaagtaatttgtatcgcttgtttttgatga

SEQ ID NO: 2368 - protein, 1199 aa, Arabidopsis thaliana
  misc_feature: PFam Name: Fasciclin; PFam Description: Fasciclin domain
  misc_feature: GI Number: 21593810; NR Description: putative pollen surface
  misc_feature: GI Number: 22655474; NR Description: At4g12730/T20K18_80 [Arabidopsis thaliana] >gi|4586249|emb|CAB40990.1| putative pollen surface protein [Arabidopsis thaliana] >gi|7267974|emb|CAB78315.1| putative pollen surface protein
  misc_feature: GI Number: 13377778; NR Description: fasciclin-like
  misc_feature: GI Number: 21618321; NR Description: unknown [Arabidopsis thaliana]
  misc_feature: GI Number: 21595125; NR Description: endosperm-specific
TTCCTCTTCTTTTCTCTTCTCCTTCCACTTCCACTTCTTCTATCTCTCACAATTCAGCAATGGCTTCTTCTATAGTTACCTCTAGCTTGAAGCCTTTAGCCATGGCCGATTCTTCCTCTTCTACCATTTTCTCCCATCCTTCCATCTCCTCTACCATCTCTTCCTCCAGAATTCGCAGCTCCAGTGTTTCCCTCCTTACCGGACGCATTAACCTGCCCCTCTCTTTCTCTCGCGTCTCTCTATCTCTTAAAACCAAAACCCACCTTAAAAAATCCCCCTTTGTCTCCTTCGTTGCCCAGACTTCGGATTGGGCTGAAGAAGGTGGAGAAGGAAGCGTCGCTGTTGAGGAGACCGAGAACAGTTTAGAGTCACAAGATGTGAGCGAAGGAGATGAGAGCGAAGGAGATGCGAGCGAAGGAGATGTGAGCGAAGGAGATGAGAGCGAAGGAGATGTGAGCGAAGGAGCTGTGAGCGAAAGAGCTGAGTTCCCGGAGCCATCGGAAGAAGCCAAGCTTTTCGTCGGAAATTTGGCTTATGATGTTAATAGCCAAGCTTTGGCTATGCTCTTTGAGCAAGCCGGTACTGTTGAAATCGCCGAGGTTATATACAATAGGGAAACTGACCAGAGTCGTGGGTTTGGATTTGTGACAATGAGTTCTGTGGACGAAGCTGAGACAGCTGTGGAGAAGTTCAACCGTTATGATCTTAACGGACGTCTACTAACTGTAAACAAGGCAGCTCCAAGAGGATCACGTCCAGAACGTGCGCCTCGGGTATATGAACCTGCATTCAGAGTATATGTAGGGAATCTACCATGGGATGTGGACAATGGCCGTCTAGAACAGCTTTTCAGTGAGCATGGTAAAGTTGTGGAAGCTAGGGTGGTTTACGACCGTGAGACAGGTCGTTCACGTGGATTCGGGTTTGTCACAATGTCTGACGTGGATGAACTCAACGAAGCCATCTCTGCCCTCGATGGACAGAACTTGGAGGGTAGAGCAATCAGAGTGAATGTAGCGGAAGAGCGTCCTCCAAGGCGTGGATATTAAAGCTGAGATCTAGCTGTGCCCTCTCTCTCTCCCTATCTTGCATTTTGTTTAGACGAGATTCTTACACTCTTCAACGATTGTTTTTGGCTGAACTCTGAATGTGAAAGTTAAGCTGCTTCTAAAGTAATTTGTATCGCTTGTTTTTGATGA

SEQ ID NO: 2369 - DNA, 1160 bp, Arabidopsis thaliana
  misc_feature (1)..(1160): Ceres cDNA ID no. 13593121
  misc_feature (1)..(1160): Ceres CLONE  ID no. 1148374
  misc_feature (1)..(1160): Also known as  Ceres CDNA ID no. 23656099
ggtcgatgtctccgatctccatcgtaattcagtttccttcaattgatgtgaccttcgattccaaactcgcaaacccagaaacgggttactcatagaaacagtgatagagagatatgaatgttgacgctagagtcggtgttgcggtcgatggagctcagagtgctcttaacactgcaaccactgttcatagtagcgtcgtcatgacgcagattaagccgcaggcaaagctaggaaccttccagaatctcctcgctggtggtattgccggcgccattagcaagacatgtaccgctcctcttgctcgcctcaccatcttgtttcagttgcaagggatgcaatcagaaggtgcagtgttaagccgtccaaacttacggcgtgaagcttcccgtattatcaacgaggaaggatatagagccttttggaaaggaaatttggttactgtagtacacaggattccttatactgcagtaaacttctatgcatatgagaagtacaatctatttttcaattcaaatccagtcgtacagagttttataggaaatacgagtggcaatccgatagtgcattttgttagtggtggcttggctggaattacagctgctacagctacatatcccctcgatcttgtcaggactcgtcttgctgcacagaggaatgcaatttactaccagggtattgagcatactttccgtaccatatgcagagaagagggaattttgggtctatataaaggacttggtgctacattattgggtgttggaccaagtcttgctatcaatttcgccgcgtacgagtctatgaaattgttttggcattctcataggccaaatgattcggatttggttgtttctcttgtttctggaggtctagctggagctgtttcttcaacagatgataaactttttgatgcccataactatgtagctacatacccattggatcttgtgagaagaagaatgcaagtggaaggagctggtggaagagcaagagtatacaacactggactctttggaacattcaaacacatattcaagtcagaaggcttcaaagggatatacagaggaatattgcctgaatattacaaagtagttcctggcgttggcatcgtcttcatgacatacgatgctttgcggagactcttaacttctctccccgattga

SEQ ID NO: 2370 - protein, 1160 aa, Arabidopsis thaliana
  misc_feature: PFam Name: Mito_carr; PFam Description: Mitochondrial
  misc_feature: GI Number: 51970652; NR Description: mitochondrial carrier
  misc_feature: GI Number: 23197668; NR Description: putative mitochondrial carrier protein [Arabidopsis thaliana] >gi|22135876|gb|AAM91520.1| putative mitochondrial carrier protein [Arabidopsis thaliana] >gi|51968668|dbj|BAD43026.1|
  misc_feature: GI Number: 4895195; NR Description: putative mitochondrial carrier protein [Arabidopsis thaliana] >gi|25295875|pir||D84798 probable mitochondrial carrier protein [imported] - Arabidopsis
  misc_feature: GI Number: 17104715; NR Description: putative Ca-dependent solute carrier protein [Arabidopsis thaliana] >gi|13877985|gb|AAK44070.1| putative Ca-dependent solute carrier
  misc_feature: GI Number: 21554682; NR Description: Ca-dependent solute
GGTCGATGTCTCCGATCTCCATCGTAATTCAGTTTCCTTCAATTGATGTGACCTTCGATTCCAAACTCGCAAACCCAGAAACGGGTTACTCATAGAAACAGTGATAGAGAGATATGAATGTTGACGCTAGAGTCGGTGTTGCGGTCGATGGAGCTCAGAGTGCTCTTAACACTGCAACCACTGTTCATAGTAGCGTCGTCATGACGCAGATTAAGCCGCAGGCAAAGCTAGGAACCTTCCAGAATCTCCTCGCTGGTGGTATTGCCGGCGCCATTAGCAAGACATGTACCGCTCCTCTTGCTCGCCTCACCATCTTGTTTCAGTTGCAAGGGATGCAATCAGAAGGTGCAGTGTTAAGCCGTCCAAACTTACGGCGTGAAGCTTCCCGTATTATCAACGAGGAAGGATATAGAGCCTTTTGGAAAGGAAATTTGGTTACTGTAGTACACAGGATTCCTTATACTGCAGTAAACTTCTATGCATATGAGAAGTACAATCTATTTTTCAATTCAAATCCAGTCGTACAGAGTTTTATAGGAAATACGAGTGGCAATCCGATAGTGCATTTTGTTAGTGGTGGCTTGGCTGGAATTACAGCTGCTACAGCTACATATCCCCTCGATCTTGTCAGGACTCGTCTTGCTGCACAGAGGAATGCAATTTACTACCAGGGTATTGAGCATACTTTCCGTACCATATGCAGAGAAGAGGGAATTTTGGGTCTATATAAAGGACTTGGTGCTACATTATTGGGTGTTGGACCAAGTCTTGCTATCAATTTCGCCGCGTACGAGTCTATGAAATTGTTTTGGCATTCTCATAGGCCAAATGATTCGGATTTGGTTGTTTCTCTTGTTTCTGGAGGTCTAGCTGGAGCTGTTTCTTCAACAGATGATAAACTTTTTGATGCCCATAACTATGTAGCTACATACCCATTGGATCTTGTGAGAAGAAGAATGCAAGTGGAAGGAGCTGGTGGAAGAGCAAGAGTATACAACACTGGACTCTTTGGAACATTCAAACACATATTCAAGTCAGAAGGCTTCAAAGGGATATACAGAGGAATATTGCCTGAATATTACAAAGTAGTTCCTGGCGTTGGCATCGTCTTCATGACATACGATGCTTTGCGGAGACTCTTAACTTCTCTCCCCGATTGA

SEQ ID NO: 2371 - DNA, 1146 bp, Arabidopsis thaliana
  misc_feature (1)..(1146): Ceres cDNA ID no. 13593326
  misc_feature (1)..(1146): Ceres CLONE  ID no. 43008
  misc_feature (1)..(1146): Also known as  Ceres CDNA ID no. 23472510
catcctaatgaaaattacgctgttcttcccctttccttccgaaattagggcttccgtgtttcgcagtgctctccatcaatccccagcttgacaatgcctcgctatgatgatcgctatgggaacactcgtctctacgttggccgattatcatcgagaactaggacccgagaccttgaacgtctttttagcagatacggaagagtgcgagatgtggatatgaagcgagattatgctttcgttgaatttggtgatccccgtgatgctgatgatgcaagacattacctggacggacgagactttgatggaagtcgcatcactgtggagttttcacgaggggcacctcgtggttctcgggattttgatagcagaggcccaccacctggagctggtcgctgttttaactgtggtgtagatggtcattgggctcgtgactgcacagcaggggactggaagaacaagtgttaccgttgtggagagagaggacacattgagagaaactgcaaaaacagccccaagaagcttaggcgcagtggaagctactccaggtcacctgtaagatcccgttctcctcgtcgtagaagaagcccaagccggagtcttagccgtagccgaagctacagccgatcacgatccccggtgagaagaagagagaggagtgtggaggagagatcacgcagtccaaagcggatggatgactctctatcgccaagagccagagatcgtagtccggttcttgatgatgaaggcagcccaaagatcatagacgggagcccaccaccatcaccaaagcttcaaaaggaagtcggatctgaccgtgacggtggtagcccccaagacaatggcagaaactctgttgtcagtcctgttgtaggagccggtggtgacagttcgaaagaggaccggagccctgttgatgatgattacgagccaaaccgcacttcccctagaggaagtgagtctccttaactttgatggctcatggccacggcttgcaggcattgtagcatgtatactattggatcgactgttcctttctcttttaagtgtgtttgctttagaaccttttaagtttcatgttaccaagagttttttcatttgagacataatgttgttgcgtttcttttggacaagttttcgaagattgtt

SEQ ID NO: 2372 - protein, 1146 aa, Arabidopsis thaliana
  misc_feature: PFam Name: RRM_1; PFam Description: RNA recognition motif.
  misc_feature: PFam Name: zf-CCHC; PFam Description: Zinc knuckle
  misc_feature: GI Number: 42571091; NR Description: splicing factor RSZ33
  misc_feature: GI Number: 9843663; NR Description: splicing factor RSZ33
  misc_feature: GI Number: 9795142; NR Description: splicing factor-like protein [Arabidopsis thaliana] >gi|30693839|ref|NP_190918.3| zinc
  misc_feature: GI Number: 24111329; NR Description: At3g53500/F4P12_200 [Arabidopsis thaliana] >gi|20465265|gb|AAM19952.1| AT3g53500/F4P12_200 [Arabidopsis thaliana] >gi|30693836|ref|NP_851015.1| zinc knuckle (CCHC-type) family
  misc_feature: GI Number: 11346381; NR Description: splicing factor-like
CATCCTAATGAAAATTACGCTGTTCTTCCCCTTTCCTTCCGAAATTAGGGCTTCCGTGTTTCGCAGTGCTCTCCATCAATCCCCAGCTTGACAATGCCTCGCTATGATGATCGCTATGGGAACACTCGTCTCTACGTTGGCCGATTATCATCGAGAACTAGGACCCGAGACCTTGAACGTCTTTTTAGCAGATACGGAAGAGTGCGAGATGTGGATATGAAGCGAGATTATGCTTTCGTTGAATTTGGTGATCCCCGTGATGCTGATGATGCAAGACATTACCTGGACGGACGAGACTTTGATGGAAGTCGCATCACTGTGGAGTTTTCACGAGGGGCACCTCGTGGTTCTCGGGATTTTGATAGCAGAGGCCCACCACCTGGAGCTGGTCGCTGTTTTAACTGTGGTGTAGATGGTCATTGGGCTCGTGACTGCACAGCAGGGGACTGGAAGAACAAGTGTTACCGTTGTGGAGAGAGAGGACACATTGAGAGAAACTGCAAAAACAGCCCCAAGAAGCTTAGGCGCAGTGGAAGCTACTCCAGGTCACCTGTAAGATCCCGTTCTCCTCGTCGTAGAAGAAGCCCAAGCCGGAGTCTTAGCCGTAGCCGAAGCTACAGCCGATCACGATCCCCGGTGAGAAGAAGAGAGAGGAGTGTGGAGGAGAGATCACGCAGTCCAAAGCGGATGGATGACTCTCTATCGCCAAGAGCCAGAGATCGTAGTCCGGTTCTTGATGATGAAGGCAGCCCAAAGATCATAGACGGGAGCCCACCACCATCACCAAAGCTTCAAAAGGAAGTCGGATCTGACCGTGACGGTGGTAGCCCCCAAGACAATGGCAGAAACTCTGTTGTCAGTCCTGTTGTAGGAGCCGGTGGTGACAGTTCGAAAGAGGACCGGAGCCCTGTTGATGATGATTACGAGCCAAACCGCACTTCCCCTAGAGGAAGTGAGTCTCCTTAACTTTGATGGCTCATGGCCACGGCTTGCAGGCATTGTAGCATGTATACTATTGGATCGACTGTTCCTTTCTCTTTTAAGTGTGTTTGCTTTAGAACCTTTTAAGTTTCATGTTACCAAGAGTTTTTTCATTTGAGACATAATGTTGTTGCGTTTCTTTTGGACAAGTTTTCGAAGATTGTT

SEQ ID NO: 2373 - DNA, 1538 bp, Arabidopsis thaliana
  misc_feature (1)..(1538): Ceres cDNA ID no. 13593435
  misc_feature (1)..(1538): Also known as  Ceres CDNA ID no. 23472510
gccggcaaattcttacgtttctccggcggttagaaaaatgacaccacagatcaaaactcatctcttgccgaagcaagaaccttcttcgtctgagaaccatggatcatcaacctccggcatcgttttcaacgtgtcaacgagtataatcggagccggaataatgtcgatgccggcggcgtttaaagttcttggaatagttccagcgtttttgattatcacgatcatagcttggctttccacaatttccgttggatttctgatgaaatcaactctcgccggagaatcaactacttacgccggagttatgaaagagtcgtttggtaaaacaggatccatcgctgtacagattgctacgatggttgctacttttggttgtatgattatattttcgattattataggagatgtgctttctggtaatgaaaatggtggtcctgaacatattggagttttgcaagaatggtttggttcttactggtggaacacgagaatcttcgctttgttatttgtctacggctttgtcttgcttccattggtcctgcgtagacgagtcgaaagactggcaattagttccgctgtatcgtttcttcttgcggttctatttgttgtcataagctcggtgctggcgatttccgcgctggtgaatggacaaacgaagaatccaagactgtttccggagttgagcaatggaggatcgttctggcaactcttcacagcttcccctgttatagttacagccttcacgtttcacttcaatgttcatccaattggattcgagctcaaagatccattacaagtgatcccagcaactaagatctctgtcatcttgtgtgctgctatctacttcgcaactggactctttggttaccttctctttggagatgcaactatgtcggatattctagtgaactttgaccagagctctggttcttccattggttctcttctcaacgacattgtcagactcagctacgtgcttcacctcatgctggtctttcctctcctgaacttctcattgagagcaaatctcgacgaactcttgtaccccaagaagccgtccttggaaaaagacacaaaaagattcatcggactcactctggctctactgatttgctgtttcttgtctgcaatcgctgtaccagacatttggtacttctttcagttcatgggatcaaccatcacagtctccatagcattcatatttccagccgccattgttctaaggaatatccatggtgtatcaacctcaagagagaagatcgtagctgcaataatgcttgttcttgctgttgccactagcattattgctatctcgacaaatttatacagcctcgcagcaaactagtcgttgaaaaaagttttgcaaacagtcccttccatgatcacttcaaagaaatctgtaaaattattagcttgccgtagcattcatatttatatctttgtgaaataggtttgtcagaaaatgcaatgtaatagctatacaaagtgcaatttttgttgctgcttgaaacagagaaagaggaaatgaacaactcttc

SEQ ID NO: 2374 - protein, 1538 aa, Arabidopsis thaliana
  misc_feature: PFam Name: RRM_1; PFam Description: RNA recognition motif.
  misc_feature: PFam Name: zf-CCHC; PFam Description: Zinc knuckle
  misc_feature: GI Number: 42571091; NR Description: splicing factor RSZ33
  misc_feature: GI Number: 9843663; NR Description: splicing factor RSZ33
  misc_feature: GI Number: 9795142; NR Description: splicing factor-like protein [Arabidopsis thaliana] >gi|30693839|ref|NP_190918.3| zinc
  misc_feature: GI Number: 24111329; NR Description: At3g53500/F4P12_200 [Arabidopsis thaliana] >gi|20465265|gb|AAM19952.1| AT3g53500/F4P12_200 [Arabidopsis thaliana] >gi|30693836|ref|NP_851015.1| zinc knuckle (CCHC-type) family
  misc_feature: GI Number: 11346381; NR Description: splicing factor-like
GCCGGCAAATTCTTACGTTTCTCCGGCGGTTAGAAAAATGACACCACAGATCAAAACTCATCTCTTGCCGAAGCAAGAACCTTCTTCGTCTGAGAACCATGGATCATCAACCTCCGGCATCGTTTTCAACGTGTCAACGAGTATAATCGGAGCCGGAATAATGTCGATGCCGGCGGCGTTTAAAGTTCTTGGAATAGTTCCAGCGTTTTTGATTATCACGATCATAGCTTGGCTTTCCACAATTTCCGTTGGATTTCTGATGAAATCAACTCTCGCCGGAGAATCAACTACTTACGCCGGAGTTATGAAAGAGTCGTTTGGTAAAACAGGATCCATCGCTGTACAGATTGCTACGATGGTTGCTACTTTTGGTTGTATGATTATATTTTCGATTATTATAGGAGATGTGCTTTCTGGTAATGAAAATGGTGGTCCTGAACATATTGGAGTTTTGCAAGAATGGTTTGGTTCTTACTGGTGGAACACGAGAATCTTCGCTTTGTTATTTGTCTACGGCTTTGTCTTGCTTCCATTGGTCCTGCGTAGACGAGTCGAAAGACTGGCAATTAGTTCCGCTGTATCGTTTCTTCTTGCGGTTCTATTTGTTGTCATAAGCTCGGTGCTGGCGATTTCCGCGCTGGTGAATGGACAAACGAAGAATCCAAGACTGTTTCCGGAGTTGAGCAATGGAGGATCGTTCTGGCAACTCTTCACAGCTTCCCCTGTTATAGTTACAGCCTTCACGTTTCACTTCAATGTTCATCCAATTGGATTCGAGCTCAAAGATCCATTACAAGTGATCCCAGCAACTAAGATCTCTGTCATCTTGTGTGCTGCTATCTACTTCGCAACTGGACTCTTTGGTTACCTTCTCTTTGGAGATGCAACTATGTCGGATATTCTAGTGAACTTTGACCAGAGCTCTGGTTCTTCCATTGGTTCTCTTCTCAACGACATTGTCAGACTCAGCTACGTGCTTCACCTCATGCTGGTCTTTCCTCTCCTGAACTTCTCATTGAGAGCAAATCTCGACGAACTCTTGTACCCCAAGAAGCCGTCCTTGGAAAAAGACACAAAAAGATTCATCGGACTCACTCTGGCTCTACTGATTTGCTGTTTCTTGTCTGCAATCGCTGTACCAGACATTTGGTACTTCTTTCAGTTCATGGGATCAACCATCACAGTCTCCATAGCATTCATATTTCCAGCCGCCATTGTTCTAAGGAATATCCATGGTGTATCAACCTCAAGAGAGAAGATCGTAGCTGCAATAATGCTTGTTCTTGCTGTTGCCACTAGCATTATTGCTATCTCGACAAATTTATACAGCCTCGCAGCAAACTAGTCGTTGAAAAAAGTTTTGCAAACAGTCCCTTCCATGATCACTTCAAAGAAATCTGTAAAATTATTAGCTTGCCGTAGCATTCATATTTATATCTTTGTGAAATAGGTTTGTCAGAAAATGCAATGTAATAGCTATACAAAGTGCAATTTTTGTTGCTGCTTGAAACAGAGAAAGAGGAAATGAACAACTCTTC

SEQ ID NO: 2375 - DNA, 1770 bp, Arabidopsis thaliana
  misc_feature (1)..(1770): Ceres cDNA ID no. 13593571
cccaatatcttcctttgtcaatctcttgagagtttttgcttcctcgtcttcttcgattcatcaaacagcgtgtgttttttgtttagagttggaagagacgaatcgaattttgaagctttcttttatgtctgacaagatatctccgttttgttgtcaatctggttgcttggaaaacacagtcctacatccagaattaaggactactactagttcctccatcactttagggtctcgcatcttcaaaccggagatccctcctctttctctccacttttttagctaagaagaatggcgctgcagaacattggtgcttccaaccgtaacgatgccttctacaggtacaagatgcctaagatggttaccaaaaccgaaggcaaaggtaatggcattaagaccaacattatcaacaatgttgagattgccaaagccttggctagaccgccttcttatacgaccaagtactttggttgtgagcttggagcgcagtctaagtttgatgagaagactgggacgtcgcttgtgaatggagctcacaacacgtctaagcttgctgggcttttggagaattttattaagaagtttgttcagtgttatggatgtggtaacccggagactgagattattattacgaagacgcagatggtgaatctcaagtgtgctgcttgtgggtttatctctgaggtcgacatgagggataagttgactaatttcattctcaagaacccacctgagcagaagaaggtgtcaaaggataagaaagcaatgaggaaagctgagaaggagaggcttaaagaaggcgagctagctgatgaggagcagagaaagctgaaagctaagaagaaagcattgtctaacggcaaggattctaagacgtctaagaaccattcttctgatgaggatataagcccgaagcatgatgagaatgctctagaggtggatgaggatgaagatgatgatgatggtgtcgagtggcaaactgatacttcccgagaagctgctgagaaaagaatgatggaacagttgagtgctaaaactgccgaaatggtgatgctctctgcaatggaagtagaagagaaaaaggcgcccaaaagcaaatctaacgggaacgttgtgaaaactgagaatcctcctccgcaagagaagaatctcgtgcaggatatgaaagagtatctgaagaaagggtcaccaataagcgcgctcaaaagtttcatctcgtctctctctgaacctcctcaagacatcatggacgcactcttcaatgctctctttgatggtgtgggaaagggattcgccaaagaagtgactaagaagaagaattacttagcggctgctgcaacaatgcaagaggatggatcacagatgcatctgctcaattcgattgggacattctgtggaaagaatggaaacgaagaagctttgaaagaggtggctctggttcttaaagcattgtacgaccaagacatcattgaggaagaggtagtgttggattggtacgaaaagggtctcaccggagctgacaaaagctcgccggtttggaagaatgttaagccttttgtggagtggcttcagagcgctgagtctgagtccgaagaggaggattgagtcacttttttcttccctcctaacttttctttgcggcatttcttataatacttcgtcagttttcagaattcttaaatctttttgctgtgttcttataaagaaacatcatctattaaagttgtcttcgtttggatttggttttgacgactttgggaaatatttatgttt

SEQ ID NO: 2376 - protein, 437 aa, Arabidopsis thaliana
  misc_feature: PFam Name: eIF-5_eIF-2B; PFam Description: Domain found in
  misc_feature: PFam Name: W2; PFam Description: eIF4-gamma/eIF5/eIF2-epsilon
  misc_feature: PFam Name: eIF-3c_N; PFam Description: Eukaryotic
  misc_feature: GI Number: 15810339; NR Description: putative eukaryotic
  misc_feature: GI Number: 21387159; NR Description: putative eukaryotic translation initiation factor 5 [Arabidopsis thaliana] gi|17473619|gb|AAL38273.1| putative eukaryotic translation initiation factor 5 [Arabidopsis thaliana]
  misc_feature: GI Number: 4160402; NR Description: eukaryotic translation
  misc_feature: GI Number: 1806575; NR Description: Eukaryotic initiation factor-5 [Zea mays] gi|2494320|sp|P55876|IF5_MAIZE Eukaryotic translation initiation factor 5 (eIF-5) gi|7489730|pir||JC5595
  misc_feature: GI Number: 42733476; NR Description: BRI1-KD interacting
MALQNIGASNRNDAFYRYKMPKMVTKTEGKGNGIKTNIINNVEIAKALARPPSYTTKYFGCELGAQSKFDEKTGTSLVNGAHNTSKLAGLLENFIKKFVQCYGCGNPETEIIITKTQMVNLKCAACGFISEVDMRDKLTNFILKNPPEQKKVSKDKKAMRKAEKERLKEGELADEEQRKLKAKKKALSNGKDSKTSKNHSSDEDISPKHDENALEVDEDEDDDDGVEWQTDTSREAAEKRMMEQLSAKTAEMVMLSAMEVEEKKAPKSKSNGNVVKTENPPPQEKNLVQDMKEYLKKGSPISALKSFISSLSEPPQDIMDALFNALFDGVGKGFAKEVTKKKNYLAAAATMQEDGSQMHLLNSIGTFCGKNGNEEALKEVALVLKALYDQDIIEEEVVLDWYEKGLTGADKSSPVWKNVKPFVEWLQSAESESEEED

SEQ ID NO: 2377 - DNA, 1314 bp, Zea mays
  misc_feature (1)..(1314): Ceres cDNA ID no. 13599438
  misc_feature (1)..(1314): Ceres CLONE  ID no. 1063866
  misc_feature (1)..(1314): Also known as  Ceres CDNA ID no. 23827422
accaggatcagcaaagagacatccaagaactccaatggctgatgagtcatggaggctgccgagttcagtgcagcaactggctgccagcatacaggagccaccaaggcagtacttgctcagagagcaagaaccgcttggtgggaacctggctggtacggagatgccggaccccattccaacaatcgatctcggcctgctgtctgcatccaacgacgcggaggaagccgccaagctgcggtcggcactgcagacctggggattcttcaaggtttctaaccatggaatggagacctctctgatggattctgtgatgaccgcatcaagggatttcttccgcctaccgcttgaagagaagagaaagtacagtaacataataggtgggaaacatttccagatggaagggtatggaactgaccaggtgaaaactcaagaccaaaggctggactggtccgatcgactgcatcttaaagtggagccagaggacgagagaaaccttgccctttggcccatacatccaaaatctttcagggatgacctgcatgagtacacattgaggagcaagagaattaaagacgacatccttcgggcaatggccaagctactggagctcgatgaagattgcctagttaaccagtttagcgacagggctctcacttatgctagattcaattactatcctccatgtccaaggcctgatcttgtcttgggcatcaagcctcactctgatgtctacgctcttacggttcttctaatggacaaagatgtcgctgggctgcagtttctcagagatggaacgtggtacaatgtcccatctgcgtctaactacaccttgctgatcaacgttggtgttacaatggagataatgaccaacgggatatttaaagggccagtacatagggttgtgactaattctgagaaagagaggatgtcagtggccgtgttctatggcctggatcctgaaagagagattggaccgatagctcagatgttgactgaggaccaaccggcgcgatacaggaaaatgaaggtcaaggatttcctggtcgcgcaccttgagcatttctctcgaggagaaagagtcgtcgattcgttaaggatatgatcaaggtgagtttgctttggtgctgcaatacccatggaataaagaatttgtgacttgcctattcgttaaggatataaacgaggcgactttacttctataaggcgatgaatctggtgaaaataaataatttcatcgtatttatgttgcattttgggtttgttctgtggtagatgtggctctatggacacctttgtattctcttacctcaagtg

SEQ ID NO: 2378 - protein, 355 aa, Zea mays
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
MADESWRLPSSVQQLAASIQEPPRQYLLREQEPLGGNLAGTEMPDPIPTIDLGLLSASNDAEEAAKLRSALQTWGFFKVSNHGMETSLMDSVMTASRDFFRLPLEEKRKYSNIIGGKHFQMEGYGTDQVKTQDQRLDWSDRLHLKVEPEDERNLALWPIHPKSFRDDLHEYTLRSKRIKDDILRAMAKLLELDEDCLVNQFSDRALTYARFNYYPPCPRPDLVLGIKPHSDVYALTVLLMDKDVAGLQFLRDGTWYNVPSASNYTLLINVGVTMEIMTNGIFKGPVHRVVTNSEKERMSVAVFYGLDPEREIGPIAQMLTEDQPARYRKMKVKDFLVAHLEHFSRGERVVDSLRI

SEQ ID NO: 2379 - DNA, 1703 bp, Arabidopsis thaliana
  misc_feature (1)..(1703): Ceres cDNA ID no. 13600880
  misc_feature (1)..(1703): Also known as  Ceres CDNA ID no. 23827422
accgctccaacttactaagataaacactctcattctaaaatgtctcttccatatacaattctcattctatttatattttcaacatcttcatcttatttgatccccctcgcacactccaaaatcgctagacttgggatttcctcaaaaacgctaaagaatgaacctgatggatcaacgcaaaaagtagatgaatctaatcttaaaatgtactactttaatcagacactcgatcacttcacattcacaccggaaagctacatgacttttcaacaaagatacgccattgattccacgcactggggtggtgctaaagccaacgcgccaatcttagcatttcttggagaagaatcgtcgttagactctgatttggctgccatcggttttcttcgtgacaacggtcctcgcctaaatgcgctcctcgtctacatagagcataggtattatggggagacgatgccatttggatcagcagaagaagcactaaagaacgcaagtacgttggggtatttgaacgcagcacaagccctagcagactatgccgcgattctcttgcacgttaaggagaagtactccaccaatcacagccctatcattgtaattggaggatcctatggtggaatgttagcggcatggttcaggctaaaatatccacacatagcactcggagcattagcatcttcagctcctcttctctactttgaagatactcgtcctaaatttggttattattatattgtaaccaaagttttcaaggaagcaagtgaaagatgttataatacaatccgtaattcttggatagaaatcgatagagttgctggcaaacccaatggtctctcgatccttagcaaacaattcaaaacttgcgctccattgaacggaagcttcgatatcaaagactttttggacacaatatatgccgaagctgttcaatacaaccgaggtccgaatttttgggtggccaaagtgtgcaacgcaatcaacgccaatccaccaaaccgtagatacaatttactcgaccggatttttgctggtgttgtcgctttagtaggcaaccgaacttgctatgatacaaaaatgtttgcgcagccaacaaacaataacatcgcatggagatggcagagctgcagcgagatagtgatgcccgtgggatatgacaaacaagatacaatgttcccaacggcaccatttaacatgaccagttacattgatggatgtaagtcttatcatggtgtcactcctagaccacattggatcacaacttatttcggcattcaggaggtcaagttaatcctccaaaaatttggaagcaacatcattttctctaatggattgtctgatccttatagcgttggcggagttttggaggatatttcagatactttagttgccattacgacaaaaaatggttcacattgtctagatatcaccttgaagagcaaagaagatccggagtggctagtgattcaaagagagaaagagattaaagttattgattcttggatttcaacttatcaaaatgatctaagagatcttaacatgccagtctaggttcataagttatataaaatttatattatataagacgatggtatccgcatccggtttcactcacgaccttaaattggagctctatcactttttgtgtgtttcaacactctcattctaatctctcaaaacattaagctaaaagatgcatttattgt

SEQ ID NO: 2380 - protein, 1703 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ACCGCTCCAACTTACTAAGATAAACACTCTCATTCTAAAATGTCTCTTCCATATACAATTCTCATTCTATTTATATTTTCAACATCTTCATCTTATTTGATCCCCCTCGCACACTCCAAAATCGCTAGACTTGGGATTTCCTCAAAAACGCTAAAGAATGAACCTGATGGATCAACGCAAAAAGTAGATGAATCTAATCTTAAAATGTACTACTTTAATCAGACACTCGATCACTTCACATTCACACCGGAAAGCTACATGACTTTTCAACAAAGATACGCCATTGATTCCACGCACTGGGGTGGTGCTAAAGCCAACGCGCCAATCTTAGCATTTCTTGGAGAAGAATCGTCGTTAGACTCTGATTTGGCTGCCATCGGTTTTCTTCGTGACAACGGTCCTCGCCTAAATGCGCTCCTCGTCTACATAGAGCATAGGTATTATGGGGAGACGATGCCATTTGGATCAGCAGAAGAAGCACTAAAGAACGCAAGTACGTTGGGGTATTTGAACGCAGCACAAGCCCTAGCAGACTATGCCGCGATTCTCTTGCACGTTAAGGAGAAGTACTCCACCAATCACAGCCCTATCATTGTAATTGGAGGATCCTATGGTGGAATGTTAGCGGCATGGTTCAGGCTAAAATATCCACACATAGCACTCGGAGCATTAGCATCTTCAGCTCCTCTTCTCTACTTTGAAGATACTCGTCCTAAATTTGGTTATTATTATATTGTAACCAAAGTTTTCAAGGAAGCAAGTGAAAGATGTTATAATACAATCCGTAATTCTTGGATAGAAATCGATAGAGTTGCTGGCAAACCCAATGGTCTCTCGATCCTTAGCAAACAATTCAAAACTTGCGCTCCATTGAACGGAAGCTTCGATATCAAAGACTTTTTGGACACAATATATGCCGAAGCTGTTCAATACAACCGAGGTCCGAATTTTTGGGTGGCCAAAGTGTGCAACGCAATCAACGCCAATCCACCAAACCGTAGATACAATTTACTCGACCGGATTTTTGCTGGTGTTGTCGCTTTAGTAGGCAACCGAACTTGCTATGATACAAAAATGTTTGCGCAGCCAACAAACAATAACATCGCATGGAGATGGCAGAGCTGCAGCGAGATAGTGATGCCCGTGGGATATGACAAACAAGATACAATGTTCCCAACGGCACCATTTAACATGACCAGTTACATTGATGGATGTAAGTCTTATCATGGTGTCACTCCTAGACCACATTGGATCACAACTTATTTCGGCATTCAGGAGGTCAAGTTAATCCTCCAAAAATTTGGAAGCAACATCATTTTCTCTAATGGATTGTCTGATCCTTATAGCGTTGGCGGAGTTTTGGAGGATATTTCAGATACTTTAGTTGCCATTACGACAAAAAATGGTTCACATTGTCTAGATATCACCTTGAAGAGCAAAGAAGATCCGGAGTGGCTAGTGATTCAAAGAGAGAAAGAGATTAAAGTTATTGATTCTTGGATTTCAACTTATCAAAATGATCTAAGAGATCTTAACATGCCAGTCTAGGTTCATAAGTTATATAAAATTTATATTATATAAGACGATGGTATCCGCATCCGGTTTCACTCACGACCTTAAATTGGAGCTCTATCACTTTTTGTGTGTTTCAACACTCTCATTCTAATCTCTCAAAACATTAAGCTAAAAGATGCATTTATTGT

SEQ ID NO: 2381 - DNA, 1259 bp, Arabidopsis thaliana
  misc_feature (1)..(1259): Ceres cDNA ID no. 13600945
  misc_feature (1)..(1259): Also known as  Ceres CDNA ID no. 23827422
aaacaacacacacacaaatggctcctcgtgtgatcttcttacttctctcgcttgtttttctctacctcgcaaacacatcacactctttgagaaagtttcaatcatttctacaccctatttataaagacacggccaaaaatatatacaccatccctttgtccatcggctcaacttccagcgaaaaattcgtccttgacctcaacggagccgcaccgttattgcaaaactgtccaaccgccgccaaatccaccacctaccacccaatcagatgtggctccacaagatgcaaatacgcaaaccccaacttcccctgtcccaacaatgtcattgccaagaagaggaccgtgtgtctctcctccgacaattcccgcctattccgagacaccgtccccttgttatacacatttaatggagtttacactagggacagtgaaatgagttcttcattgactttgacttgcactgacggtgctcctgccttaaaacaaagaaccatcggtctcgctaacacccacttgtcgattccctcgcagctcatctccatgtaccagcttcctcataagatagctctttgtttgccttccaccgaacgaagtcagtctcataatggtgacctttggatcggtaaaggggaatattattatctgccttacgataaagatgtctctaagatctttgcctccacgcctctgatcggtaatggcaagtccggcgagtacttaatcgatgtgaagtccatccaaatcggtgcaaagaccgttcctataccctatggagccacaaagatcagcactttggctccttacaccgtattccaaacttccctttacaaggctctgctcacagctttcaccgaaaacatcaagatagctaaagctcccgcggtgaagcctttcggtgcgtgcttctactccaatggaggacgtggagttcccgtgatcgacctggtgctgagcggaggggctaagtggaggatctacgggtctaattccttggtgaaggtgaataaaaatgtggtttgtttagggtttgtggacggaggtgtgaagccgaagtaccctatagtgatcggaggatttcagatggaggataatttggtggagttcgatcttgaagcttccaaattttctttctcctcttctcttttgcttcacaacacttcttgctcagtgcaaaggttgtctcctttctaatgcatgtgatcgattattcatgttatcaagacatatcatcaatttcctttttaataaattaatgtc

SEQ ID NO: 2382 - protein, 1259 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
AAACAACACACACACAAATGGCTCCTCGTGTGATCTTCTTACTTCTCTCGCTTGTTTTTCTCTACCTCGCAAACACATCACACTCTTTGAGAAAGTTTCAATCATTTCTACACCCTATTTATAAAGACACGGCCAAAAATATATACACCATCCCTTTGTCCATCGGCTCAACTTCCAGCGAAAAATTCGTCCTTGACCTCAACGGAGCCGCACCGTTATTGCAAAACTGTCCAACCGCCGCCAAATCCACCACCTACCACCCAATCAGATGTGGCTCCACAAGATGCAAATACGCAAACCCCAACTTCCCCTGTCCCAACAATGTCATTGCCAAGAAGAGGACCGTGTGTCTCTCCTCCGACAATTCCCGCCTATTCCGAGACACCGTCCCCTTGTTATACACATTTAATGGAGTTTACACTAGGGACAGTGAAATGAGTTCTTCATTGACTTTGACTTGCACTGACGGTGCTCCTGCCTTAAAACAAAGAACCATCGGTCTCGCTAACACCCACTTGTCGATTCCCTCGCAGCTCATCTCCATGTACCAGCTTCCTCATAAGATAGCTCTTTGTTTGCCTTCCACCGAACGAAGTCAGTCTCATAATGGTGACCTTTGGATCGGTAAAGGGGAATATTATTATCTGCCTTACGATAAAGATGTCTCTAAGATCTTTGCCTCCACGCCTCTGATCGGTAATGGCAAGTCCGGCGAGTACTTAATCGATGTGAAGTCCATCCAAATCGGTGCAAAGACCGTTCCTATACCCTATGGAGCCACAAAGATCAGCACTTTGGCTCCTTACACCGTATTCCAAACTTCCCTTTACAAGGCTCTGCTCACAGCTTTCACCGAAAACATCAAGATAGCTAAAGCTCCCGCGGTGAAGCCTTTCGGTGCGTGCTTCTACTCCAATGGAGGACGTGGAGTTCCCGTGATCGACCTGGTGCTGAGCGGAGGGGCTAAGTGGAGGATCTACGGGTCTAATTCCTTGGTGAAGGTGAATAAAAATGTGGTTTGTTTAGGGTTTGTGGACGGAGGTGTGAAGCCGAAGTACCCTATAGTGATCGGAGGATTTCAGATGGAGGATAATTTGGTGGAGTTCGATCTTGAAGCTTCCAAATTTTCTTTCTCCTCTTCTCTTTTGCTTCACAACACTTCTTGCTCAGTGCAAAGGTTGTCTCCTTTCTAATGCATGTGATCGATTATTCATGTTATCAAGACATATCATCAATTTCCTTTTTAATAAATTAATGTC

SEQ ID NO: 2383 - DNA, 1535 bp, Arabidopsis thaliana
  misc_feature (1)..(1535): Ceres cDNA ID no. 13600949
  misc_feature (1)..(1535): Also known as  Ceres CDNA ID no. 23827422
acaaacaatcacattcatcatttcatttaccaaaaaaaattataacctgaatataatagagatgggtagtagcctcacgcgcctactagtcttcctttccattttcgcagccatagctctgaaatcaaactctcaataccttcttccgatcaccaagcacgaacccaccaatctattctacaccactttcaacgtcggatccgccgcaaaatctcctgtaaacctcctcctcgacctcggaacaaacctcacgtggctcgactgccgcaaacttaaatctttatcatctctccgcctagtcacttgccagagctccacatgcaagtctatccccggtaatggatgcgctggcaaatcttgtctttacaagcaaccaaacccactcggacaaaaccccgttgtaaccggccgtgtcgtccaagacagagcttccctctacaccacagacggcggcaagttcctctctcaagtctccgtccgccacttcacattctcatgcgccggtgagaaagccctccaaggccttcctcctccagtcgacggagttctggctctttctcccggatcttcgtcgttcacgaaacaagtgacgtcagcgtttaacgtcatccctaaattctctctctgcttgccttcttccggtaccggtcatttctatatcgccggcattcactactttatcccaccattcaatagtagcgataatccgattccaaggactttaactcccattaaaggcactgactcaggagattatctaatcactgtaaaatctatctacgttggtggaactgctttgaagttgaaccctgatttgctaaccggcggagccaaactcagtacggtggttcactacaccgtacttcaaaccgatatctacaatgctcttgctcagtcttttacactcaaggctaaggctatgggaatagctaaggttccatcggtggcgccgtttaaacattgttttgattcacgcaccgctggaaagaatttgacggcggggcctaacgtgcccgtgatagagattggtctgccggggaggataggggaggtaaagtgggggttctacggtgcgaatacggtggtgaaagtgaaggaaacggtgatgtgtttggcgtttatcgacggtggaaagacaccgaaggatttgatggtgattgggacacatcagcttcaagatcatatgctcgagttcgatttcagcgggacggttctcgcttttagtgagtcactcttgctccataacacaagctgctccacttggccttcccaaaaatagaatcatcagtcactcatgatagtatcacagtttttggtcttgtatgacacgttttcagcgacacatgtgttctaatcgaaattttaagaaattatcacccgtttctcataaatatcgtctatgttattttattcaaatttgatattcgcttgttttgataaaaaatattgtctgaggattttgcacattaataattatctaaagtattctgtatttcttattagaaattgcaatttagatttgaaattcaaaagtt

SEQ ID NO: 2384 - protein, 1535 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ACAAACAATCACATTCATCATTTCATTTACCAAAAAAAATTATAACCTGAATATAATAGAGATGGGTAGTAGCCTCACGCGCCTACTAGTCTTCCTTTCCATTTTCGCAGCCATAGCTCTGAAATCAAACTCTCAATACCTTCTTCCGATCACCAAGCACGAACCCACCAATCTATTCTACACCACTTTCAACGTCGGATCCGCCGCAAAATCTCCTGTAAACCTCCTCCTCGACCTCGGAACAAACCTCACGTGGCTCGACTGCCGCAAACTTAAATCTTTATCATCTCTCCGCCTAGTCACTTGCCAGAGCTCCACATGCAAGTCTATCCCCGGTAATGGATGCGCTGGCAAATCTTGTCTTTACAAGCAACCAAACCCACTCGGACAAAACCCCGTTGTAACCGGCCGTGTCGTCCAAGACAGAGCTTCCCTCTACACCACAGACGGCGGCAAGTTCCTCTCTCAAGTCTCCGTCCGCCACTTCACATTCTCATGCGCCGGTGAGAAAGCCCTCCAAGGCCTTCCTCCTCCAGTCGACGGAGTTCTGGCTCTTTCTCCCGGATCTTCGTCGTTCACGAAACAAGTGACGTCAGCGTTTAACGTCATCCCTAAATTCTCTCTCTGCTTGCCTTCTTCCGGTACCGGTCATTTCTATATCGCCGGCATTCACTACTTTATCCCACCATTCAATAGTAGCGATAATCCGATTCCAAGGACTTTAACTCCCATTAAAGGCACTGACTCAGGAGATTATCTAATCACTGTAAAATCTATCTACGTTGGTGGAACTGCTTTGAAGTTGAACCCTGATTTGCTAACCGGCGGAGCCAAACTCAGTACGGTGGTTCACTACACCGTACTTCAAACCGATATCTACAATGCTCTTGCTCAGTCTTTTACACTCAAGGCTAAGGCTATGGGAATAGCTAAGGTTCCATCGGTGGCGCCGTTTAAACATTGTTTTGATTCACGCACCGCTGGAAAGAATTTGACGGCGGGGCCTAACGTGCCCGTGATAGAGATTGGTCTGCCGGGGAGGATAGGGGAGGTAAAGTGGGGGTTCTACGGTGCGAATACGGTGGTGAAAGTGAAGGAAACGGTGATGTGTTTGGCGTTTATCGACGGTGGAAAGACACCGAAGGATTTGATGGTGATTGGGACACATCAGCTTCAAGATCATATGCTCGAGTTCGATTTCAGCGGGACGGTTCTCGCTTTTAGTGAGTCACTCTTGCTCCATAACACAAGCTGCTCCACTTGGCCTTCCCAAAAATAGAATCATCAGTCACTCATGATAGTATCACAGTTTTTGGTCTTGTATGACACGTTTTCAGCGACACATGTGTTCTAATCGAAATTTTAAGAAATTATCACCCGTTTCTCATAAATATCGTCTATGTTATTTTATTCAAATTTGATATTCGCTTGTTTTGATAAAAAATATTGTCTGAGGATTTTGCACATTAATAATTATCTAAAGTATTCTGTATTTCTTATTAGAAATTGCAATTTAGATTTGAAATTCAAAAGTT

SEQ ID NO: 2385 - DNA, 1330 bp, Arabidopsis thaliana
  misc_feature (1)..(1330): Ceres cDNA ID no. 13600952
  misc_feature (1)..(1330): Also known as  Ceres CDNA ID no. 23827422
attcacaataaaccagcgtcggcccaccgcatcccaaaccataacgcttaatccttaaaaaccgtccagatccatttccttcctctaaaactcatcacacacacttctaatggcttcttcttcttgtttgaatctcttcttcttctcttttctctccgctctaatcatttctaaatctcagatctctgattccgttaacggggtcgttttccctgttgttaaagaccttccaaccggtcaatacctcgcacagattcgactcggtgactcaccggatccagtcaagctcgtagtcgatctggccggctcaattctctggtttgattgttcctcaagacatgtttcctcgtcaaggaacctaatatccggtagctctagcggctgcttaaaggcaaaagttggaaatgaacgagtatcatcatcatcatcatcgcgtaaagaccaaaacgccgattgcgaattacttgttaaaaacgacgcctttgggattacggcgagaggagagcttttcagtgacgtcatgtcggttggctctgttacttctccgggaaccgttgatctacttttcgcttgtactccaccgtggctgttacgtgggctcgctagtggagcccaaggagtaatgggcttaggaagggcccaaatctcactcccttcacaactcgccgcggaaactaacgaacgtcgtcggttaactgtttacctgtcgccgttgaacggtgtcgtatcaacgagttcggtggaggaggtttttggagtggctgcgtctagatcgctggtttacacgcctttgttaaccggttcgagtggcaactacgtaattaacgtgaaatcgattagagtcaacggggaaaagctctccgtggaaggtccgttggcggtggagctgagcacggtggttccttacacgattttagagagctcgatctacaaggtgttcgcggaagcttacgccaaagctgcgggtgaagctacatcggtgcctcctgtcgcaccgtttgggctctgcttcactagtgacgtagattttccggcggtagatctagcgttgcagagtgagatggtgcggtggaggattcatgggaagaatctgatggtggatgttggtggtggagtccgatgctcggggattgttgacggcgggtcaagtcgagtcaacccgattgtaatgggtgggctacaattagaaggctttatattggactttgatttgggtaactcaatgatgggctttggacaaagaacacgctctgattcaacttcgttgtaatacagaaacctttgtaattgtaaccttctaattatctggtagatatcctcaattttgatc

SEQ ID NO: 2386 - protein, 1330 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATTCACAATAAACCAGCGTCGGCCCACCGCATCCCAAACCATAACGCTTAATCCTTAAAAACCGTCCAGATCCATTTCCTTCCTCTAAAACTCATCACACACACTTCTAATGGCTTCTTCTTCTTGTTTGAATCTCTTCTTCTTCTCTTTTCTCTCCGCTCTAATCATTTCTAAATCTCAGATCTCTGATTCCGTTAACGGGGTCGTTTTCCCTGTTGTTAAAGACCTTCCAACCGGTCAATACCTCGCACAGATTCGACTCGGTGACTCACCGGATCCAGTCAAGCTCGTAGTCGATCTGGCCGGCTCAATTCTCTGGTTTGATTGTTCCTCAAGACATGTTTCCTCGTCAAGGAACCTAATATCCGGTAGCTCTAGCGGCTGCTTAAAGGCAAAAGTTGGAAATGAACGAGTATCATCATCATCATCATCGCGTAAAGACCAAAACGCCGATTGCGAATTACTTGTTAAAAACGACGCCTTTGGGATTACGGCGAGAGGAGAGCTTTTCAGTGACGTCATGTCGGTTGGCTCTGTTACTTCTCCGGGAACCGTTGATCTACTTTTCGCTTGTACTCCACCGTGGCTGTTACGTGGGCTCGCTAGTGGAGCCCAAGGAGTAATGGGCTTAGGAAGGGCCCAAATCTCACTCCCTTCACAACTCGCCGCGGAAACTAACGAACGTCGTCGGTTAACTGTTTACCTGTCGCCGTTGAACGGTGTCGTATCAACGAGTTCGGTGGAGGAGGTTTTTGGAGTGGCTGCGTCTAGATCGCTGGTTTACACGCCTTTGTTAACCGGTTCGAGTGGCAACTACGTAATTAACGTGAAATCGATTAGAGTCAACGGGGAAAAGCTCTCCGTGGAAGGTCCGTTGGCGGTGGAGCTGAGCACGGTGGTTCCTTACACGATTTTAGAGAGCTCGATCTACAAGGTGTTCGCGGAAGCTTACGCCAAAGCTGCGGGTGAAGCTACATCGGTGCCTCCTGTCGCACCGTTTGGGCTCTGCTTCACTAGTGACGTAGATTTTCCGGCGGTAGATCTAGCGTTGCAGAGTGAGATGGTGCGGTGGAGGATTCATGGGAAGAATCTGATGGTGGATGTTGGTGGTGGAGTCCGATGCTCGGGGATTGTTGACGGCGGGTCAAGTCGAGTCAACCCGATTGTAATGGGTGGGCTACAATTAGAAGGCTTTATATTGGACTTTGATTTGGGTAACTCAATGATGGGCTTTGGACAAAGAACACGCTCTGATTCAACTTCGTTGTAATACAGAAACCTTTGTAATTGTAACCTTCTAATTATCTGGTAGATATCCTCAATTTTGATC

SEQ ID NO: 2387 - DNA, 1437 bp, Arabidopsis thaliana
  misc_feature (1)..(1437): Ceres cDNA ID no. 13601143
  misc_feature (1)..(1437): Also known as  Ceres CDNA ID no. 23827422
atcaaattaaaaccctccagcctccaacaacaaaatttaccaacactctctctttctctttctctctgaaaacttaaaacgatggctataaccgccactcaaaacgacggcgtttcactaaacgccaataagatttcgtatgatcttgtggaaactgatgttgagatcatcacctccggtcgtcgtagtattccggcacactccggcatcctcgcttcggtctcaccggtactgacgaacatcatcgagaagccgaggaagattcacggcggatcatcgaagaaagttattaagattctcggtgttccatgcgacgccgtttcagtcttcgtcagattcctctattctccgagtgtcacggagaatgagatggaaaaatacggaatccatctactggctttatcacacgtgtatatggtgactcagttaaagcaacggtgcactaaaggcgtcggtgagagagtaaccgccgaaaacgttgtcgatattctccagctggctcgtctctgcgacgcacctgacctctgtctcaagtgtatgcgattcattcactacaagttcaagaccgttgaacagacagaaggatggaagtttcttcaagaacacgatccttttcttgaacttgacattctccaattcatcgacgatgcagaatcgaggaagaaaagaagaaggagacacagacgagaacagaatctgtatttgcagctgagtgaagccatggaatgtatagaacacatatgcaccgaaggttgcacactggtcggaccatcgtctaacttagacaacaagtcaacatgtcaagcaaaacccggtccatgcagtgcgttttcgacttgttacggacttcaacttcttatacgtcactttgcagtatgcaagaaaagagtcgatggcaaaggttgtgtccgatgcaagagaatgattcaactccttagactccattcttcgatttgtgaccaatctgaatcttgccgtgtccctctttgcaggcaatataagaatagaggtgaaaaggacaagaaaatggttgaggacacgaagtggaaggttctggtgagaagagtagcgtctgctaaagccatgtcttcgttgtctcaatcaaagaagaaaaaaagtgaagtgttatttaaagaagaagcagaagatttgatcagaatccggaacaagttaatgtgaatatacaatatatgtgtttttattagattatatagtgagcgattgttagaagccattaattacttgagtcggaaggtttatttgtttgttatttgtctctcggactggttgattgggttaaacttgtcaatgagtaaccctttgaatctgtcgttttgtttggtcggtcgaattatatagaaatgtattattggttataaaatggtattagggtttttggagactttgtggcaaaaagtatacagattgatccggttt

SEQ ID NO: 2388 - protein, 1437 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATCAAATTAAAACCCTCCAGCCTCCAACAACAAAATTTACCAACACTCTCTCTTTCTCTTTCTCTCTGAAAACTTAAAACGATGGCTATAACCGCCACTCAAAACGACGGCGTTTCACTAAACGCCAATAAGATTTCGTATGATCTTGTGGAAACTGATGTTGAGATCATCACCTCCGGTCGTCGTAGTATTCCGGCACACTCCGGCATCCTCGCTTCGGTCTCACCGGTACTGACGAACATCATCGAGAAGCCGAGGAAGATTCACGGCGGATCATCGAAGAAAGTTATTAAGATTCTCGGTGTTCCATGCGACGCCGTTTCAGTCTTCGTCAGATTCCTCTATTCTCCGAGTGTCACGGAGAATGAGATGGAAAAATACGGAATCCATCTACTGGCTTTATCACACGTGTATATGGTGACTCAGTTAAAGCAACGGTGCACTAAAGGCGTCGGTGAGAGAGTAACCGCCGAAAACGTTGTCGATATTCTCCAGCTGGCTCGTCTCTGCGACGCACCTGACCTCTGTCTCAAGTGTATGCGATTCATTCACTACAAGTTCAAGACCGTTGAACAGACAGAAGGATGGAAGTTTCTTCAAGAACACGATCCTTTTCTTGAACTTGACATTCTCCAATTCATCGACGATGCAGAATCGAGGAAGAAAAGAAGAAGGAGACACAGACGAGAACAGAATCTGTATTTGCAGCTGAGTGAAGCCATGGAATGTATAGAACACATATGCACCGAAGGTTGCACACTGGTCGGACCATCGTCTAACTTAGACAACAAGTCAACATGTCAAGCAAAACCCGGTCCATGCAGTGCGTTTTCGACTTGTTACGGACTTCAACTTCTTATACGTCACTTTGCAGTATGCAAGAAAAGAGTCGATGGCAAAGGTTGTGTCCGATGCAAGAGAATGATTCAACTCCTTAGACTCCATTCTTCGATTTGTGACCAATCTGAATCTTGCCGTGTCCCTCTTTGCAGGCAATATAAGAATAGAGGTGAAAAGGACAAGAAAATGGTTGAGGACACGAAGTGGAAGGTTCTGGTGAGAAGAGTAGCGTCTGCTAAAGCCATGTCTTCGTTGTCTCAATCAAAGAAGAAAAAAAGTGAAGTGTTATTTAAAGAAGAAGCAGAAGATTTGATCAGAATCCGGAACAAGTTAATGTGAATATACAATATATGTGTTTTTATTAGATTATATAGTGAGCGATTGTTAGAAGCCATTAATTACTTGAGTCGGAAGGTTTATTTGTTTGTTATTTGTCTCTCGGACTGGTTGATTGGGTTAAACTTGTCAATGAGTAACCCTTTGAATCTGTCGTTTTGTTTGGTCGGTCGAATTATATAGAAATGTATTATTGGTTATAAAATGGTATTAGGGTTTTTGGAGACTTTGTGGCAAAAAGTATACAGATTGATCCGGTTT

SEQ ID NO: 2389 - DNA, 1199 bp, Arabidopsis thaliana
  misc_feature (1)..(1199): Ceres cDNA ID no. 13601185
  misc_feature (1)..(1199): Also known as  Ceres CDNA ID no. 23827422
gattttatctgatcactcgttttgtgtctctgaatctctatcccgtggattcgcatctggatttgtttttttttcatttttattcgagcggctaacctttctcggatccatctgatatcgattggattctctctaatcaatcgttgaaatggcggatgcgtggaaggatttagcttcagggactgttggaggagctgctcaactagttgttggtcatccatttgacactatcaaggtcaaacttcagagccaaccgactccagcaccaggccaacttccaaggtacaccggtgcaatcgatgcggttaaacagaccgttgcttctgaaggaaccaaaggtttgtataaaggtatgggagctccacttgcaaccgttgctgccttcaatgcggttttgttcactgtgagaggtcaaatggaagggctgcttaggtctgaagctggagttcctttgaccattagtcaacagtttgtggccggtgcaggcgctggtttcgctgtttcgttccttgcttgtcctaccgagttgatcaagtgcaggttgcaagcacaaggtgcattagctggtgcctctactacaagctcagtggttgcagccgtgaaatacggtggaccaatggatgtagcccgtcatgtcctacgatcagaaggaggagcacgaggtctattcaaaggtttattccctacattcgcccgtgaagtcccgggaaatgcaacaatgtttgcagcctacgaagctttcaagcggtttttagccggtggttcagacacttcaagcttaggacaagggtcattgatcatggcgggtggagtcgctggtgcttctttttggggaatagtatatccgacagatgttgtgaagagtgttcttcaagtcgacgattacaaaaacccgagatacacggggtcgatggatgcttttcggaagattctgaaatctgaaggagttaaaggtttgtataaaggatttggtccagctatggctaggagtgttcctgctaatgctgcttgcttcttggcttatgagatgacaaggtcaagcttgggataaaccggttcggtttgggtttaactgttggttcgatttctgaatgttccattgcgattaacctctctgtttttagatttgattcttaaaaaatttctgcaaaatttatgtaccatttacacagtttatttcagtatttcttacacagaag

SEQ ID NO: 2390 - protein, 1199 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
GATTTTATCTGATCACTCGTTTTGTGTCTCTGAATCTCTATCCCGTGGATTCGCATCTGGATTTGTTTTTTTTTCATTTTTATTCGAGCGGCTAACCTTTCTCGGATCCATCTGATATCGATTGGATTCTCTCTAATCAATCGTTGAAATGGCGGATGCGTGGAAGGATTTAGCTTCAGGGACTGTTGGAGGAGCTGCTCAACTAGTTGTTGGTCATCCATTTGACACTATCAAGGTCAAACTTCAGAGCCAACCGACTCCAGCACCAGGCCAACTTCCAAGGTACACCGGTGCAATCGATGCGGTTAAACAGACCGTTGCTTCTGAAGGAACCAAAGGTTTGTATAAAGGTATGGGAGCTCCACTTGCAACCGTTGCTGCCTTCAATGCGGTTTTGTTCACTGTGAGAGGTCAAATGGAAGGGCTGCTTAGGTCTGAAGCTGGAGTTCCTTTGACCATTAGTCAACAGTTTGTGGCCGGTGCAGGCGCTGGTTTCGCTGTTTCGTTCCTTGCTTGTCCTACCGAGTTGATCAAGTGCAGGTTGCAAGCACAAGGTGCATTAGCTGGTGCCTCTACTACAAGCTCAGTGGTTGCAGCCGTGAAATACGGTGGACCAATGGATGTAGCCCGTCATGTCCTACGATCAGAAGGAGGAGCACGAGGTCTATTCAAAGGTTTATTCCCTACATTCGCCCGTGAAGTCCCGGGAAATGCAACAATGTTTGCAGCCTACGAAGCTTTCAAGCGGTTTTTAGCCGGTGGTTCAGACACTTCAAGCTTAGGACAAGGGTCATTGATCATGGCGGGTGGAGTCGCTGGTGCTTCTTTTTGGGGAATAGTATATCCGACAGATGTTGTGAAGAGTGTTCTTCAAGTCGACGATTACAAAAACCCGAGATACACGGGGTCGATGGATGCTTTTCGGAAGATTCTGAAATCTGAAGGAGTTAAAGGTTTGTATAAAGGATTTGGTCCAGCTATGGCTAGGAGTGTTCCTGCTAATGCTGCTTGCTTCTTGGCTTATGAGATGACAAGGTCAAGCTTGGGATAAACCGGTTCGGTTTGGGTTTAACTGTTGGTTCGATTTCTGAATGTTCCATTGCGATTAACCTCTCTGTTTTTAGATTTGATTCTTAAAAAATTTCTGCAAAATTTATGTACCATTTACACAGTTTATTTCAGTATTTCTTACACAGAAG

SEQ ID NO: 2391 - DNA, 1205 bp, Arabidopsis thaliana
  misc_feature (1)..(1205): Ceres cDNA ID no. 13601294
  misc_feature (1)..(1205): Also known as  Ceres CDNA ID no. 23827422
acgcattcgtcatttggtccctccacttagagagaagcagacagaacataactaaaatcgagaaaaatggcaaacagtggtgaaggtaaagtggtgtgtgtaacaggagcctccggttacatcgcctcatggctcgtcaagttcctacttagccgtggctacactgttaaggcctccgtccgtgatcccagtgatccgaaaaagacacaacacttagtttcactagaaggtgcaaaggaaagacttcacttgttcaaagcagaccttttggaacaaggttctttcgactctgctattgatggttgccatggagttttccacactgcttctccattttttaatgatgccaaagacccacaggctgaacttattgatcctgcggtcaaggggacgcttaacgttttgaattcgtgcgccaaagcctcttcggttaagagggttgttgtaacctcctccatggctgccgttggttacaatggaaaaccacgcacacctgatgttaccgtcgatgaaacttggttctctgatcctgagctttgcgaggcctccaagatgtggtatgttctatccaagactttggcggaagatgcagcttggaaactcgctaaagagaaaggcttagacattgttactattaacccggctatggtgatcggtcctctcctacagccaactctgaacacgagtgctgctgctatattaaacttaatcaatggtgcaaagactttcccaaacttgagtttcggatgggttaatgtaaaagacgtagccaatgcgcacatccaagcatttgaggtcccttcagctaatgggcgttattgtttggtcgagcgtgtcgttcaccactccgagattgttaacattctacgtgagctttacccaaatctcccactacctgaaaggtgtgtggacgagaatccctacgtgccaacgtatcaagtgtccaaggataaaacgaggagccttggcatagactacatacccttgaaggttagcatcaaggagaccgtcgagtccttgaaggaaaaaggtttcgcacagttctgagaaagcatttgagccaatggatttaatccagattagataaagtatttggaagactatttcagaaataatatttggaacatgtcaatgttctcaaggagatattagtatgttcttgtgtactttattgttgttccatcaaatgagttacttttcctttt

SEQ ID NO: 2392 - protein, 1205 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ACGCATTCGTCATTTGGTCCCTCCACTTAGAGAGAAGCAGACAGAACATAACTAAAATCGAGAAAAATGGCAAACAGTGGTGAAGGTAAAGTGGTGTGTGTAACAGGAGCCTCCGGTTACATCGCCTCATGGCTCGTCAAGTTCCTACTTAGCCGTGGCTACACTGTTAAGGCCTCCGTCCGTGATCCCAGTGATCCGAAAAAGACACAACACTTAGTTTCACTAGAAGGTGCAAAGGAAAGACTTCACTTGTTCAAAGCAGACCTTTTGGAACAAGGTTCTTTCGACTCTGCTATTGATGGTTGCCATGGAGTTTTCCACACTGCTTCTCCATTTTTTAATGATGCCAAAGACCCACAGGCTGAACTTATTGATCCTGCGGTCAAGGGGACGCTTAACGTTTTGAATTCGTGCGCCAAAGCCTCTTCGGTTAAGAGGGTTGTTGTAACCTCCTCCATGGCTGCCGTTGGTTACAATGGAAAACCACGCACACCTGATGTTACCGTCGATGAAACTTGGTTCTCTGATCCTGAGCTTTGCGAGGCCTCCAAGATGTGGTATGTTCTATCCAAGACTTTGGCGGAAGATGCAGCTTGGAAACTCGCTAAAGAGAAAGGCTTAGACATTGTTACTATTAACCCGGCTATGGTGATCGGTCCTCTCCTACAGCCAACTCTGAACACGAGTGCTGCTGCTATATTAAACTTAATCAATGGTGCAAAGACTTTCCCAAACTTGAGTTTCGGATGGGTTAATGTAAAAGACGTAGCCAATGCGCACATCCAAGCATTTGAGGTCCCTTCAGCTAATGGGCGTTATTGTTTGGTCGAGCGTGTCGTTCACCACTCCGAGATTGTTAACATTCTACGTGAGCTTTACCCAAATCTCCCACTACCTGAAAGGTGTGTGGACGAGAATCCCTACGTGCCAACGTATCAAGTGTCCAAGGATAAAACGAGGAGCCTTGGCATAGACTACATACCCTTGAAGGTTAGCATCAAGGAGACCGTCGAGTCCTTGAAGGAAAAAGGTTTCGCACAGTTCTGAGAAAGCATTTGAGCCAATGGATTTAATCCAGATTAGATAAAGTATTTGGAAGACTATTTCAGAAATAATATTTGGAACATGTCAATGTTCTCAAGGAGATATTAGTATGTTCTTGTGTACTTTATTGTTGTTCCATCAAATGAGTTACTTTTCCTTTT

SEQ ID NO: 2393 - DNA, 1187 bp, Arabidopsis thaliana
  misc_feature (1)..(1187): Ceres cDNA ID no. 13601348
  misc_feature (1)..(1187): Also known as  Ceres CDNA ID no. 23827422
aaactcaagtagaaacaatggagaagccaaagttcaagactgtccaagaggtggttgcagctggcgaaggactgccggagagatatctccacgcacccaccggagacggcgaagttcaacctcttaacgcagcggtaccggagatggatattccggccatcgatctgaatcttctcctctcttcttctgaagctggtcaacaagagctgagtaaacttcactcggcactctctacatggggcgttgttcaggtgatgaatcatggaattacaaaagcgtttcttgacaagatttacaagctaaccaaggagttctttgcgcttccgaccgaagagaaacagaagtgcgcgagagagattgatagtatccaaggatatggtaacgacatgattctttgggatgatcaagttcttgattggatcgaccgtttgtatattactacttaccctgaagatcaaagacaacttaatttctggcctgaagtcccacttggattcagggaaactttacatgaatacacaatgaagcaacggatagtgattgagcaattttttaaggccatggctagatctttggaattagaagagaatagttttctagacatgtatggagaaagtgctacgttggatactagattcaacatgtatccaccatgtccgagcccggacaaggttattggtgttaaaccgcacgctgatggctcggctatcactcttctcttacccgacaaagatgtcggagggcttcagttccagaaagatgggaagtggtataaagctcctatagtccctgatacaattttgatcaatgttggtgatcaaatggagataatgagcaatgggatatacaagagcccggttcatagagtggtgactaacagagaaaaggaaagaatatctgtggcaactttttgcattccaggtgcagataaagagattcagcctgtgaatgagcttgtgtctgaggcaagaccaagattatataaaacagttaagaagtatgtggagctctacttcaagtactatcaacaaggccgaagacctattgaagctgcattgatctgatcacacttttcaagtctcatttattggtttcacaaatgaatctgtttctttcgttacttgagatcctttataagaataaaactgtttccttgtttgttggaatgtgaggctgcattgtgttgc

SEQ ID NO: 2394 - protein, 1187 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
AAACTCAAGTAGAAACAATGGAGAAGCCAAAGTTCAAGACTGTCCAAGAGGTGGTTGCAGCTGGCGAAGGACTGCCGGAGAGATATCTCCACGCACCCACCGGAGACGGCGAAGTTCAACCTCTTAACGCAGCGGTACCGGAGATGGATATTCCGGCCATCGATCTGAATCTTCTCCTCTCTTCTTCTGAAGCTGGTCAACAAGAGCTGAGTAAACTTCACTCGGCACTCTCTACATGGGGCGTTGTTCAGGTGATGAATCATGGAATTACAAAAGCGTTTCTTGACAAGATTTACAAGCTAACCAAGGAGTTCTTTGCGCTTCCGACCGAAGAGAAACAGAAGTGCGCGAGAGAGATTGATAGTATCCAAGGATATGGTAACGACATGATTCTTTGGGATGATCAAGTTCTTGATTGGATCGACCGTTTGTATATTACTACTTACCCTGAAGATCAAAGACAACTTAATTTCTGGCCTGAAGTCCCACTTGGATTCAGGGAAACTTTACATGAATACACAATGAAGCAACGGATAGTGATTGAGCAATTTTTTAAGGCCATGGCTAGATCTTTGGAATTAGAAGAGAATAGTTTTCTAGACATGTATGGAGAAAGTGCTACGTTGGATACTAGATTCAACATGTATCCACCATGTCCGAGCCCGGACAAGGTTATTGGTGTTAAACCGCACGCTGATGGCTCGGCTATCACTCTTCTCTTACCCGACAAAGATGTCGGAGGGCTTCAGTTCCAGAAAGATGGGAAGTGGTATAAAGCTCCTATAGTCCCTGATACAATTTTGATCAATGTTGGTGATCAAATGGAGATAATGAGCAATGGGATATACAAGAGCCCGGTTCATAGAGTGGTGACTAACAGAGAAAAGGAAAGAATATCTGTGGCAACTTTTTGCATTCCAGGTGCAGATAAAGAGATTCAGCCTGTGAATGAGCTTGTGTCTGAGGCAAGACCAAGATTATATAAAACAGTTAAGAAGTATGTGGAGCTCTACTTCAAGTACTATCAACAAGGCCGAAGACCTATTGAAGCTGCATTGATCTGATCACACTTTTCAAGTCTCATTTATTGGTTTCACAAATGAATCTGTTTCTTTCGTTACTTGAGATCCTTTATAAGAATAAAACTGTTTCCTTGTTTGTTGGAATGTGAGGCTGCATTGTGTTGC

SEQ ID NO: 2395 - DNA, 1285 bp, Arabidopsis thaliana
  misc_feature (1)..(1285): Ceres cDNA ID no. 13601418
  misc_feature (1)..(1285): Also known as  Ceres CDNA ID no. 23827422
ctgtatggtattgatttgttaaatacagtttatggagcttcagatagcaggagcgtctctaaatctgctgtgtcaaaaagaaccctcgccgtattgccttgctcgtcctgtcgaattaacaaacgttgcatcgagaatggacatctacaatctgctactaacaaaacttcctttgtgtgctgagcaagttcttcaggccataggagaaataatcctgatttctcaagaaacaataagcatggtttccgaggcagaaacaggcgaaacgaagataaggatggtttagtagatggtggtcttgaagacgacatgttgtcttccaaaaacggtcctttactctctctatccagtttcccaaaattccaggctacttaatcacctggaccaaaagagaaagagatagtggagcttttcaagaaagtccaagttcagctccgggctcgagctgctgctaagaaagaagaaaagaagactgaagaagcttctaaaggacagggaggaaaagagagtgagacagtggactcccttcttaagttactgaggaagcactcaggagaacaaagcaagaaacaagttagcaatttcaattctgagaagcagctccaaagagatgatgatgcttcagaaagacaaaatcacagttccagtcgtttcgattcgcgaaacaaagatcataatgcaacaccctttaccaggccagcatcaagcttcaaacgtaattctcctgtaccgagacataaatctcaagccagttattctagtgaggccatttttgatgaagcttcaagttacagtgtgacttggacccagaaaaaggatcaagtagagtcgcgtgatgaacctgaatacgagcctgagcctgagtctgcagctgagtatgatgaacctgaacctgaggctgagtatgaacctgaatctgaaccagaacttgctattctcgaatcagtgtcagagctgaaactagagtcgttttaccaagaggaagatgaagatgaggaggatcataacttcgttatagatgagttatcagatgatgacgagtctctcaataccgactaccgaggaagagactgcgaaagacgaagatttgagtgcactgaagttggtagaacttagagccatagcaaaatcaagaggactcaaaggaatttcaaagatgaagaaagttgagctagtgactttattgggtagtagtaataaagcatgatgatcagatttttaacatgagtcagattaaacattgcttgagtttttgatacagctaatgaatctccaaatactcgtt

SEQ ID NO: 2396 - protein, 1285 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
CTGTATGGTATTGATTTGTTAAATACAGTTTATGGAGCTTCAGATAGCAGGAGCGTCTCTAAATCTGCTGTGTCAAAAAGAACCCTCGCCGTATTGCCTTGCTCGTCCTGTCGAATTAACAAACGTTGCATCGAGAATGGACATCTACAATCTGCTACTAACAAAACTTCCTTTGTGTGCTGAGCAAGTTCTTCAGGCCATAGGAGAAATAATCCTGATTTCTCAAGAAACAATAAGCATGGTTTCCGAGGCAGAAACAGGCGAAACGAAGATAAGGATGGTTTAGTAGATGGTGGTCTTGAAGACGACATGTTGTCTTCCAAAAACGGTCCTTTACTCTCTCTATCCAGTTTCCCAAAATTCCAGGCTACTTAATCACCTGGACCAAAAGAGAAAGAGATAGTGGAGCTTTTCAAGAAAGTCCAAGTTCAGCTCCGGGCTCGAGCTGCTGCTAAGAAAGAAGAAAAGAAGACTGAAGAAGCTTCTAAAGGACAGGGAGGAAAAGAGAGTGAGACAGTGGACTCCCTTCTTAAGTTACTGAGGAAGCACTCAGGAGAACAAAGCAAGAAACAAGTTAGCAATTTCAATTCTGAGAAGCAGCTCCAAAGAGATGATGATGCTTCAGAAAGACAAAATCACAGTTCCAGTCGTTTCGATTCGCGAAACAAAGATCATAATGCAACACCCTTTACCAGGCCAGCATCAAGCTTCAAACGTAATTCTCCTGTACCGAGACATAAATCTCAAGCCAGTTATTCTAGTGAGGCCATTTTTGATGAAGCTTCAAGTTACAGTGTGACTTGGACCCAGAAAAAGGATCAAGTAGAGTCGCGTGATGAACCTGAATACGAGCCTGAGCCTGAGTCTGCAGCTGAGTATGATGAACCTGAACCTGAGGCTGAGTATGAACCTGAATCTGAACCAGAACTTGCTATTCTCGAATCAGTGTCAGAGCTGAAACTAGAGTCGTTTTACCAAGAGGAAGATGAAGATGAGGAGGATCATAACTTCGTTATAGATGAGTTATCAGATGATGACGAGTCTCTCAATACCGACTACCGAGGAAGAGACTGCGAAAGACGAAGATTTGAGTGCACTGAAGTTGGTAGAACTTAGAGCCATAGCAAAATCAAGAGGACTCAAAGGAATTTCAAAGATGAAGAAAGTTGAGCTAGTGACTTTATTGGGTAGTAGTAATAAAGCATGATGATCAGATTTTTAACATGAGTCAGATTAAACATTGCTTGAGTTTTTGATACAGCTAATGAATCTCCAAATACTCGTT

SEQ ID NO: 2397 - DNA, 647 bp, Arabidopsis thaliana
  misc_feature (1)..(647): Ceres cDNA ID no. 13601497
  misc_feature (1)..(647): Also known as  Ceres CDNA ID no. 23827422
aaatcacaaatcttcaacttccgatactttcaatctctctaaactctcaatttcagtaatcgataaccgtagcaatggaatccaccggaaaagtgaagaaagctttcggaggaagaaaaccacctggtgccccaaaaaccaaatcggtttcgaaatcgatgaaagccggtcttcaattcccagtgggaagaatcactcgtttcctgaagaaaggacgatacgctcagagacttggtggtggtgctccggtttacatggccgccgttcttgaatacctcgccgcagaagttctggagcttgctggtaacgctgcgagagataacaagaaatcaaggataattccgaggcatcttcttctcgcgataaggaacgatgaagaattggggaaacttctgagtggtgtcacaatcgctcacggtggtgttttgcctaacatcaactctgttctattgcctaagaagtctgccactaaaccagctgaagaaaaggctaccaaatcaccagtcaagtctccaaagaaagcttaatctgctagagttttcgttgctagtttgtgtttgagctctggtgaatgtagaaatttgaagcttttggatcttagtttctatgtatttggtgatttagaatgttgttcaaaatccttttcc

SEQ ID NO: 2398 - protein, 647 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
AAATCACAAATCTTCAACTTCCGATACTTTCAATCTCTCTAAACTCTCAATTTCAGTAATCGATAACCGTAGCAATGGAATCCACCGGAAAAGTGAAGAAAGCTTTCGGAGGAAGAAAACCACCTGGTGCCCCAAAAACCAAATCGGTTTCGAAATCGATGAAAGCCGGTCTTCAATTCCCAGTGGGAAGAATCACTCGTTTCCTGAAGAAAGGACGATACGCTCAGAGACTTGGTGGTGGTGCTCCGGTTTACATGGCCGCCGTTCTTGAATACCTCGCCGCAGAAGTTCTGGAGCTTGCTGGTAACGCTGCGAGAGATAACAAGAAATCAAGGATAATTCCGAGGCATCTTCTTCTCGCGATAAGGAACGATGAAGAATTGGGGAAACTTCTGAGTGGTGTCACAATCGCTCACGGTGGTGTTTTGCCTAACATCAACTCTGTTCTATTGCCTAAGAAGTCTGCCACTAAACCAGCTGAAGAAAAGGCTACCAAATCACCAGTCAAGTCTCCAAAGAAAGCTTAATCTGCTAGAGTTTTCGTTGCTAGTTTGTGTTTGAGCTCTGGTGAATGTAGAAATTTGAAGCTTTTGGATCTTAGTTTCTATGTATTTGGTGATTTAGAATGTTGTTCAAAATCCTTTTCC

SEQ ID NO: 2399 - DNA, 1136 bp, Arabidopsis thaliana
  misc_feature (1)..(1136): Ceres cDNA ID no. 13601700
  misc_feature (1)..(1136): Also known as  Ceres CDNA ID no. 23827422
ttcttctgctttcgtgactttcaggggacacttttgtttttataacttacgcttaaaatcctatgaattcgccgccggttgacgcaatgattaccggagaatcatcgtcacaaagatctatcccaacgccgtttctcacaaaaacgtttaacctcgttgaagatagttccatcgacgatgttatctcatggaacgaagatggttcctctttcatcgtatggaatccgacagatttcgctaaagatttgcttcctaaacacttcaaacacaacaatttctctagtttcgttcgtcagctcaacacttacggattcaaaaaagttgtaccggatcgatgggagttttcaaacgatttctttaagagaggagaaaaacgtcttctccgtgagatccaacgtcggaaaataacaacgacgcatcaaacagttgttgctccttcgtcggaacaacgaaaccagacgatggttgtatcaccgtcaaattccggggaagataataataataatcaggtgatgtcttcgtctccgtcgtcgtggtattgtcatcaaacgaagacgactgggaatggtggtttatcagtggagttattggaagagaacgagaagcttcggagtcaaaacattcagctaaaccgtgagcttactcagatgaaatctatctgcgataatatctatagtctcatgtcgaattacgtcggatctcagcccactgatcggagttattctcccggaggtagtagtagtcaaccgatggagtttttaccggcgaagcggttttcggagatggagattgaagaagaagaagaagcgagtccgaggttgtttggtgttccgattgggttaaaacggacgagaagtgaaggtgttcaggtgaagacgacggcggtggttggggaaaattccgatgaggagacgccgtggttgagacattataatcgaaccaatcagagagtttgtaattaaaaacgaacggtttagatttgtggtgtagatatgtgcgcgaagtagacgattacagctttttaagacaagcagagcacgtgtcccatctgtttcaagaagtttctgcaatcttgacttcttcttttaacactttgtgttttttattatttaattaataacaataaatgttctttt

SEQ ID NO: 2400 - protein, 1136 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
TTCTTCTGCTTTCGTGACTTTCAGGGGACACTTTTGTTTTTATAACTTACGCTTAAAATCCTATGAATTCGCCGCCGGTTGACGCAATGATTACCGGAGAATCATCGTCACAAAGATCTATCCCAACGCCGTTTCTCACAAAAACGTTTAACCTCGTTGAAGATAGTTCCATCGACGATGTTATCTCATGGAACGAAGATGGTTCCTCTTTCATCGTATGGAATCCGACAGATTTCGCTAAAGATTTGCTTCCTAAACACTTCAAACACAACAATTTCTCTAGTTTCGTTCGTCAGCTCAACACTTACGGATTCAAAAAAGTTGTACCGGATCGATGGGAGTTTTCAAACGATTTCTTTAAGAGAGGAGAAAAACGTCTTCTCCGTGAGATCCAACGTCGGAAAATAACAACGACGCATCAAACAGTTGTTGCTCCTTCGTCGGAACAACGAAACCAGACGATGGTTGTATCACCGTCAAATTCCGGGGAAGATAATAATAATAATCAGGTGATGTCTTCGTCTCCGTCGTCGTGGTATTGTCATCAAACGAAGACGACTGGGAATGGTGGTTTATCAGTGGAGTTATTGGAAGAGAACGAGAAGCTTCGGAGTCAAAACATTCAGCTAAACCGTGAGCTTACTCAGATGAAATCTATCTGCGATAATATCTATAGTCTCATGTCGAATTACGTCGGATCTCAGCCCACTGATCGGAGTTATTCTCCCGGAGGTAGTAGTAGTCAACCGATGGAGTTTTTACCGGCGAAGCGGTTTTCGGAGATGGAGATTGAAGAAGAAGAAGAAGCGAGTCCGAGGTTGTTTGGTGTTCCGATTGGGTTAAAACGGACGAGAAGTGAAGGTGTTCAGGTGAAGACGACGGCGGTGGTTGGGGAAAATTCCGATGAGGAGACGCCGTGGTTGAGACATTATAATCGAACCAATCAGAGAGTTTGTAATTAAAAACGAACGGTTTAGATTTGTGGTGTAGATATGTGCGCGAAGTAGACGATTACAGCTTTTTAAGACAAGCAGAGCACGTGTCCCATCTGTTTCAAGAAGTTTCTGCAATCTTGACTTCTTCTTTTAACACTTTGTGTTTTTTATTATTTAATTAATAACAATAAATGTTCTTTT

SEQ ID NO: 2401 - DNA, 1382 bp, Arabidopsis thaliana
  misc_feature (1)..(1382): Ceres cDNA ID no. 13601745
  misc_feature (1)..(1382): Also known as  Ceres CDNA ID no. 23827422
aaacctctctcctcgaccctttaatttctaatcaccgaccaaaattgatcggaaacctagagctcttcgtattgctccgccaccatgcatatccggcgccagatcttcgttaaatctcctgactgtcaaaaagtcgtcgctctgcaattggatcctgcgcaatctctattaactctttcgggtatcacttccttactcgaatcgtcgcagcgtatatcgttttcggcttgctcgattactctagatgggaagcttttgaatggctctacacggatccaagtatcgaagcttccttctgtatccatgctcactcttttccctcgcctccgtggaggtggaggagatggtggggcaacgggagccgagtctcgcgattgctatctcaatatgtacgcggagaagaaacctgacaaggttgatcctaatgagcagaggctctccaaatggttgaattgtgctttgtctaacgagcctttggctgagccgtgcgtgattgatctccttgggaatttgttcaataaagaagttttggtgcacgctttgttgtctaagaggttgcctaaacaattctcgtacattaagggtttgaaagatatggtgaatattaagcttacgcctgttgctggttctgatggttcatcgcaagatacgactagtgcacagtttcagtgtccggtctcagggcttgaattcaatggaaagtacaagtttttcgctttgaggggatgtggacatgtgatgagcgcaaaggcgttgaaggaagtgaagtcttcttcttgtttggtgtgtcatgcggatgtcaaagattctgataagattgtgatcaatggtactgaggaggaagtagatttgttgagggagaggatggaggaggagaaagctaagctgagagagaagaaaggtgtctcaaagaagagtaagaacggtgctgctgtggtggctgatacaggtgcgaaggtcgcaaagagacagatagaggatgggaatgtcaatggcaatggtataactgtgaagaaattcaaggcggcggataaagtgccggttaatgctactaaggaagtctatgcttctctctttacttcctctaagaagaagtctgatttcagggagacttactcttgcaggtcacttcctctcggcaggaattgatttgttggatcaatgttgtttacctgctcgcttcatttgctctgtaatctgttttgattatattgatatatcaacttgcttttgtaatttcgcctactggataatataatgtttttcttttccttttgcaattggtaaaaacagtaaacatgtttgcatccactatgctaaaactagtaaaagtgttgtatcataagctgcaattgtaacaagaggatatgtatgttgtttac

SEQ ID NO: 2402 - protein, 1382 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
AAACCTCTCTCCTCGACCCTTTAATTTCTAATCACCGACCAAAATTGATCGGAAACCTAGAGCTCTTCGTATTGCTCCGCCACCATGCATATCCGGCGCCAGATCTTCGTTAAATCTCCTGACTGTCAAAAAGTCGTCGCTCTGCAATTGGATCCTGCGCAATCTCTATTAACTCTTTCGGGTATCACTTCCTTACTCGAATCGTCGCAGCGTATATCGTTTTCGGCTTGCTCGATTACTCTAGATGGGAAGCTTTTGAATGGCTCTACACGGATCCAAGTATCGAAGCTTCCTTCTGTATCCATGCTCACTCTTTTCCCTCGCCTCCGTGGAGGTGGAGGAGATGGTGGGGCAACGGGAGCCGAGTCTCGCGATTGCTATCTCAATATGTACGCGGAGAAGAAACCTGACAAGGTTGATCCTAATGAGCAGAGGCTCTCCAAATGGTTGAATTGTGCTTTGTCTAACGAGCCTTTGGCTGAGCCGTGCGTGATTGATCTCCTTGGGAATTTGTTCAATAAAGAAGTTTTGGTGCACGCTTTGTTGTCTAAGAGGTTGCCTAAACAATTCTCGTACATTAAGGGTTTGAAAGATATGGTGAATATTAAGCTTACGCCTGTTGCTGGTTCTGATGGTTCATCGCAAGATACGACTAGTGCACAGTTTCAGTGTCCGGTCTCAGGGCTTGAATTCAATGGAAAGTACAAGTTTTTCGCTTTGAGGGGATGTGGACATGTGATGAGCGCAAAGGCGTTGAAGGAAGTGAAGTCTTCTTCTTGTTTGGTGTGTCATGCGGATGTCAAAGATTCTGATAAGATTGTGATCAATGGTACTGAGGAGGAAGTAGATTTGTTGAGGGAGAGGATGGAGGAGGAGAAAGCTAAGCTGAGAGAGAAGAAAGGTGTCTCAAAGAAGAGTAAGAACGGTGCTGCTGTGGTGGCTGATACAGGTGCGAAGGTCGCAAAGAGACAGATAGAGGATGGGAATGTCAATGGCAATGGTATAACTGTGAAGAAATTCAAGGCGGCGGATAAAGTGCCGGTTAATGCTACTAAGGAAGTCTATGCTTCTCTCTTTACTTCCTCTAAGAAGAAGTCTGATTTCAGGGAGACTTACTCTTGCAGGTCACTTCCTCTCGGCAGGAATTGATTTGTTGGATCAATGTTGTTTACCTGCTCGCTTCATTTGCTCTGTAATCTGTTTTGATTATATTGATATATCAACTTGCTTTTGTAATTTCGCCTACTGGATAATATAATGTTTTTCTTTTCCTTTTGCAATTGGTAAAAACAGTAAACATGTTTGCATCCACTATGCTAAAACTAGTAAAAGTGTTGTATCATAAGCTGCAATTGTAACAAGAGGATATGTATGTTGTTTAC

SEQ ID NO: 2403 - DNA, 1220 bp, Arabidopsis thaliana
  misc_feature (1)..(1220): Ceres cDNA ID no. 13602061
  misc_feature (1)..(1220): Also known as  Ceres CDNA ID no. 23827422
aacgactcataactcatagctatatcttgtcttaaaaagaagaagcaaagagaattagtggagtacgataagcagagaagtatgttaaaggtggtgttgttgatgatgataatgatgttggcgtcacagtccgaggctcagctgaaccgtgacttttacaaggaaagctgtccatcattgttccttgtcgtgagacgagtcgtgaaacgggccgtggccagagagcctcgcatgggtgcttctctccttcgtttgttcttccatgattgttttgtcaatgggtgtgacggatccttactgttggatgacacaccgtcttttttgggagagaaaacctcaggacccagcaataactctgtgagggggttcgaagtgatcgacaaaatcaagtttaaggttgagaaaatgtgcccgggcatcgtctcatgcgcagacattctagccatcactgctcgggactccgttctcctcctaggtggaccggggtggagcgtgaaacttggaagaagagactctacgacggcgaacttcgcggccgcgaactccggagtcatccctcctccgatcactacccttagcaacctcataaaccgtttcaaagcacaaggtttgtccacacgtgacatggtcgccctctctggtgctcacaccattggacgagcccaatgtgttacattcagaaaccgaatctacaacgcaagcaatatcgacacctctttcgccatctctaaacggaggaactgtcctgccaccagtggctccggagacaacaagaaagccaatcttgacgtccgctctcccgataggttcgaccacggcttctacaagcaacttctgagcaaaaaaggtttgcttacgtcagaccaagtcctctttaataatggtcctaccgactcgctcgtcatagcttacagccacaatctcaatgccttctaccgcgactttgcaagggcaatgattaagatgggagacatcagccccctcaccggatccaatggtcagatccgccaaaactgtcggaggcccaactgaatgattctcttttatattatcccaagcccattgagctcaataatcacctcttcgtcaactgttttttcatgtgcattccccttcttcgtcaactgttaaaatacatcttcattatataaaaaacaataaacacgtaaaagtttgtgactatgcagttttccattataaattactgtctatattctctt

SEQ ID NO: 2404 - protein, 1220 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
AACGACTCATAACTCATAGCTATATCTTGTCTTAAAAAGAAGAAGCAAAGAGAATTAGTGGAGTACGATAAGCAGAGAAGTATGTTAAAGGTGGTGTTGTTGATGATGATAATGATGTTGGCGTCACAGTCCGAGGCTCAGCTGAACCGTGACTTTTACAAGGAAAGCTGTCCATCATTGTTCCTTGTCGTGAGACGAGTCGTGAAACGGGCCGTGGCCAGAGAGCCTCGCATGGGTGCTTCTCTCCTTCGTTTGTTCTTCCATGATTGTTTTGTCAATGGGTGTGACGGATCCTTACTGTTGGATGACACACCGTCTTTTTTGGGAGAGAAAACCTCAGGACCCAGCAATAACTCTGTGAGGGGGTTCGAAGTGATCGACAAAATCAAGTTTAAGGTTGAGAAAATGTGCCCGGGCATCGTCTCATGCGCAGACATTCTAGCCATCACTGCTCGGGACTCCGTTCTCCTCCTAGGTGGACCGGGGTGGAGCGTGAAACTTGGAAGAAGAGACTCTACGACGGCGAACTTCGCGGCCGCGAACTCCGGAGTCATCCCTCCTCCGATCACTACCCTTAGCAACCTCATAAACCGTTTCAAAGCACAAGGTTTGTCCACACGTGACATGGTCGCCCTCTCTGGTGCTCACACCATTGGACGAGCCCAATGTGTTACATTCAGAAACCGAATCTACAACGCAAGCAATATCGACACCTCTTTCGCCATCTCTAAACGGAGGAACTGTCCTGCCACCAGTGGCTCCGGAGACAACAAGAAAGCCAATCTTGACGTCCGCTCTCCCGATAGGTTCGACCACGGCTTCTACAAGCAACTTCTGAGCAAAAAAGGTTTGCTTACGTCAGACCAAGTCCTCTTTAATAATGGTCCTACCGACTCGCTCGTCATAGCTTACAGCCACAATCTCAATGCCTTCTACCGCGACTTTGCAAGGGCAATGATTAAGATGGGAGACATCAGCCCCCTCACCGGATCCAATGGTCAGATCCGCCAAAACTGTCGGAGGCCCAACTGAATGATTCTCTTTTATATTATCCCAAGCCCATTGAGCTCAATAATCACCTCTTCGTCAACTGTTTTTTCATGTGCATTCCCCTTCTTCGTCAACTGTTAAAATACATCTTCATTATATAAAAAACAATAAACACGTAAAAGTTTGTGACTATGCAGTTTTCCATTATAAATTACTGTCTATATTCTCTT

SEQ ID NO: 2405 - DNA, 1633 bp, Arabidopsis thaliana
  misc_feature (1)..(1633): Ceres cDNA ID no. 13602150
  misc_feature (1)..(1633): Also known as  Ceres CDNA ID no. 23827422
atggatcccacaaacagcagacacggcgcttcttttgaattttctactcggcgttttacactttccacgtttggtcaaaacgctccttctctatacgtaacgaccgtttataactccgctatcatctacccagtcaaacactcaccacgtgtctatttaccgtctaatccgacaccgttaattccgctcctaagaatcgccttaaaaaccacgttttcattttctcatcttcaaacctctctgtcattactctggtcagcgattcttctttcttcttcttctcagatcctttcaccgagtaagaagattttaaagatgccgtcaacgccgacgacgccgactacaacaacgccgatcacggcttcgtattggtgttacagctgtacgcgtttcgtcagcgtttgggctgatcaaggcacaacaaccgtcggtagcgtcgcttgccctcactgcgacggcggttttatcgaacagattaacgattcttcctccgccgctaccgaattaacgattccggcttctactgaagtaagatcgatcaataacaaccgtagatccgtgattagacgccggagatccggtcgtcgtccgtcctttaatccggtcatcgtacttcaaggaggcgccggcgagagagaagagggagaagaaggagatgcggctagagatcgacgcgcttttgagttttattacgatgacggatccggatcgggtcttagaccgcttccggattctgtatctgagatcttgatgggatctggattcgagcggttacttgaacagctaagccaaatcgaagcgtcggctactggaattggtagatctggaaaccctccggcgtctaaatcggcgattgagtctttacctagagtcgaaatctcggattgccacataggctcggaggctaattgcgctgtttgcacggagattttcgagacggagacggaggcgcgtgagatgccgtgtaaacaccttttccacgacgattgcatcgtaccgtggctatcgattcgaaactcttgtcccgtgtgcagattcgagctaccttcagagcctaatcgacggagcaacaacaacgaggaggataacgccgtggggatgacgatttggagacttcccggtggtggattcgccgtagggaggtttaacgcagcaatgagagacggagagagagttttgccagtggtgttaacagaaatggatggtggtgggattggtaatagccaggatggtcctagacggatctcatgggttaggtcacacggtacactcgaatcggatagtaacggtactggctcaggttccggctccggtggaagattgaggaggatggttcgtggaatggtgtcgttaatgaggagagtgagaccaaaccgtagctcttcttcttcatcagctgcgatatcaacttcttctgataatctggatttgaacattgaagtagaatctagggttttggataggtcaaattcagtgatgagaagatacttcagaagaaacagaagtaacagggattcttcgtcttcagttcttcattgattcagaaatatatatatattattttttggtttgttcattcaacaatgtaaatataagattcagaagaaaaagattggtgcttcgttttctatta

SEQ ID NO: 2406 - protein, 1633 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATGGATCCCACAAACAGCAGACACGGCGCTTCTTTTGAATTTTCTACTCGGCGTTTTACACTTTCCACGTTTGGTCAAAACGCTCCTTCTCTATACGTAACGACCGTTTATAACTCCGCTATCATCTACCCAGTCAAACACTCACCACGTGTCTATTTACCGTCTAATCCGACACCGTTAATTCCGCTCCTAAGAATCGCCTTAAAAACCACGTTTTCATTTTCTCATCTTCAAACCTCTCTGTCATTACTCTGGTCAGCGATTCTTCTTTCTTCTTCTTCTCAGATCCTTTCACCGAGTAAGAAGATTTTAAAGATGCCGTCAACGCCGACGACGCCGACTACAACAACGCCGATCACGGCTTCGTATTGGTGTTACAGCTGTACGCGTTTCGTCAGCGTTTGGGCTGATCAAGGCACAACAACCGTCGGTAGCGTCGCTTGCCCTCACTGCGACGGCGGTTTTATCGAACAGATTAACGATTCTTCCTCCGCCGCTACCGAATTAACGATTCCGGCTTCTACTGAAGTAAGATCGATCAATAACAACCGTAGATCCGTGATTAGACGCCGGAGATCCGGTCGTCGTCCGTCCTTTAATCCGGTCATCGTACTTCAAGGAGGCGCCGGCGAGAGAGAAGAGGGAGAAGAAGGAGATGCGGCTAGAGATCGACGCGCTTTTGAGTTTTATTACGATGACGGATCCGGATCGGGTCTTAGACCGCTTCCGGATTCTGTATCTGAGATCTTGATGGGATCTGGATTCGAGCGGTTACTTGAACAGCTAAGCCAAATCGAAGCGTCGGCTACTGGAATTGGTAGATCTGGAAACCCTCCGGCGTCTAAATCGGCGATTGAGTCTTTACCTAGAGTCGAAATCTCGGATTGCCACATAGGCTCGGAGGCTAATTGCGCTGTTTGCACGGAGATTTTCGAGACGGAGACGGAGGCGCGTGAGATGCCGTGTAAACACCTTTTCCACGACGATTGCATCGTACCGTGGCTATCGATTCGAAACTCTTGTCCCGTGTGCAGATTCGAGCTACCTTCAGAGCCTAATCGACGGAGCAACAACAACGAGGAGGATAACGCCGTGGGGATGACGATTTGGAGACTTCCCGGTGGTGGATTCGCCGTAGGGAGGTTTAACGCAGCAATGAGAGACGGAGAGAGAGTTTTGCCAGTGGTGTTAACAGAAATGGATGGTGGTGGGATTGGTAATAGCCAGGATGGTCCTAGACGGATCTCATGGGTTAGGTCACACGGTACACTCGAATCGGATAGTAACGGTACTGGCTCAGGTTCCGGCTCCGGTGGAAGATTGAGGAGGATGGTTCGTGGAATGGTGTCGTTAATGAGGAGAGTGAGACCAAACCGTAGCTCTTCTTCTTCATCAGCTGCGATATCAACTTCTTCTGATAATCTGGATTTGAACATTGAAGTAGAATCTAGGGTTTTGGATAGGTCAAATTCAGTGATGAGAAGATACTTCAGAAGAAACAGAAGTAACAGGGATTCTTCGTCTTCAGTTCTTCATTGATTCAGAAATATATATATATTATTTTTTGGTTTGTTCATTCAACAATGTAAATATAAGATTCAGAAGAAAAAGATTGGTGCTTCGTTTTCTATTA

SEQ ID NO: 2407 - DNA, 2079 bp, Arabidopsis thaliana
  misc_feature (1)..(2079): Ceres cDNA ID no. 13602273
  misc_feature (1)..(2079): Also known as  Ceres CDNA ID no. 23827422
atcacattctctccttattcaacttaaatactacacggccaaaaacatttaacaaacgccactcagatcctgagtctttggatcaatggctatttcaaatgttatttctgtcttattattattgcttgtactaatcaatttaagcaatcaaaatatcaaaggaattgatgcatttcatcagatttacgaagaattgcaatctgaatcagtcgagtcagtgaatcatcttcacagacctagttttcactttcaacctccaaagcattggattaacgatccaaatggtccagtatactacaaaggtctctaccatctcttctaccaatataacaccaaaggtgcggtttggggtaatattatatgggcccattcggtttctaaagacttggttaactgggaggctcttgaaccggctcttagtccttcaaaatggttcgacatcggaggtacatggtccggttcaataacaatcgtaccgggaaaaggaccgattatcctctataccggtgttaaccagaacgaaactcagttgcaaaactatgcaatcccagaggacccatcagacccatacctaaggaaatggattaaaccggacgataacccgattgcaatcccagactatacaatgaacggttcagcattccgtgacccgacaaccgcttggttctccaaagacgggcattggagaaccgtggtagggtcaaaaagaaagcgtagaggaattgcttacatctacagaagccgagatttcaagcattgggtcaaagctaagcacccggttcactctaaacagtcaaccggtatgtgggaatgtcctgatttcttcccggtttccttaaccgatttccgaaacggtttggacttggattacgtcggtccaaacaccaagcatgtgttgaaggttagcttggacattacccggtacgagtattacacgcttggtaaatacgatcttaagaaggaccggtacataccggacggtaatactcccgatggttgggagggtttaagattcgattacggtaatttctacgcttccaagacattctttgactacaaaaagaacagaagaatcttatggggttgggctaatgaatctgacaccgttgaagatgatattttgaagggttgggctggtcttcaggtgattccaagaacggtgctccttgattcaagcaagaagcaacttgtgttttggcctgttgaagagatagagtcattaagaggtaactacgtccgaatgaacaatcatgacatcaagatgggtcaacgcatagaagtcaaaggaatcactcctgctcaagccgatgtggaagtaacgttctatgttggaagtctagagaaagctgagatattcgatccgagtttcacgtggaaaccattggaattgtgtaacattaaaggctcgaatgtgagaggcggtgtaggaccttttggtctgatcacattagcgactcctgatttggaagagtacactcctgtcttctttagagtcttcaacgacactaaaactcataagcctaaagttctcatgtgctccgatgctagaccgtcgtcgttaaagcaagacacgggtttactcgcaaaagataggatgtataaaccatcgtttgctggttttgtggatgttgatatggctgatggaaggatctctctaaggagtttgattgatcattcagtagtagagagctttggagcattaggtaaaacggtgataacatcaagagtgtatccagtgaaagcagtaaaagagaatgcacatttgtatgtctttaacaatggaacacaaactgtgaccatagagagtctcaatgcttggaatatggatcgtcctctgcaaatgaatgatggagctctttaatttagctcttctctctatagtttagctataccgtcttctctctttctcactttttcttatattttcatcttcagtatagtaactgagagatactgtgaaattaggaagaaaaatgtgggagtttctgtgtttacgaacaatttggttgtgatgtccatactttatgtatcgactgttgtatctttctgtctttagtctctcaataaaaataagtttag

SEQ ID NO: 2408 - protein, 2079 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATCACATTCTCTCCTTATTCAACTTAAATACTACACGGCCAAAAACATTTAACAAACGCCACTCAGATCCTGAGTCTTTGGATCAATGGCTATTTCAAATGTTATTTCTGTCTTATTATTATTGCTTGTACTAATCAATTTAAGCAATCAAAATATCAAAGGAATTGATGCATTTCATCAGATTTACGAAGAATTGCAATCTGAATCAGTCGAGTCAGTGAATCATCTTCACAGACCTAGTTTTCACTTTCAACCTCCAAAGCATTGGATTAACGATCCAAATGGTCCAGTATACTACAAAGGTCTCTACCATCTCTTCTACCAATATAACACCAAAGGTGCGGTTTGGGGTAATATTATATGGGCCCATTCGGTTTCTAAAGACTTGGTTAACTGGGAGGCTCTTGAACCGGCTCTTAGTCCTTCAAAATGGTTCGACATCGGAGGTACATGGTCCGGTTCAATAACAATCGTACCGGGAAAAGGACCGATTATCCTCTATACCGGTGTTAACCAGAACGAAACTCAGTTGCAAAACTATGCAATCCCAGAGGACCCATCAGACCCATACCTAAGGAAATGGATTAAACCGGACGATAACCCGATTGCAATCCCAGACTATACAATGAACGGTTCAGCATTCCGTGACCCGACAACCGCTTGGTTCTCCAAAGACGGGCATTGGAGAACCGTGGTAGGGTCAAAAAGAAAGCGTAGAGGAATTGCTTACATCTACAGAAGCCGAGATTTCAAGCATTGGGTCAAAGCTAAGCACCCGGTTCACTCTAAACAGTCAACCGGTATGTGGGAATGTCCTGATTTCTTCCCGGTTTCCTTAACCGATTTCCGAAACGGTTTGGACTTGGATTACGTCGGTCCAAACACCAAGCATGTGTTGAAGGTTAGCTTGGACATTACCCGGTACGAGTATTACACGCTTGGTAAATACGATCTTAAGAAGGACCGGTACATACCGGACGGTAATACTCCCGATGGTTGGGAGGGTTTAAGATTCGATTACGGTAATTTCTACGCTTCCAAGACATTCTTTGACTACAAAAAGAACAGAAGAATCTTATGGGGTTGGGCTAATGAATCTGACACCGTTGAAGATGATATTTTGAAGGGTTGGGCTGGTCTTCAGGTGATTCCAAGAACGGTGCTCCTTGATTCAAGCAAGAAGCAACTTGTGTTTTGGCCTGTTGAAGAGATAGAGTCATTAAGAGGTAACTACGTCCGAATGAACAATCATGACATCAAGATGGGTCAACGCATAGAAGTCAAAGGAATCACTCCTGCTCAAGCCGATGTGGAAGTAACGTTCTATGTTGGAAGTCTAGAGAAAGCTGAGATATTCGATCCGAGTTTCACGTGGAAACCATTGGAATTGTGTAACATTAAAGGCTCGAATGTGAGAGGCGGTGTAGGACCTTTTGGTCTGATCACATTAGCGACTCCTGATTTGGAAGAGTACACTCCTGTCTTCTTTAGAGTCTTCAACGACACTAAAACTCATAAGCCTAAAGTTCTCATGTGCTCCGATGCTAGACCGTCGTCGTTAAAGCAAGACACGGGTTTACTCGCAAAAGATAGGATGTATAAACCATCGTTTGCTGGTTTTGTGGATGTTGATATGGCTGATGGAAGGATCTCTCTAAGGAGTTTGATTGATCATTCAGTAGTAGAGAGCTTTGGAGCATTAGGTAAAACGGTGATAACATCAAGAGTGTATCCAGTGAAAGCAGTAAAAGAGAATGCACATTTGTATGTCTTTAACAATGGAACACAAACTGTGACCATAGAGAGTCTCAATGCTTGGAATATGGATCGTCCTCTGCAAATGAATGATGGAGCTCTTTAATTTAGCTCTTCTCTCTATAGTTTAGCTATACCGTCTTCTCTCTTTCTCACTTTTTCTTATATTTTCATCTTCAGTATAGTAACTGAGAGATACTGTGAAATTAGGAAGAAAAATGTGGGAGTTTCTGTGTTTACGAACAATTTGGTTGTGATGTCCATACTTTATGTATCGACTGTTGTATCTTTCTGTCTTTAGTCTCTCAATAAAAATAAGTTTAG

SEQ ID NO: 2409 - DNA, 1544 bp, Arabidopsis thaliana
  misc_feature (1)..(1544): Ceres cDNA ID no. 13602304
  misc_feature (1)..(1544): Also known as  Ceres CDNA ID no. 23827422
aatgaaagaaactgttcaacaacttctgatttctaaaatcttttaaaaatctctccgccacttctagttggacttgatttctcaccatagtctgtcccgttgttaccgaccatctattatatagggaaagtctcttagctacagagacacaataaccatttggagaggtcatgaactctaagaatcgcataaacaatgtcggggaaggtgttgatatcgaaatccctgacactgctcatcagattagcagcgattcatggtttcaggcagcgttcgttctgacaacaagtataaacagcgcatacgtgttgggatattcaggaacagtcatggttcctttaggatggattggtggtgtggttggtcttattcttgctactgcaatctcactctatgcaaacactctcgtagccaagcttcatgagtttggtggcaaaagacacattcgctatagagaccttgcgggattcatttacggtagaaaggcttattgtcttacatgggtgttgcaatatgtcaatcttttcatgattaattgtggtttcatcatactagctggttccgccttaaaggctgtttatgtgctttttagggatgatcatgccatgaagttacctcattttatagctattgcgggtctgatttgtgcggtttttgctattggaattcctcatttgtcggctcttgggatatggcttgcggtttcgactatcctcagcctcatctatatcgttgtggcaatcgtgctatcggttaaagatggagttaaagcaccttcaagagattacgagatacaaggatcaccactaagcaaactttttaccatcactggagcagccgctacactagttttcgtattcaacacagggatgcttccagaaattcaggcaacagtaaagcaaccagtagtaaaaaacatgatgaaggctctatactttcaattcacggtgggtgttttaccgatgtttgcggttgtattcatcgggtattgggcttacggatcctcgacctcgccctatctactaaacaacgttaatggtccactttgggttaaagcccttgctaacatctccgctatccttcaatccgttatctcgttgcacatttttgcaagtccaacatatgagtacatggacaccaagtttgggatcaaaggaaacccattggcattaaagaacttgttgtttaggatcatggcaagaggcgggtacatagcagttagtacgcttctctcagcactcttgccgttccttggggacttcatgagcctcactggtgcagtgagcacattcccccttacattcattctagccaaccacatgtactataaggctaagaacaataagctcaatactttgcaaaagctatgccattggctcaacgttgtcttcttcagtttgatgtctgttgctgccgccattgcagctcttaggctcatcgcccttgactccaaaaacttccacgtttttgcagatttgtaattcataatatatactcatcgtatttattcttagttggatttcttatcaataaaattaattttc

SEQ ID NO: 2410 - protein, 1544 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
AATGAAAGAAACTGTTCAACAACTTCTGATTTCTAAAATCTTTTAAAAATCTCTCCGCCACTTCTAGTTGGACTTGATTTCTCACCATAGTCTGTCCCGTTGTTACCGACCATCTATTATATAGGGAAAGTCTCTTAGCTACAGAGACACAATAACCATTTGGAGAGGTCATGAACTCTAAGAATCGCATAAACAATGTCGGGGAAGGTGTTGATATCGAAATCCCTGACACTGCTCATCAGATTAGCAGCGATTCATGGTTTCAGGCAGCGTTCGTTCTGACAACAAGTATAAACAGCGCATACGTGTTGGGATATTCAGGAACAGTCATGGTTCCTTTAGGATGGATTGGTGGTGTGGTTGGTCTTATTCTTGCTACTGCAATCTCACTCTATGCAAACACTCTCGTAGCCAAGCTTCATGAGTTTGGTGGCAAAAGACACATTCGCTATAGAGACCTTGCGGGATTCATTTACGGTAGAAAGGCTTATTGTCTTACATGGGTGTTGCAATATGTCAATCTTTTCATGATTAATTGTGGTTTCATCATACTAGCTGGTTCCGCCTTAAAGGCTGTTTATGTGCTTTTTAGGGATGATCATGCCATGAAGTTACCTCATTTTATAGCTATTGCGGGTCTGATTTGTGCGGTTTTTGCTATTGGAATTCCTCATTTGTCGGCTCTTGGGATATGGCTTGCGGTTTCGACTATCCTCAGCCTCATCTATATCGTTGTGGCAATCGTGCTATCGGTTAAAGATGGAGTTAAAGCACCTTCAAGAGATTACGAGATACAAGGATCACCACTAAGCAAACTTTTTACCATCACTGGAGCAGCCGCTACACTAGTTTTCGTATTCAACACAGGGATGCTTCCAGAAATTCAGGCAACAGTAAAGCAACCAGTAGTAAAAAACATGATGAAGGCTCTATACTTTCAATTCACGGTGGGTGTTTTACCGATGTTTGCGGTTGTATTCATCGGGTATTGGGCTTACGGATCCTCGACCTCGCCCTATCTACTAAACAACGTTAATGGTCCACTTTGGGTTAAAGCCCTTGCTAACATCTCCGCTATCCTTCAATCCGTTATCTCGTTGCACATTTTTGCAAGTCCAACATATGAGTACATGGACACCAAGTTTGGGATCAAAGGAAACCCATTGGCATTAAAGAACTTGTTGTTTAGGATCATGGCAAGAGGCGGGTACATAGCAGTTAGTACGCTTCTCTCAGCACTCTTGCCGTTCCTTGGGGACTTCATGAGCCTCACTGGTGCAGTGAGCACATTCCCCCTTACATTCATTCTAGCCAACCACATGTACTATAAGGCTAAGAACAATAAGCTCAATACTTTGCAAAAGCTATGCCATTGGCTCAACGTTGTCTTCTTCAGTTTGATGTCTGTTGCTGCCGCCATTGCAGCTCTTAGGCTCATCGCCCTTGACTCCAAAAACTTCCACGTTTTTGCAGATTTGTAATTCATAATATATACTCATCGTATTTATTCTTAGTTGGATTTCTTATCAATAAAATTAATTTTC

SEQ ID NO: 2411 - DNA, 1340 bp, Arabidopsis thaliana
  misc_feature (1)..(1340): Ceres cDNA ID no. 13602339
  misc_feature (1)..(1340): Also known as  Ceres CDNA ID no. 23827422
gttcaaacaattcttcgtcctattaaatacaaaaaataaaaatccttaaaaatatatccttatcttcaaccaagaatgggagaggtccaagaaggtcccaaagttgaacaagagaagaagccggctgccaccgtagtcccagttgagactactgacggcaagccaaagagcggcggaggagattccgcggcagcagcagcaccaccggtcgccgcggttgtctctgcctttgtttacaaagtggatatgcactgtgaaggctgcgctaagaagataaagcgaatggttaagcactttgatggagtgaaagatgtgacggcagatactggtggaaataagcttttggtggtcggaaagattgatccagtgaaactccaggagaagttggaggagaaaaccaagagaaaggtggttctcgcgaatccaccgccaaaggtagagggacctgttgctgccgccgttggagagaagaaagccgatggtggagataaggaggcggctcctcctgctcctgctccggcagctccaaaagagagcgtggtgcctttaaagatcagactacattgcgaaggatgtattcagaaaatcaagaaaataatattgaaaatcaaaggagtcgaaacagtggctattgacggagctaaagacgtggtgacggttaaaggaacgatagacgttaaagaacttgtgcctctactcactaagaagctcaaaagaaccgtcgagcctcttgttcccgccaaaaaagatgacggagccgccgagaataagaagacggaagctgccgctcctgacgcaaagaaagaggctccgtccgccggagttaacgaagcaaagaaggaaggaagtgacggtggagagaagaaaaaagaggttggagacggcggagagaagaagaaagaaggtggtgacggcggagagaaaaagaaagaagccggagacggaggagagaagaagaaagatggcggaggtgtgccggccccggtggcgatggtgaataagatggattattatgggtactcagcttatccaacggctcctatgcattggcaagaaggacacgtgtacggtcagagttattcgatgacaggtcagaattatccagtgggaggtcagagttatccaggttcaggatacaactacgcaagtgagagttacgtgccgtacgcgcagccaaacgtgaacgctcctggaatgttcagcgacgagaatcccaatggttgctctgttatgtaataatggggttaaactgtaaatataagaaactataagggtttaaaacataattgtgggaacacaaaacttatgttaaaattttgaaagtctactttgagccagcg

SEQ ID NO: 2412 - protein, 1340 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
GTTCAAACAATTCTTCGTCCTATTAAATACAAAAAATAAAAATCCTTAAAAATATATCCTTATCTTCAACCAAGAATGGGAGAGGTCCAAGAAGGTCCCAAAGTTGAACAAGAGAAGAAGCCGGCTGCCACCGTAGTCCCAGTTGAGACTACTGACGGCAAGCCAAAGAGCGGCGGAGGAGATTCCGCGGCAGCAGCAGCACCACCGGTCGCCGCGGTTGTCTCTGCCTTTGTTTACAAAGTGGATATGCACTGTGAAGGCTGCGCTAAGAAGATAAAGCGAATGGTTAAGCACTTTGATGGAGTGAAAGATGTGACGGCAGATACTGGTGGAAATAAGCTTTTGGTGGTCGGAAAGATTGATCCAGTGAAACTCCAGGAGAAGTTGGAGGAGAAAACCAAGAGAAAGGTGGTTCTCGCGAATCCACCGCCAAAGGTAGAGGGACCTGTTGCTGCCGCCGTTGGAGAGAAGAAAGCCGATGGTGGAGATAAGGAGGCGGCTCCTCCTGCTCCTGCTCCGGCAGCTCCAAAAGAGAGCGTGGTGCCTTTAAAGATCAGACTACATTGCGAAGGATGTATTCAGAAAATCAAGAAAATAATATTGAAAATCAAAGGAGTCGAAACAGTGGCTATTGACGGAGCTAAAGACGTGGTGACGGTTAAAGGAACGATAGACGTTAAAGAACTTGTGCCTCTACTCACTAAGAAGCTCAAAAGAACCGTCGAGCCTCTTGTTCCCGCCAAAAAAGATGACGGAGCCGCCGAGAATAAGAAGACGGAAGCTGCCGCTCCTGACGCAAAGAAAGAGGCTCCGTCCGCCGGAGTTAACGAAGCAAAGAAGGAAGGAAGTGACGGTGGAGAGAAGAAAAAAGAGGTTGGAGACGGCGGAGAGAAGAAGAAAGAAGGTGGTGACGGCGGAGAGAAAAAGAAAGAAGCCGGAGACGGAGGAGAGAAGAAGAAAGATGGCGGAGGTGTGCCGGCCCCGGTGGCGATGGTGAATAAGATGGATTATTATGGGTACTCAGCTTATCCAACGGCTCCTATGCATTGGCAAGAAGGACACGTGTACGGTCAGAGTTATTCGATGACAGGTCAGAATTATCCAGTGGGAGGTCAGAGTTATCCAGGTTCAGGATACAACTACGCAAGTGAGAGTTACGTGCCGTACGCGCAGCCAAACGTGAACGCTCCTGGAATGTTCAGCGACGAGAATCCCAATGGTTGCTCTGTTATGTAATAATGGGGTTAAACTGTAAATATAAGAAACTATAAGGGTTTAAAACATAATTGTGGGAACACAAAACTTATGTTAAAATTTTGAAAGTCTACTTTGAGCCAGCG

SEQ ID NO: 2413 - DNA, 1098 bp, Arabidopsis thaliana
  misc_feature (1)..(1098): Ceres cDNA ID no. 13602446
  misc_feature (1)..(1098): Also known as  Ceres CDNA ID no. 23827422
acaacaaatcgtctccgtcttcctcgctcagcttcaacaaccagagccgacttgagattgagaatcaacgtaatcgatactctcgcaaagtctcatcctttctcagcaaaaaacactaggaaatggttgaaaggcatggagagttttgatttgctgcttaagatatatcatgtcgcagtgcgttgacggtatcaagcatttatgcacctctgttttagggtgttttgatcttgatttgtataaacaatctggtggccttggagatcctgaattgcttgcaagagacactgtttttagtgtgagtgaaatagaagctctttatgagctttttaagaaaatcagcagtgccgtgattgatgatgggctaataaacaaggaagagtttcagttggctttgtttaagacaaataaaaaagagagtttgtttgcagatcgggttttcgatttgtttgatacaaagcacaatggaatactggggtttgaggaatttgctcgtgctctctccgtctttcacccaaatgcgcctatagatgacaaaattcacttttcatttcagctatatgatcttaaacagcaagggtttatcgaacggcaagaggtgaaacaaatggttgtcgctacgcttgctgaatctggaatgaatttgaaggatactgtcattgaggatataatcgacaagacgtttgaggaagcagacacaaaacacgatggaaagatcgataaggaagagtggagaagccttgttcttagacatcccagccttctgaagaacatgactcttcaatatctcaaggatatcacgactacgtttccaagctttgtgttccattctcaggttgaagatacctgaaaaagcaaaagcaaaagcaagcagcggcaagacatcattgtattgttgaaggttgttctttcgttatggttctttatttgttacatttctaaatctctgaactcattttattttttattgagctttttttgtgaagcaaaattcttctttttagtttggtttttgtcctttttgatttcgctcggtctatctgtagatacaacttttgcatcttgatgttatggtaatgtaaagtttttcagtttatt

SEQ ID NO: 2414 - protein, 1098 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ACAACAAATCGTCTCCGTCTTCCTCGCTCAGCTTCAACAACCAGAGCCGACTTGAGATTGAGAATCAACGTAATCGATACTCTCGCAAAGTCTCATCCTTTCTCAGCAAAAAACACTAGGAAATGGTTGAAAGGCATGGAGAGTTTTGATTTGCTGCTTAAGATATATCATGTCGCAGTGCGTTGACGGTATCAAGCATTTATGCACCTCTGTTTTAGGGTGTTTTGATCTTGATTTGTATAAACAATCTGGTGGCCTTGGAGATCCTGAATTGCTTGCAAGAGACACTGTTTTTAGTGTGAGTGAAATAGAAGCTCTTTATGAGCTTTTTAAGAAAATCAGCAGTGCCGTGATTGATGATGGGCTAATAAACAAGGAAGAGTTTCAGTTGGCTTTGTTTAAGACAAATAAAAAAGAGAGTTTGTTTGCAGATCGGGTTTTCGATTTGTTTGATACAAAGCACAATGGAATACTGGGGTTTGAGGAATTTGCTCGTGCTCTCTCCGTCTTTCACCCAAATGCGCCTATAGATGACAAAATTCACTTTTCATTTCAGCTATATGATCTTAAACAGCAAGGGTTTATCGAACGGCAAGAGGTGAAACAAATGGTTGTCGCTACGCTTGCTGAATCTGGAATGAATTTGAAGGATACTGTCATTGAGGATATAATCGACAAGACGTTTGAGGAAGCAGACACAAAACACGATGGAAAGATCGATAAGGAAGAGTGGAGAAGCCTTGTTCTTAGACATCCCAGCCTTCTGAAGAACATGACTCTTCAATATCTCAAGGATATCACGACTACGTTTCCAAGCTTTGTGTTCCATTCTCAGGTTGAAGATACCTGAAAAAGCAAAAGCAAAAGCAAGCAGCGGCAAGACATCATTGTATTGTTGAAGGTTGTTCTTTCGTTATGGTTCTTTATTTGTTACATTTCTAAATCTCTGAACTCATTTTATTTTTTATTGAGCTTTTTTTGTGAAGCAAAATTCTTCTTTTTAGTTTGGTTTTTGTCCTTTTTGATTTCGCTCGGTCTATCTGTAGATACAACTTTTGCATCTTGATGTTATGGTAATGTAAAGTTTTTCAGTTTATT

SEQ ID NO: 2415 - DNA, 1172 bp, Arabidopsis thaliana
  misc_feature (1)..(1172): Ceres cDNA ID no. 13602519
  misc_feature (1)..(1172): Also known as  Ceres CDNA ID no. 23827422
tttcctctgcttctcaacatctctaagctttcattgaacaaggaatatgaaatcttctccaagatcagaaggaagaaagttcattatcccttctttcttcttcatcatagctctttgtgtactagctttcatcaacgagatcagattcgatagcttattgagttttggaagatgtgctttgtcaaatgttcctatgaataatggttcatcagagactccattgttgtcttcttctcctgttgatgatgagattaggattcttattggaatccttacacttcctgatcagtattcacgtcgccattttctccggatgatctacgggacacaaaatgttccggacggtgttaaggttgatgtgaagtttgtgttctgtaatttgactaaagaagaccagaaagtgcttgttgctttggagattatgcgttatgatgacatcattatactcaactgcaatgagaatatgaacaaaggcaagacttacacatacttctcaagcttaccagacatattcaatgagaccgatgcacaaaaaccaccgtaccattacgtaatgaaagccgacgacgacacatacataagactagaaagtctcgttgcatctttgagaccactccctcgagaagatctttactacggctatgtaattccatgtccaagcatggacccatttgttcattacatgtcaggaatgggttacttagtgtcatgggatattgcggtttggctcaaagactcggaaattcccaagaaacatctagaaggtcctgaagacaaagtgtttggcgattggattcgagaaggaagacgaggaaaaaaccggtttaacgctaagtggtccatgtataatttccctgagccaccgactagatgcacacatgagctttggccagacactattgccgttcatttgttaaagaaccaagagaagtggatacgtacattgaactatttcaatgttactagcaatctcaagccttctaaactataccacataccgtagatagtctttttgtttgcttttaccggattcttatatttatactttacattgtttctcttgaaattggtaagaaatgttctttaataatcgattttttgggagggatttgtagtacactaattaaggattgttcaaacatgtttaatagtcaatctggtggggttttttc

SEQ ID NO: 2416 - protein, 1172 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
TTTCCTCTGCTTCTCAACATCTCTAAGCTTTCATTGAACAAGGAATATGAAATCTTCTCCAAGATCAGAAGGAAGAAAGTTCATTATCCCTTCTTTCTTCTTCATCATAGCTCTTTGTGTACTAGCTTTCATCAACGAGATCAGATTCGATAGCTTATTGAGTTTTGGAAGATGTGCTTTGTCAAATGTTCCTATGAATAATGGTTCATCAGAGACTCCATTGTTGTCTTCTTCTCCTGTTGATGATGAGATTAGGATTCTTATTGGAATCCTTACACTTCCTGATCAGTATTCACGTCGCCATTTTCTCCGGATGATCTACGGGACACAAAATGTTCCGGACGGTGTTAAGGTTGATGTGAAGTTTGTGTTCTGTAATTTGACTAAAGAAGACCAGAAAGTGCTTGTTGCTTTGGAGATTATGCGTTATGATGACATCATTATACTCAACTGCAATGAGAATATGAACAAAGGCAAGACTTACACATACTTCTCAAGCTTACCAGACATATTCAATGAGACCGATGCACAAAAACCACCGTACCATTACGTAATGAAAGCCGACGACGACACATACATAAGACTAGAAAGTCTCGTTGCATCTTTGAGACCACTCCCTCGAGAAGATCTTTACTACGGCTATGTAATTCCATGTCCAAGCATGGACCCATTTGTTCATTACATGTCAGGAATGGGTTACTTAGTGTCATGGGATATTGCGGTTTGGCTCAAAGACTCGGAAATTCCCAAGAAACATCTAGAAGGTCCTGAAGACAAAGTGTTTGGCGATTGGATTCGAGAAGGAAGACGAGGAAAAAACCGGTTTAACGCTAAGTGGTCCATGTATAATTTCCCTGAGCCACCGACTAGATGCACACATGAGCTTTGGCCAGACACTATTGCCGTTCATTTGTTAAAGAACCAAGAGAAGTGGATACGTACATTGAACTATTTCAATGTTACTAGCAATCTCAAGCCTTCTAAACTATACCACATACCGTAGATAGTCTTTTTGTTTGCTTTTACCGGATTCTTATATTTATACTTTACATTGTTTCTCTTGAAATTGGTAAGAAATGTTCTTTAATAATCGATTTTTTGGGAGGGATTTGTAGTACACTAATTAAGGATTGTTCAAACATGTTTAATAGTCAATCTGGTGGGGTTTTTTC

SEQ ID NO: 2417 - DNA, 1540 bp, Arabidopsis thaliana
  misc_feature (1)..(1540): Ceres cDNA ID no. 13602619
  misc_feature (1)..(1540): Also known as  Ceres CDNA ID no. 23827422
atcctctgcaaagttatggctttgcttgagagtataatattagggctaatcacaggatggttagcttttgttattgggttggttattggatgggcatggaaaccaagatgggtttcttcttctaataatcgacaagtcaaattacaatgttctgctccaagatcttttgatttgtctttaccatcttcttctcctagttctgttgttacttctcctttgaagggttttggatcagctccttgcttaaaggctcttgtttgtgatacatggactatggctttaagacaacagagacaaacagtttctcctgattcttcttcttcttcatatgattcttctgaacaacatttggatttggtttcaagagtgaagaaaacaaaggagagattgcctaatactgtaacagagttagatttgagacatcttgtgcaattggttgagaggaaagatggtggtcaagcttggattcagatgatggatcgttttactcctggtatgagataccaagcttggttgagagaacctaagaatggtcctactgagtatagaagtagaactgtgtttgaagatgcaactcctgtgatgttaagagactttttctgggatgatgagtttagaccaacttgggatacaatgctttctaattccactactgttgaagagtgtcccagtactggaaccatgattgttagatggatacgcaagttcccgttcttctgcagtgatagagagtatgtaatcggtcgcaggatatggaattgtggaaactcttattactgtgttacaaagggagtatcggttccttctataccgcctaacaacaaacaaaaacgcgtggatttgttctactcaagctggtgcattcgaccagtggaatcaagaagagacgatggggtaacaagtgcctgcgaagtacttctattccaccacgaagacatgggaatacctagagaaatcgcaaagcttggagtgaaacgaggaatgtggggagcagtgaagaagatggaacccggtttacgtgcttaccaaacgcatagactctcagatggaggaaccaagctttctcggtctgctttcatggctcaaatcaacaccaagatcacacaagaccatctcatctccctcagcaacggtgcatcgcctgtcactgaaactcccgttacattaaaccaaggaaaccgagctgcgaatctgaagaaactgttgattatcggtggagctgttgcggttgtctgcagtttaagcggaggtgcttttgttcctcctgcgtttcttttaggttttgggaaaaggtttgttaatggtggaagaaaacgtcagctcgaaggaacaacaagaagtgagagtcagactacttcttcatagaatcttgagaccaagaatatagatcaacatataaatttagattcgttttaagtagattaagaataatccattccaaaattagtttatagaattggaataagctgtatgattattaatctttatacaaaggaaggaacattttttttacaagtaatgaataaaatctctttatcat

SEQ ID NO: 2418 - protein, 1540 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATCCTCTGCAAAGTTATGGCTTTGCTTGAGAGTATAATATTAGGGCTAATCACAGGATGGTTAGCTTTTGTTATTGGGTTGGTTATTGGATGGGCATGGAAACCAAGATGGGTTTCTTCTTCTAATAATCGACAAGTCAAATTACAATGTTCTGCTCCAAGATCTTTTGATTTGTCTTTACCATCTTCTTCTCCTAGTTCTGTTGTTACTTCTCCTTTGAAGGGTTTTGGATCAGCTCCTTGCTTAAAGGCTCTTGTTTGTGATACATGGACTATGGCTTTAAGACAACAGAGACAAACAGTTTCTCCTGATTCTTCTTCTTCTTCATATGATTCTTCTGAACAACATTTGGATTTGGTTTCAAGAGTGAAGAAAACAAAGGAGAGATTGCCTAATACTGTAACAGAGTTAGATTTGAGACATCTTGTGCAATTGGTTGAGAGGAAAGATGGTGGTCAAGCTTGGATTCAGATGATGGATCGTTTTACTCCTGGTATGAGATACCAAGCTTGGTTGAGAGAACCTAAGAATGGTCCTACTGAGTATAGAAGTAGAACTGTGTTTGAAGATGCAACTCCTGTGATGTTAAGAGACTTTTTCTGGGATGATGAGTTTAGACCAACTTGGGATACAATGCTTTCTAATTCCACTACTGTTGAAGAGTGTCCCAGTACTGGAACCATGATTGTTAGATGGATACGCAAGTTCCCGTTCTTCTGCAGTGATAGAGAGTATGTAATCGGTCGCAGGATATGGAATTGTGGAAACTCTTATTACTGTGTTACAAAGGGAGTATCGGTTCCTTCTATACCGCCTAACAACAAACAAAAACGCGTGGATTTGTTCTACTCAAGCTGGTGCATTCGACCAGTGGAATCAAGAAGAGACGATGGGGTAACAAGTGCCTGCGAAGTACTTCTATTCCACCACGAAGACATGGGAATACCTAGAGAAATCGCAAAGCTTGGAGTGAAACGAGGAATGTGGGGAGCAGTGAAGAAGATGGAACCCGGTTTACGTGCTTACCAAACGCATAGACTCTCAGATGGAGGAACCAAGCTTTCTCGGTCTGCTTTCATGGCTCAAATCAACACCAAGATCACACAAGACCATCTCATCTCCCTCAGCAACGGTGCATCGCCTGTCACTGAAACTCCCGTTACATTAAACCAAGGAAACCGAGCTGCGAATCTGAAGAAACTGTTGATTATCGGTGGAGCTGTTGCGGTTGTCTGCAGTTTAAGCGGAGGTGCTTTTGTTCCTCCTGCGTTTCTTTTAGGTTTTGGGAAAAGGTTTGTTAATGGTGGAAGAAAACGTCAGCTCGAAGGAACAACAAGAAGTGAGAGTCAGACTACTTCTTCATAGAATCTTGAGACCAAGAATATAGATCAACATATAAATTTAGATTCGTTTTAAGTAGATTAAGAATAATCCATTCCAAAATTAGTTTATAGAATTGGAATAAGCTGTATGATTATTAATCTTTATACAAAGGAAGGAACATTTTTTTTACAAGTAATGAATAAAATCTCTTTATCAT

SEQ ID NO: 2419 - DNA, 1195 bp, Arabidopsis thaliana
  misc_feature (1)..(1195): Ceres cDNA ID no. 13602765
  misc_feature (1)..(1195): Also known as  Ceres CDNA ID no. 23827422
aactttatagttaaagttatcaattattcgaaaacaaagctggttttttgttttgtcccttaaaccagcatgatcaagaacttaagtaatatgaagaatgacaatcagaaacgtgaaaaatgttgcgagtacatcgaagctctcgaagaagaacgtcgcaagatcaatgttttccaacgcgagcttcctctttgcgtagagctcgtgactcaagcgattgaggcgtataagagggagatatcagggacgtcgacggataacttatacggacagtcggagtgctcagagcagaccaccggagaatgtgggcgcatcttggatctgttcataccaatcaaacactcttcgacctccatagaagaagaggttgatgacaaagatgatgatgatgaagaacaccagtctcatgaaaccgacatagattttgatgacaagaacatgaaatctgaatggctcaagtctgttcagctctggaaccaatccgacgcagttgtttctaataatagacaggatcgctcacaagaaaagacagagacgctggtagagttgataaaaataaacgatgaagcagcgaagaaaaacaacaacataaaatcaccggtgactactagcgatggtggcagtggcggtggcggtggcagaagagggcagagaaagaataggcggtgttggtcgcaagagttacacagacgcttcttgaacgctcttaaacaacttggtggccctcatgtagctacgccgaaacagataagagatataatgaaggttgatgggttaacaaatgatgaagtcaaaagtcatttacagaaatataggctgcatgcaagacggccaagccaaacaacaccgaacaacagaaactctcaaacgcaacatttcgtggtggttggtggaatatgggtcccacagactaaccattcaacggccaacgcagtcaacgccgtcgcatcgggtgagaccaccgggatttatgggcctatggtcagttcgttgccgtccgagtggccgaggcattccaattttggtaggaagatttcggaagatagatcaagatgctctaacaacggattttttcggtgtagctcaccagctatgtcttgttctactcgtacaaagacgaaagatgcaaaaataatatcataaatttaatttttgattatttattaagagaaaaaagttatagacattaatattg

SEQ ID NO: 2420 - protein, 1195 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
AACTTTATAGTTAAAGTTATCAATTATTCGAAAACAAAGCTGGTTTTTTGTTTTGTCCCTTAAACCAGCATGATCAAGAACTTAAGTAATATGAAGAATGACAATCAGAAACGTGAAAAATGTTGCGAGTACATCGAAGCTCTCGAAGAAGAACGTCGCAAGATCAATGTTTTCCAACGCGAGCTTCCTCTTTGCGTAGAGCTCGTGACTCAAGCGATTGAGGCGTATAAGAGGGAGATATCAGGGACGTCGACGGATAACTTATACGGACAGTCGGAGTGCTCAGAGCAGACCACCGGAGAATGTGGGCGCATCTTGGATCTGTTCATACCAATCAAACACTCTTCGACCTCCATAGAAGAAGAGGTTGATGACAAAGATGATGATGATGAAGAACACCAGTCTCATGAAACCGACATAGATTTTGATGACAAGAACATGAAATCTGAATGGCTCAAGTCTGTTCAGCTCTGGAACCAATCCGACGCAGTTGTTTCTAATAATAGACAGGATCGCTCACAAGAAAAGACAGAGACGCTGGTAGAGTTGATAAAAATAAACGATGAAGCAGCGAAGAAAAACAACAACATAAAATCACCGGTGACTACTAGCGATGGTGGCAGTGGCGGTGGCGGTGGCAGAAGAGGGCAGAGAAAGAATAGGCGGTGTTGGTCGCAAGAGTTACACAGACGCTTCTTGAACGCTCTTAAACAACTTGGTGGCCCTCATGTAGCTACGCCGAAACAGATAAGAGATATAATGAAGGTTGATGGGTTAACAAATGATGAAGTCAAAAGTCATTTACAGAAATATAGGCTGCATGCAAGACGGCCAAGCCAAACAACACCGAACAACAGAAACTCTCAAACGCAACATTTCGTGGTGGTTGGTGGAATATGGGTCCCACAGACTAACCATTCAACGGCCAACGCAGTCAACGCCGTCGCATCGGGTGAGACCACCGGGATTTATGGGCCTATGGTCAGTTCGTTGCCGTCCGAGTGGCCGAGGCATTCCAATTTTGGTAGGAAGATTTCGGAAGATAGATCAAGATGCTCTAACAACGGATTTTTTCGGTGTAGCTCACCAGCTATGTCTTGTTCTACTCGTACAAAGACGAAAGATGCAAAAATAATATCATAAATTTAATTTTTGATTATTTATTAAGAGAAAAAAGTTATAGACATTAATATTG

SEQ ID NO: 2421 - DNA, 1489 bp, Arabidopsis thaliana
  misc_feature (1)..(1489): Ceres cDNA ID no. 13602857
  misc_feature (1)..(1489): Also known as  Ceres CDNA ID no. 23827422
cgatttctccgctcttctccactcttcttctctgttctatcgcagacatttttgtttatatgcatacataataataatacactcttgtcaggatttttgattctctctttggttttctcggaaaaatgtctgcgatactccaaggagctggagctgcaacggctctctcgccgtttaattctatcgattccaacaaactcgttgctccttctcgctcttctctttcagtgaggagcaagagatacattgttgccggatctgatagtaaaagctttggttctagcctcgtagctcgtcgctctgagccgttgataccaaatgctgttacgacgaaggcggacactgctgcgagctctacttcatcaaagcctggacatgagctattacttttcgaggctcttcaagaaggtctagaagaagagatggacagagatccacatgtatgtgtcatgggtgaagatgtaggccattacggaggctcatacaaagtaactaaaggcctagctgataagtttggcgatctcagggttctggacactccaatctgtgaaaacgccttcaccggtatgggcattggagccgccatgacaggactaagacccgtcatcgaaggtatgaacatggggtttctactcttagccttcaaccaaatctccaacaactgtggtatgcttcactatacatccggtggtcaattcactatcccggttgttatccgtgggcctggaggtgtgggccggcagctcggagccgagcattcccagcgtctcgagtcttacttccagtcaatccctgggatccagatggtggcttgctcaacaccttacaacgctaaaggattgatgaaagcggcgataagaagtgagaatcctgtgattctgtttgaacacgttctgctctataacctcaaggagagtattccggatgaagaatacatatgtaatctggaagaagcagaaatggtcagacccggtgaacacatcacgatactgacgtattcaaggatgaggtaccatgtaatgcaggctgcaaagacgctggtgaacaaagggtatgatccagaggttatcgacataaggtcgttgaagccgtttgatctctacacaattggaaactcggtgaagaagacacaccgggttttgattgtggaggaatgtatgagaacgggaggaatcggagccagtttgacggctgcaataaacgagaactttcatgattacttagatgctccggtgatgtgtttgtcttctcaggatgtcccaactccttacgccggtacattggaagaatggacggttgttcagccagctcagatcgtcactgccgtcgaacaactttgccagtaattgctttttttacggtgattgtgttttacccttttttactttttgttactgtttgtcttcgatggaaaatgcttgtgaaatgaaaactctgaattttactcttatgatatgaacatttatattttctatagataataacttcc

SEQ ID NO: 2422 - protein, 1489 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
CGATTTCTCCGCTCTTCTCCACTCTTCTTCTCTGTTCTATCGCAGACATTTTTGTTTATATGCATACATAATAATAATACACTCTTGTCAGGATTTTTGATTCTCTCTTTGGTTTTCTCGGAAAAATGTCTGCGATACTCCAAGGAGCTGGAGCTGCAACGGCTCTCTCGCCGTTTAATTCTATCGATTCCAACAAACTCGTTGCTCCTTCTCGCTCTTCTCTTTCAGTGAGGAGCAAGAGATACATTGTTGCCGGATCTGATAGTAAAAGCTTTGGTTCTAGCCTCGTAGCTCGTCGCTCTGAGCCGTTGATACCAAATGCTGTTACGACGAAGGCGGACACTGCTGCGAGCTCTACTTCATCAAAGCCTGGACATGAGCTATTACTTTTCGAGGCTCTTCAAGAAGGTCTAGAAGAAGAGATGGACAGAGATCCACATGTATGTGTCATGGGTGAAGATGTAGGCCATTACGGAGGCTCATACAAAGTAACTAAAGGCCTAGCTGATAAGTTTGGCGATCTCAGGGTTCTGGACACTCCAATCTGTGAAAACGCCTTCACCGGTATGGGCATTGGAGCCGCCATGACAGGACTAAGACCCGTCATCGAAGGTATGAACATGGGGTTTCTACTCTTAGCCTTCAACCAAATCTCCAACAACTGTGGTATGCTTCACTATACATCCGGTGGTCAATTCACTATCCCGGTTGTTATCCGTGGGCCTGGAGGTGTGGGCCGGCAGCTCGGAGCCGAGCATTCCCAGCGTCTCGAGTCTTACTTCCAGTCAATCCCTGGGATCCAGATGGTGGCTTGCTCAACACCTTACAACGCTAAAGGATTGATGAAAGCGGCGATAAGAAGTGAGAATCCTGTGATTCTGTTTGAACACGTTCTGCTCTATAACCTCAAGGAGAGTATTCCGGATGAAGAATACATATGTAATCTGGAAGAAGCAGAAATGGTCAGACCCGGTGAACACATCACGATACTGACGTATTCAAGGATGAGGTACCATGTAATGCAGGCTGCAAAGACGCTGGTGAACAAAGGGTATGATCCAGAGGTTATCGACATAAGGTCGTTGAAGCCGTTTGATCTCTACACAATTGGAAACTCGGTGAAGAAGACACACCGGGTTTTGATTGTGGAGGAATGTATGAGAACGGGAGGAATCGGAGCCAGTTTGACGGCTGCAATAAACGAGAACTTTCATGATTACTTAGATGCTCCGGTGATGTGTTTGTCTTCTCAGGATGTCCCAACTCCTTACGCCGGTACATTGGAAGAATGGACGGTTGTTCAGCCAGCTCAGATCGTCACTGCCGTCGAACAACTTTGCCAGTAATTGCTTTTTTTACGGTGATTGTGTTTTACCCTTTTTTACTTTTTGTTACTGTTTGTCTTCGATGGAAAATGCTTGTGAAATGAAAACTCTGAATTTTACTCTTATGATATGAACATTTATATTTTCTATAGATAATAACTTCC

SEQ ID NO: 2423 - DNA, 1302 bp, Arabidopsis thaliana
  misc_feature (1)..(1302): Ceres cDNA ID no. 13602944
  misc_feature (1)..(1302): Also known as  Ceres CDNA ID no. 23827422
atctttcttctctctctatctctcctctttgaaccctaaaaactctttctttacaaggattgatctttttgtatttttgattttgacatttgctttgtgttcgatctctgttttgatgcgatttctctgtttttaaagccatttgatagattgtttccggtaaagctcagcgagagaagaagaagaacaacaatggagtttacagatttctcaaagacgagtttttactacccgtcgtcacaaagcgtttgggatttcggagatttagcggcggcggagaggcattctttagggttcatggagttattaagttctcagcagcatcaagactttgctactgtttctcctcattccttccttctccaaacgtctcaaccgcaaacgcaaacgcaaccatcggcgaagctgtcttcaagtatcattcaagctccaccgtcagagcaattagtgacgtcaaaggtggagtctttgtgttcggatcatttgttgataaacccaccggcgactcctaactcgtcatcgatttcgtctgcttcaagcgaggctctaaatgaagagaaaccgaaaacagaagacaatgaagaagaaggaggtgaagatcaacaagagaagagtcatactaagaaacagttgaaagcaaagaagaataatcagaagagacagagagaggcaagagtcgcattcatgacaaagagtgaagttgatcatctcgaagatggttatcgctggcgaaaatatggtcaaaaagctgtcaaaaacagtccttttcccaggagttactaccgttgcacaacggcttcatgtaacgtgaagaagagagtggagagatcattcagagatccaagcactgtggttacaacctacgaaggtcaacacactcacattagtccactcacgtctcgtcctatttccactggaggtttcttcggatcgtcaggagctgcttcgagtctcggtaatggttgctttgggtttcctattgatggctccacgttaatctctcctcagttccaacagcttgtccaataccatcaccaacagcagcaacaagaactcatgtcttgttttggaggagtcaacgagtaccttaatagccacgctaatgagtatggtgatgataatcgtgtgaagaagagtcgagttttggttaaagataatggacttctgcaagatgttgttccgtctcatatgttgaaggaagagtagtagtatatatatagtcttatagttttaatctagtttttttttgtataattgtctaaaagaaacggatcttttgttctgatgaagaagatgttttct

SEQ ID NO: 2424 - protein, 1302 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATCTTTCTTCTCTCTCTATCTCTCCTCTTTGAACCCTAAAAACTCTTTCTTTACAAGGATTGATCTTTTTGTATTTTTGATTTTGACATTTGCTTTGTGTTCGATCTCTGTTTTGATGCGATTTCTCTGTTTTTAAAGCCATTTGATAGATTGTTTCCGGTAAAGCTCAGCGAGAGAAGAAGAAGAACAACAATGGAGTTTACAGATTTCTCAAAGACGAGTTTTTACTACCCGTCGTCACAAAGCGTTTGGGATTTCGGAGATTTAGCGGCGGCGGAGAGGCATTCTTTAGGGTTCATGGAGTTATTAAGTTCTCAGCAGCATCAAGACTTTGCTACTGTTTCTCCTCATTCCTTCCTTCTCCAAACGTCTCAACCGCAAACGCAAACGCAACCATCGGCGAAGCTGTCTTCAAGTATCATTCAAGCTCCACCGTCAGAGCAATTAGTGACGTCAAAGGTGGAGTCTTTGTGTTCGGATCATTTGTTGATAAACCCACCGGCGACTCCTAACTCGTCATCGATTTCGTCTGCTTCAAGCGAGGCTCTAAATGAAGAGAAACCGAAAACAGAAGACAATGAAGAAGAAGGAGGTGAAGATCAACAAGAGAAGAGTCATACTAAGAAACAGTTGAAAGCAAAGAAGAATAATCAGAAGAGACAGAGAGAGGCAAGAGTCGCATTCATGACAAAGAGTGAAGTTGATCATCTCGAAGATGGTTATCGCTGGCGAAAATATGGTCAAAAAGCTGTCAAAAACAGTCCTTTTCCCAGGAGTTACTACCGTTGCACAACGGCTTCATGTAACGTGAAGAAGAGAGTGGAGAGATCATTCAGAGATCCAAGCACTGTGGTTACAACCTACGAAGGTCAACACACTCACATTAGTCCACTCACGTCTCGTCCTATTTCCACTGGAGGTTTCTTCGGATCGTCAGGAGCTGCTTCGAGTCTCGGTAATGGTTGCTTTGGGTTTCCTATTGATGGCTCCACGTTAATCTCTCCTCAGTTCCAACAGCTTGTCCAATACCATCACCAACAGCAGCAACAAGAACTCATGTCTTGTTTTGGAGGAGTCAACGAGTACCTTAATAGCCACGCTAATGAGTATGGTGATGATAATCGTGTGAAGAAGAGTCGAGTTTTGGTTAAAGATAATGGACTTCTGCAAGATGTTGTTCCGTCTCATATGTTGAAGGAAGAGTAGTAGTATATATATAGTCTTATAGTTTTAATCTAGTTTTTTTTTGTATAATTGTCTAAAAGAAACGGATCTTTTGTTCTGATGAAGAAGATGTTTTCT

SEQ ID NO: 2425 - DNA, 1751 bp, Arabidopsis thaliana
  misc_feature (1)..(1751): Ceres cDNA ID no. 13603121
  misc_feature (1)..(1751): Also known as  Ceres CDNA ID no. 23827422
attcagcttgctcgcaacgaaacatattttgttggaaaaaaaaaacaaaggaaatcgccatggaagacgttaaccagttgttcgatgctgctttcgagttcgcacactatcccggcgctcaaaacgaaacttccgttaaggaattcctcgatcgcttccctcttcctgttatcttcaatgctttgcaaaccgatccggatataccaggatttgaaaacacgttggtgacttgcttggagaggttgtttaagactaagtatggcgcttcacttattcctcagtatatgcctgttctgcaagttggtctcaaggcagattctgcagttgtgaaatctctggcttgcaaaactgttctgtgtctcttggaggattgcgatacaaacgacgtttcttctgttcagctagttgttaacaatggcatataccctcttctacttgactatatcattaacagcgatgatgaagttgcaaatgctgcaagtgagacaattaagagcctagctcgctttccagatgcaatgtccgtaattttcccttctgaaaccaacgatcctacacatcttcgtaaccttgctgcaaggtgttcatcactggcacgagtccgggttttgtcgttgatagtgaagcttttttcgatttctcgacttgtagcttcagaagttaagaaatcggggcttcttgatttactggaggcagaaatgaagggtacaaaagacactcttgtgatcttaaatgttctggaactctactatgagttaatggaagtggagcacagttcagagttcgtgccacaaacatcacttattcagctgttgtgttctatcatcagtggtacatcgacgggaccctatgaaaagttaagagcaatgatgataagtggcagactactctcaaaggaaaatatctacaaagtcgtggaagaagctagtgtgaaggcgttaatttcagctattgatgggagtctggagtcagttgagatgaatgatactgatgcacaggaagctgccattgatgcacttggtcagatgggatcaacaacgaagggagcggatcttgtcctttcaacttcacctccagctgcaagacatgttgtagcttctgcctttgatcgtaatgcacatggaaaacagttggctgcactgcatgcactggcaaacatcgcaggtgaaacacgacctaagagcaacagaatagttgatggaaaagctgaagaaagccttagatgtttgatatacgacgctgcagcacagagcacaaaactaaccccatccggtttattcctctcagttcttcaacaaagctcagagattcgtcttgcgggttatcgaacgttaacagcattagtggctcggccatggtgcctggtggaaatcttggccaaagaagagataataaacatagttacggatgcaaccactgaaactgcaaaaatagcaatggaagcaaggtataactgctgcaaagcaattcacgaagcgttcttgtgtagtaactttgttgatgaccctcgtcgtctaaaaaccggtgacaagttgcaagaagctgttcgaagtggaccatatatgtcgaagaagcacagaggcgcacgaccagaagtaatgacaggcgaaggattttaaagacaactaaagaaaaaaagttaaaacttctttgttaaccaaagttttttatatcttctctggctgttcgataagtaaactttagttctttctataaacaacgaaggctaggagtaaacgttttggcggttg

SEQ ID NO: 2426 - protein, 1751 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATTCAGCTTGCTCGCAACGAAACATATTTTGTTGGAAAAAAAAAACAAAGGAAATCGCCATGGAAGACGTTAACCAGTTGTTCGATGCTGCTTTCGAGTTCGCACACTATCCCGGCGCTCAAAACGAAACTTCCGTTAAGGAATTCCTCGATCGCTTCCCTCTTCCTGTTATCTTCAATGCTTTGCAAACCGATCCGGATATACCAGGATTTGAAAACACGTTGGTGACTTGCTTGGAGAGGTTGTTTAAGACTAAGTATGGCGCTTCACTTATTCCTCAGTATATGCCTGTTCTGCAAGTTGGTCTCAAGGCAGATTCTGCAGTTGTGAAATCTCTGGCTTGCAAAACTGTTCTGTGTCTCTTGGAGGATTGCGATACAAACGACGTTTCTTCTGTTCAGCTAGTTGTTAACAATGGCATATACCCTCTTCTACTTGACTATATCATTAACAGCGATGATGAAGTTGCAAATGCTGCAAGTGAGACAATTAAGAGCCTAGCTCGCTTTCCAGATGCAATGTCCGTAATTTTCCCTTCTGAAACCAACGATCCTACACATCTTCGTAACCTTGCTGCAAGGTGTTCATCACTGGCACGAGTCCGGGTTTTGTCGTTGATAGTGAAGCTTTTTTCGATTTCTCGACTTGTAGCTTCAGAAGTTAAGAAATCGGGGCTTCTTGATTTACTGGAGGCAGAAATGAAGGGTACAAAAGACACTCTTGTGATCTTAAATGTTCTGGAACTCTACTATGAGTTAATGGAAGTGGAGCACAGTTCAGAGTTCGTGCCACAAACATCACTTATTCAGCTGTTGTGTTCTATCATCAGTGGTACATCGACGGGACCCTATGAAAAGTTAAGAGCAATGATGATAAGTGGCAGACTACTCTCAAAGGAAAATATCTACAAAGTCGTGGAAGAAGCTAGTGTGAAGGCGTTAATTTCAGCTATTGATGGGAGTCTGGAGTCAGTTGAGATGAATGATACTGATGCACAGGAAGCTGCCATTGATGCACTTGGTCAGATGGGATCAACAACGAAGGGAGCGGATCTTGTCCTTTCAACTTCACCTCCAGCTGCAAGACATGTTGTAGCTTCTGCCTTTGATCGTAATGCACATGGAAAACAGTTGGCTGCACTGCATGCACTGGCAAACATCGCAGGTGAAACACGACCTAAGAGCAACAGAATAGTTGATGGAAAAGCTGAAGAAAGCCTTAGATGTTTGATATACGACGCTGCAGCACAGAGCACAAAACTAACCCCATCCGGTTTATTCCTCTCAGTTCTTCAACAAAGCTCAGAGATTCGTCTTGCGGGTTATCGAACGTTAACAGCATTAGTGGCTCGGCCATGGTGCCTGGTGGAAATCTTGGCCAAAGAAGAGATAATAAACATAGTTACGGATGCAACCACTGAAACTGCAAAAATAGCAATGGAAGCAAGGTATAACTGCTGCAAAGCAATTCACGAAGCGTTCTTGTGTAGTAACTTTGTTGATGACCCTCGTCGTCTAAAAACCGGTGACAAGTTGCAAGAAGCTGTTCGAAGTGGACCATATATGTCGAAGAAGCACAGAGGCGCACGACCAGAAGTAATGACAGGCGAAGGATTTTAAAGACAACTAAAGAAAAAAAGTTAAAACTTCTTTGTTAACCAAAGTTTTTTATATCTTCTCTGGCTGTTCGATAAGTAAACTTTAGTTCTTTCTATAAACAACGAAGGCTAGGAGTAAACGTTTTGGCGGTTG

SEQ ID NO: 2427 - DNA, 1540 bp, Arabidopsis thaliana
  misc_feature (1)..(1540): Ceres cDNA ID no. 13603459
  misc_feature (1)..(1540): Also known as  Ceres CDNA ID no. 23827422
actttcttcttcgattagccacttttttttcttttgtaattttcctttcttttttttttcttttgaattttcgggaagcagcatttccactggagctgcaaaatcttcctatcaaaattatagatcgatccaagttttagattcgagaattattttctccaaattagatttatatatcaaaaggaatcgaaaatagacagcaatttttgttttgtcggatcgtattgaatcagctgtgaattttagcgccaatttaaccactgaatcgtttgattagaagctaagatttggtcttacgatcgatctaagtagggttcttcttcttaagtgtgtgttttgttaaaattagtaaagagagatggagaagaagaaagtcgcgactccgctagtgtgccatggccattcgagacctgttgtggatttgttctacagtccaatcactcctgatggtttcttcctcatcagcgcaagtaaagattctcaaccaatgttgagaaatggggaaactggagattggattggtacatttgaaggtcataaaggtgctgtgtggagttcttgtcttgataacaatgctttacgtgcagcttctgcatctgctgatttttcagcgaagctttgggatgctttgactggggatgtcttgcattcttttgagcacaagcatattgttcgagcatgcgccttctctcaggatacgaaatatctaatcacaggaggatttgagaaaattcttcgtgttttcgacttgaatcgcttggatgcacctcctacagaaattgataaatctcctggttctatcagaacactaacatggcttcacggtgatcaaacaatattaagttcttgcactgatattggtggtgtgaggttatgggatgtgaggagtggcaaaatagtgcaaactctagaaaccaagtctcctgtcaccagtgctgaagtgagtcaagatggacggtatataacaactgccgatgggtcaactgttaaattttgggatgcaaatcattttggactagtgaaaagttacgacatgccctgcaatatcgaatctgcatcgcttgagccaaaatctggcaacaaattcgttgctggtggagaagatatgtgggttcgactctttgatttccacaccggaaaggagattggatgcaacaagggacatcatggtccggttcactgtgtgagatttgcaccaacaggtgagtcttatgcttcagggtctgaagatggtacaatcagaatttggcaaactggaccggtgaatcctgaagagatcagcgagtcaaagccgaagcagagtgtggatgaggttgctcgtaagattgaaggctttcacattaacaaggaaggaaaaaccgcagagaaaccatctgatgcttaaaccaagaaaagaaccaagaaaaatggctgcttctctttgtcttcttactgtgtttttacttccagactgaatatacggaaattcaaaacaagtgtttgaaaaacagtcgttgtcaatcttcattcgagtcaagtttatggatgtggctgaaaattt

SEQ ID NO: 2428 - protein, 1540 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ACTTTCTTCTTCGATTAGCCACTTTTTTTTCTTTTGTAATTTTCCTTTCTTTTTTTTTTCTTTTGAATTTTCGGGAAGCAGCATTTCCACTGGAGCTGCAAAATCTTCCTATCAAAATTATAGATCGATCCAAGTTTTAGATTCGAGAATTATTTTCTCCAAATTAGATTTATATATCAAAAGGAATCGAAAATAGACAGCAATTTTTGTTTTGTCGGATCGTATTGAATCAGCTGTGAATTTTAGCGCCAATTTAACCACTGAATCGTTTGATTAGAAGCTAAGATTTGGTCTTACGATCGATCTAAGTAGGGTTCTTCTTCTTAAGTGTGTGTTTTGTTAAAATTAGTAAAGAGAGATGGAGAAGAAGAAAGTCGCGACTCCGCTAGTGTGCCATGGCCATTCGAGACCTGTTGTGGATTTGTTCTACAGTCCAATCACTCCTGATGGTTTCTTCCTCATCAGCGCAAGTAAAGATTCTCAACCAATGTTGAGAAATGGGGAAACTGGAGATTGGATTGGTACATTTGAAGGTCATAAAGGTGCTGTGTGGAGTTCTTGTCTTGATAACAATGCTTTACGTGCAGCTTCTGCATCTGCTGATTTTTCAGCGAAGCTTTGGGATGCTTTGACTGGGGATGTCTTGCATTCTTTTGAGCACAAGCATATTGTTCGAGCATGCGCCTTCTCTCAGGATACGAAATATCTAATCACAGGAGGATTTGAGAAAATTCTTCGTGTTTTCGACTTGAATCGCTTGGATGCACCTCCTACAGAAATTGATAAATCTCCTGGTTCTATCAGAACACTAACATGGCTTCACGGTGATCAAACAATATTAAGTTCTTGCACTGATATTGGTGGTGTGAGGTTATGGGATGTGAGGAGTGGCAAAATAGTGCAAACTCTAGAAACCAAGTCTCCTGTCACCAGTGCTGAAGTGAGTCAAGATGGACGGTATATAACAACTGCCGATGGGTCAACTGTTAAATTTTGGGATGCAAATCATTTTGGACTAGTGAAAAGTTACGACATGCCCTGCAATATCGAATCTGCATCGCTTGAGCCAAAATCTGGCAACAAATTCGTTGCTGGTGGAGAAGATATGTGGGTTCGACTCTTTGATTTCCACACCGGAAAGGAGATTGGATGCAACAAGGGACATCATGGTCCGGTTCACTGTGTGAGATTTGCACCAACAGGTGAGTCTTATGCTTCAGGGTCTGAAGATGGTACAATCAGAATTTGGCAAACTGGACCGGTGAATCCTGAAGAGATCAGCGAGTCAAAGCCGAAGCAGAGTGTGGATGAGGTTGCTCGTAAGATTGAAGGCTTTCACATTAACAAGGAAGGAAAAACCGCAGAGAAACCATCTGATGCTTAAACCAAGAAAAGAACCAAGAAAAATGGCTGCTTCTCTTTGTCTTCTTACTGTGTTTTTACTTCCAGACTGAATATACGGAAATTCAAAACAAGTGTTTGAAAAACAGTCGTTGTCAATCTTCATTCGAGTCAAGTTTATGGATGTGGCTGAAAATTT

SEQ ID NO: 2429 - DNA, 1363 bp, Arabidopsis thaliana
  misc_feature (1)..(1363): Ceres cDNA ID no. 13603478
  misc_feature (1)..(1363): Also known as  Ceres CDNA ID no. 23827422
aaattgttgtcttttaggttttgacagtagcaaagaaaagctgaatctagttagaaattgcttttgcagggtttttgaatagtttgtgtattgaagattgtctgaaatggaagcagctattactcagaggattcagtacccatcatgggttgattgtagaaaagttgagtgtaagccgcagcgtggttcattgcggtattctcagcaggttaaggtagatagaaggtttagaggtctttctttggctcgcttgcaacctgaaagaagaaatgatcaacgaagagcagtttctccagcggtttcctgttctgataacaattcctcagcgttgttggagactggaagtgtttatccatttgatgaagatattctcaagagaaaagcagaagaggttaaaccgtatttgaatggacgatctatgtaccttgtcggaatgatgggttctgggaaaacaactgtgggaaagttaatgtccaaagtgctcggttatacgttctttgactgcgacactttgattgaacaggcgatgaatggaacttctgttgcagagatatttgttcatcacggagagaatttttttagaggaaaggagaccgatgcgcttaagaagctctcttcgaggtatcaagttgttgtttccacaggtggaggtgcagttataagacccattaactggaagtatatgcataaaggaatcagcatttggctagatgtgcctctagaagcattagcccatagaatcgctgctgttggaactgattcacgaccactgctacacgatgaatcaggagatgcatactcagtggctttcaaacgtctctcggctatttgggacgagcgcggtgaagcatacacaaacgcaaatgccagagtctccttagaaaatattgcagcaaagcgtggctataaaaatgtctcagatctcacaccaactgaaattgctatcgaggccttcgagcaagttctgagctttctagagaaagaagaaactatggagatcccagacggcgacctctaatttcccagccttcttttctccgtctcttcatttatctgtttaatcaactaaacgaagcaatcactcatcaccaggccattgagcaagttcagagacaaagaagacctctagttactggttccgggtcattggagcttacacgagcctaattttgactggaactatggtttattgaaagaagattcaatacatgtatatataaaatatatacttttttttttgtttcagtatcatccttcttctcttttccttacaataagaattaagaaaaagtagccgtgtttgttaacatgggccaagaacaagcaaagtgatcattcaaatataaaagtagctttctcatgg

SEQ ID NO: 2430 - protein, 1363 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
AAATTGTTGTCTTTTAGGTTTTGACAGTAGCAAAGAAAAGCTGAATCTAGTTAGAAATTGCTTTTGCAGGGTTTTTGAATAGTTTGTGTATTGAAGATTGTCTGAAATGGAAGCAGCTATTACTCAGAGGATTCAGTACCCATCATGGGTTGATTGTAGAAAAGTTGAGTGTAAGCCGCAGCGTGGTTCATTGCGGTATTCTCAGCAGGTTAAGGTAGATAGAAGGTTTAGAGGTCTTTCTTTGGCTCGCTTGCAACCTGAAAGAAGAAATGATCAACGAAGAGCAGTTTCTCCAGCGGTTTCCTGTTCTGATAACAATTCCTCAGCGTTGTTGGAGACTGGAAGTGTTTATCCATTTGATGAAGATATTCTCAAGAGAAAAGCAGAAGAGGTTAAACCGTATTTGAATGGACGATCTATGTACCTTGTCGGAATGATGGGTTCTGGGAAAACAACTGTGGGAAAGTTAATGTCCAAAGTGCTCGGTTATACGTTCTTTGACTGCGACACTTTGATTGAACAGGCGATGAATGGAACTTCTGTTGCAGAGATATTTGTTCATCACGGAGAGAATTTTTTTAGAGGAAAGGAGACCGATGCGCTTAAGAAGCTCTCTTCGAGGTATCAAGTTGTTGTTTCCACAGGTGGAGGTGCAGTTATAAGACCCATTAACTGGAAGTATATGCATAAAGGAATCAGCATTTGGCTAGATGTGCCTCTAGAAGCATTAGCCCATAGAATCGCTGCTGTTGGAACTGATTCACGACCACTGCTACACGATGAATCAGGAGATGCATACTCAGTGGCTTTCAAACGTCTCTCGGCTATTTGGGACGAGCGCGGTGAAGCATACACAAACGCAAATGCCAGAGTCTCCTTAGAAAATATTGCAGCAAAGCGTGGCTATAAAAATGTCTCAGATCTCACACCAACTGAAATTGCTATCGAGGCCTTCGAGCAAGTTCTGAGCTTTCTAGAGAAAGAAGAAACTATGGAGATCCCAGACGGCGACCTCTAATTTCCCAGCCTTCTTTTCTCCGTCTCTTCATTTATCTGTTTAATCAACTAAACGAAGCAATCACTCATCACCAGGCCATTGAGCAAGTTCAGAGACAAAGAAGACCTCTAGTTACTGGTTCCGGGTCATTGGAGCTTACACGAGCCTAATTTTGACTGGAACTATGGTTTATTGAAAGAAGATTCAATACATGTATATATAAAATATATACTTTTTTTTTTGTTTCAGTATCATCCTTCTTCTCTTTTCCTTACAATAAGAATTAAGAAAAAGTAGCCGTGTTTGTTAACATGGGCCAAGAACAAGCAAAGTGATCATTCAAATATAAAAGTAGCTTTCTCATGG

SEQ ID NO: 2431 - DNA, 1537 bp, Arabidopsis thaliana
  misc_feature (1)..(1537): Ceres cDNA ID no. 13603535
  misc_feature (1)..(1537): Also known as  Ceres CDNA ID no. 23827422
atcatcaaagtgaaaatgacaaacttcaaagacaacgatggagatggaaccaaactccacgtggtaatgtttccatggttagcctttggtcacatggttccatacttggagctctctaaactcatagctcaaaagggtcacaaagtctctttcatttccactccacgtaacatcgaccgtctcctcccatggttaccggaaaatctctcctccgtcattaacttcgtcaagctatcacttcccgtcggcgacaacaaactcccggaagacggtgaagctaccacagacgtccctttcgaactcataccttacttaaaaatcgcttacgacgggttaaaagttccggtgacggagtttcttgaatcttcgaaacccgattgggttcttcaagatttcgcggggttttggcttcctccaatctctcgtcgtctcggaatcaaaaccggattctttagcgctttcaacggcgcgacgctcggtattcttaaaccgccggggttcgaagagtaccgtacttcgccggcggattttatgaagccgcctaagtgggttccgtttgaaacttcggtagctttcaagttatttgaatgcaggttcattttcaaaggatttatggcggaaaccaccgaagggaatgttcccgacatccaccgtgtcggcggcgtaattgacggctgtgacgtcatcttcgtacggagctgttacgagtatgaagcggagtggttaggacttacacaagaacttcaccggaaaccggttataccggtcggagttttgcctccaaaaccggacgaaaagtttgaagataccgacacgtggctgtctgttaaaaaatggttggactcacggaaaagtaagtccattgtctacgtagcttttggttcagaagctaaaccgagtcaaacggagctaaatgagatcgctctcggtttagagctttctggtttacctttcttttgggtgttaaagactcgtcgtggtccgtgggataccgaaccggtcgagcttccggaaggattcgaagagcgtacagcggatagagggatggtgtggagaggttgggttgagcaattgcgtacattgagccatgactcgatcggtttggttctgactcatcccggttggggaacgataattgaagctatccggtttgctaaaccgatggcaatgctggtttttgtgtatgaccaaggattgaatgcgagagtcattgaagagaagaaaattgggtatatgatccctcgagacgagacagaaggtttctttactaaagaaagtgttgcgaattcgctaagattggtaatggtggaagaagaaggaaaggtttatagagagaatgtgaaggagatgaaaggagtgtttggagatatggatagacaagatcgttatgtggattcattcttggaatatcttgttactaatcgttaactttgagtcttgatccaatggtcggttaattgagtgaagttgatcaagtgttgcaaggatgatcattgtataatgttatgatattttggaatggtcaagttttcttgag

SEQ ID NO: 2432 - protein, 1537 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATCATCAAAGTGAAAATGACAAACTTCAAAGACAACGATGGAGATGGAACCAAACTCCACGTGGTAATGTTTCCATGGTTAGCCTTTGGTCACATGGTTCCATACTTGGAGCTCTCTAAACTCATAGCTCAAAAGGGTCACAAAGTCTCTTTCATTTCCACTCCACGTAACATCGACCGTCTCCTCCCATGGTTACCGGAAAATCTCTCCTCCGTCATTAACTTCGTCAAGCTATCACTTCCCGTCGGCGACAACAAACTCCCGGAAGACGGTGAAGCTACCACAGACGTCCCTTTCGAACTCATACCTTACTTAAAAATCGCTTACGACGGGTTAAAAGTTCCGGTGACGGAGTTTCTTGAATCTTCGAAACCCGATTGGGTTCTTCAAGATTTCGCGGGGTTTTGGCTTCCTCCAATCTCTCGTCGTCTCGGAATCAAAACCGGATTCTTTAGCGCTTTCAACGGCGCGACGCTCGGTATTCTTAAACCGCCGGGGTTCGAAGAGTACCGTACTTCGCCGGCGGATTTTATGAAGCCGCCTAAGTGGGTTCCGTTTGAAACTTCGGTAGCTTTCAAGTTATTTGAATGCAGGTTCATTTTCAAAGGATTTATGGCGGAAACCACCGAAGGGAATGTTCCCGACATCCACCGTGTCGGCGGCGTAATTGACGGCTGTGACGTCATCTTCGTACGGAGCTGTTACGAGTATGAAGCGGAGTGGTTAGGACTTACACAAGAACTTCACCGGAAACCGGTTATACCGGTCGGAGTTTTGCCTCCAAAACCGGACGAAAAGTTTGAAGATACCGACACGTGGCTGTCTGTTAAAAAATGGTTGGACTCACGGAAAAGTAAGTCCATTGTCTACGTAGCTTTTGGTTCAGAAGCTAAACCGAGTCAAACGGAGCTAAATGAGATCGCTCTCGGTTTAGAGCTTTCTGGTTTACCTTTCTTTTGGGTGTTAAAGACTCGTCGTGGTCCGTGGGATACCGAACCGGTCGAGCTTCCGGAAGGATTCGAAGAGCGTACAGCGGATAGAGGGATGGTGTGGAGAGGTTGGGTTGAGCAATTGCGTACATTGAGCCATGACTCGATCGGTTTGGTTCTGACTCATCCCGGTTGGGGAACGATAATTGAAGCTATCCGGTTTGCTAAACCGATGGCAATGCTGGTTTTTGTGTATGACCAAGGATTGAATGCGAGAGTCATTGAAGAGAAGAAAATTGGGTATATGATCCCTCGAGACGAGACAGAAGGTTTCTTTACTAAAGAAAGTGTTGCGAATTCGCTAAGATTGGTAATGGTGGAAGAAGAAGGAAAGGTTTATAGAGAGAATGTGAAGGAGATGAAAGGAGTGTTTGGAGATATGGATAGACAAGATCGTTATGTGGATTCATTCTTGGAATATCTTGTTACTAATCGTTAACTTTGAGTCTTGATCCAATGGTCGGTTAATTGAGTGAAGTTGATCAAGTGTTGCAAGGATGATCATTGTATAATGTTATGATATTTTGGAATGGTCAAGTTTTCTTGAG

SEQ ID NO: 2433 - DNA, 983 bp, Arabidopsis thaliana
  misc_feature (1)..(983): Ceres cDNA ID no. 13603693
  misc_feature (1)..(983): Also known as  Ceres CDNA ID no. 23827422
aggaagataagaaaatggaggagaagaaatctgaagagccacaagcgaaatcagaagataagaaaccagaagaagagaaaaagaaagaacctcaagagattgtgcttaagatttttatgcattgtgaaggttgtgctaaaaaaatccatagatgtcttaaaggctttgaaggagtggaggatgtaactactgattgtaagactagtaaagttgtggtgaaaggagagaaggcagatccattaaaagtgttgcaaagattgcagaggaagagccatcgtcaagtggagcttatctcaccgattccggagcctaaaccggtttctgatgaaccggagaaaaaggagaaggagaaacctaaacctgaggagaaaaaagaagaggtagtgacagtggtgctgagagttcacatgcattgtgaagcatgtgccatggagattcaaaagaggatcatgagaatgaaaggagtggagtctgtggaaccagattttaaagcatcacaagtgagcgtgaaaggagtttttacgccggaaaagctagttgagttcatttacaagagaatcgggaagcatgccgcggttgtcaagcaagatccgccgccaaaacctccggagaaagaaaaagaaacgaaagacaaagacgagaagaaaaaggaagagggacagcccaaagaaggaaaagaggccaaggaaaacggtggtggaggaggtgctaaaggcgatggtgctgccgcggaggaggggaacaaagtggtagacttgaagaagaacgaatatcagtaccagccaccgaggtaccccgtggagatgtttgcttatccaccgcagatattcagtgatgaaaaccccaatgcttgtaccattatataataaaatcgtcggtttaaggggttgtaggatttgttatttttttactttatttctatgcagaattttaatttaaatgtatttttggtaatttttagtttcaaccgaattgaatgatcg

SEQ ID NO: 2434 - protein, 983 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
AGGAAGATAAGAAAATGGAGGAGAAGAAATCTGAAGAGCCACAAGCGAAATCAGAAGATAAGAAACCAGAAGAAGAGAAAAAGAAAGAACCTCAAGAGATTGTGCTTAAGATTTTTATGCATTGTGAAGGTTGTGCTAAAAAAATCCATAGATGTCTTAAAGGCTTTGAAGGAGTGGAGGATGTAACTACTGATTGTAAGACTAGTAAAGTTGTGGTGAAAGGAGAGAAGGCAGATCCATTAAAAGTGTTGCAAAGATTGCAGAGGAAGAGCCATCGTCAAGTGGAGCTTATCTCACCGATTCCGGAGCCTAAACCGGTTTCTGATGAACCGGAGAAAAAGGAGAAGGAGAAACCTAAACCTGAGGAGAAAAAAGAAGAGGTAGTGACAGTGGTGCTGAGAGTTCACATGCATTGTGAAGCATGTGCCATGGAGATTCAAAAGAGGATCATGAGAATGAAAGGAGTGGAGTCTGTGGAACCAGATTTTAAAGCATCACAAGTGAGCGTGAAAGGAGTTTTTACGCCGGAAAAGCTAGTTGAGTTCATTTACAAGAGAATCGGGAAGCATGCCGCGGTTGTCAAGCAAGATCCGCCGCCAAAACCTCCGGAGAAAGAAAAAGAAACGAAAGACAAAGACGAGAAGAAAAAGGAAGAGGGACAGCCCAAAGAAGGAAAAGAGGCCAAGGAAAACGGTGGTGGAGGAGGTGCTAAAGGCGATGGTGCTGCCGCGGAGGAGGGGAACAAAGTGGTAGACTTGAAGAAGAACGAATATCAGTACCAGCCACCGAGGTACCCCGTGGAGATGTTTGCTTATCCACCGCAGATATTCAGTGATGAAAACCCCAATGCTTGTACCATTATATAATAAAATCGTCGGTTTAAGGGGTTGTAGGATTTGTTATTTTTTTACTTTATTTCTATGCAGAATTTTAATTTAAATGTATTTTTGGTAATTTTTAGTTTCAACCGAATTGAATGATCG

SEQ ID NO: 2435 - DNA, 1528 bp, Arabidopsis thaliana
  misc_feature (1)..(1528): Ceres cDNA ID no. 13603916
  misc_feature (1)..(1528): Also known as  Ceres CDNA ID no. 23827422
acccatggatttttaacgaacaagagaagagaagaaccaagttttcttcgaaaggattgaactttgtttctttctcttcagctacaacaaccaaaaaatgatcaagctttgcttcatgacttctcatggttattcaatccctggccttggtcttcctcaagacctctgcaacaccgaaatcatcaagaatagccggtctcatctggtgaatcccggagcaagacaagagatcatacctgcaagctccttcaatctgaatacagaactcttggaaccatggaaaccggtttcttcatttagccaattcgtggagattgattcagccatgatgaaacctctgctcatggatgttcatgagacggcaccagaatctctgattttgagctttggaatcgctgataagtttgcaagacaagaaaaggtgatggagtttcttctgtctcagtcagaggagttcaaggaaaaaggattcgatatgtcgctgttaaatgaattgatggagtttgagtctatgaaatccagttctcagctacgaccgtatgatacttcctctgttctttacttgaatcaagaattagggaaaccggttttggatctcgttagggatatgatggagaatccagagttctctgtgcgatcgaatggtcatgttctgttctcttcaagtagcaatcctgagttgaatgatctactttctattgcttccgagttcaatttgtcaaggaattcaacaacaaaatggagacagctctcaccgcttatcccacactttcagaggtttgaaagtgacgtatttacaccggctaagctgaaagcagttacagtgctagcacctttgaagagtcctgagaaaagcaggctcaagtcaccaaggaaacacaacacgaagcgaaaagctaaagagagggacctatacaaaagaaatcatctccacgcttacgagagccttctctctttaatgataggcaatgatcatcgacacaaacacacaacagtactctctttacagaaatcatgtggagagctctcagagcttctgactcagttctctatcactgctgctggaactggaatcgctgtgctcttttctgtcgtatgtagccttgcttcaaggcgtgtacccttttgcgcaaataagttcttcgacactgggcttggtttgagtttggtaatactgtcatgggctgtgaatagactcagggaggtgattgttcatgtcaataggaaagcgaacaagccatgttcaagtttgaaagatgacgaaatcataaacagtgtggagagaagtatgaaggaggtttactacagagctgcaacggtaatcgcggtgtttgcgcttaggtttgcatgttgaaaaatcggggtgagaggtaaaaatcttgatttactactccatggaaagcttctaaaaggtcgtttgtaaatgactaaaacttgtttagtagctgtaaatgtgaaagatgatattatgtggtagaacctaagattaagaggtgaagaattttgaagagaataaatgttttgcaag

SEQ ID NO: 2436 - protein, 1528 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ACCCATGGATTTTTAACGAACAAGAGAAGAGAAGAACCAAGTTTTCTTCGAAAGGATTGAACTTTGTTTCTTTCTCTTCAGCTACAACAACCAAAAAATGATCAAGCTTTGCTTCATGACTTCTCATGGTTATTCAATCCCTGGCCTTGGTCTTCCTCAAGACCTCTGCAACACCGAAATCATCAAGAATAGCCGGTCTCATCTGGTGAATCCCGGAGCAAGACAAGAGATCATACCTGCAAGCTCCTTCAATCTGAATACAGAACTCTTGGAACCATGGAAACCGGTTTCTTCATTTAGCCAATTCGTGGAGATTGATTCAGCCATGATGAAACCTCTGCTCATGGATGTTCATGAGACGGCACCAGAATCTCTGATTTTGAGCTTTGGAATCGCTGATAAGTTTGCAAGACAAGAAAAGGTGATGGAGTTTCTTCTGTCTCAGTCAGAGGAGTTCAAGGAAAAAGGATTCGATATGTCGCTGTTAAATGAATTGATGGAGTTTGAGTCTATGAAATCCAGTTCTCAGCTACGACCGTATGATACTTCCTCTGTTCTTTACTTGAATCAAGAATTAGGGAAACCGGTTTTGGATCTCGTTAGGGATATGATGGAGAATCCAGAGTTCTCTGTGCGATCGAATGGTCATGTTCTGTTCTCTTCAAGTAGCAATCCTGAGTTGAATGATCTACTTTCTATTGCTTCCGAGTTCAATTTGTCAAGGAATTCAACAACAAAATGGAGACAGCTCTCACCGCTTATCCCACACTTTCAGAGGTTTGAAAGTGACGTATTTACACCGGCTAAGCTGAAAGCAGTTACAGTGCTAGCACCTTTGAAGAGTCCTGAGAAAAGCAGGCTCAAGTCACCAAGGAAACACAACACGAAGCGAAAAGCTAAAGAGAGGGACCTATACAAAAGAAATCATCTCCACGCTTACGAGAGCCTTCTCTCTTTAATGATAGGCAATGATCATCGACACAAACACACAACAGTACTCTCTTTACAGAAATCATGTGGAGAGCTCTCAGAGCTTCTGACTCAGTTCTCTATCACTGCTGCTGGAACTGGAATCGCTGTGCTCTTTTCTGTCGTATGTAGCCTTGCTTCAAGGCGTGTACCCTTTTGCGCAAATAAGTTCTTCGACACTGGGCTTGGTTTGAGTTTGGTAATACTGTCATGGGCTGTGAATAGACTCAGGGAGGTGATTGTTCATGTCAATAGGAAAGCGAACAAGCCATGTTCAAGTTTGAAAGATGACGAAATCATAAACAGTGTGGAGAGAAGTATGAAGGAGGTTTACTACAGAGCTGCAACGGTAATCGCGGTGTTTGCGCTTAGGTTTGCATGTTGAAAAATCGGGGTGAGAGGTAAAAATCTTGATTTACTACTCCATGGAAAGCTTCTAAAAGGTCGTTTGTAAATGACTAAAACTTGTTTAGTAGCTGTAAATGTGAAAGATGATATTATGTGGTAGAACCTAAGATTAAGAGGTGAAGAATTTTGAAGAGAATAAATGTTTTGCAAG

SEQ ID NO: 2437 - DNA, 772 bp, Arabidopsis thaliana
  misc_feature (1)..(772): Ceres cDNA ID no. 13603962
  misc_feature (1)..(772): Also known as  Ceres CDNA ID no. 23827422
ggatagagaagataatgagctccttggggttttcagttggaacttgttctcctccaagtgagaaaagaaaatgcagatttcttgtgaataatagcttaaacaaagcagaggctattaacttgagaaacaagcaaaaagtttcttctgatcctgagttaagttttgcccaattatcctcatgtggtagaagagaagcaattattggttttggtttctctattggcttgcttgataatgtttctgcattagccgaaacaacttcttgtgaattctctgtgtctccttctggtcttgctttttgtgataaagttgttggttatggtcctgaagctgttaaagggcaactaatcaaggcacattatgtagggaagttggagaatgggaaagtctttgatagtagctataatcgagggaaacctcttactttccgaattggtgttggtgaggtgataaaaggttgggatcaaggaatccttggctctgatggaattcctcctatgcttactggtgggaaacgaacattgaggattcctccagaactcgcgtatggtgatcgaggcgcaggttgcaaaggaggctcatgccttattcctccagcttcggttcttctctttgacattgagtacataggtaaagcttgagagagcttttttgcttttgctttgccttttctgagccatatcatactcttgtttgaatcatccttatagaagaaaaaaatatgtctattattttttctactatgtaatcaagtgaatatctcagctttttc

SEQ ID NO: 2438 - protein, 772 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
GGATAGAGAAGATAATGAGCTCCTTGGGGTTTTCAGTTGGAACTTGTTCTCCTCCAAGTGAGAAAAGAAAATGCAGATTTCTTGTGAATAATAGCTTAAACAAAGCAGAGGCTATTAACTTGAGAAACAAGCAAAAAGTTTCTTCTGATCCTGAGTTAAGTTTTGCCCAATTATCCTCATGTGGTAGAAGAGAAGCAATTATTGGTTTTGGTTTCTCTATTGGCTTGCTTGATAATGTTTCTGCATTAGCCGAAACAACTTCTTGTGAATTCTCTGTGTCTCCTTCTGGTCTTGCTTTTTGTGATAAAGTTGTTGGTTATGGTCCTGAAGCTGTTAAAGGGCAACTAATCAAGGCACATTATGTAGGGAAGTTGGAGAATGGGAAAGTCTTTGATAGTAGCTATAATCGAGGGAAACCTCTTACTTTCCGAATTGGTGTTGGTGAGGTGATAAAAGGTTGGGATCAAGGAATCCTTGGCTCTGATGGAATTCCTCCTATGCTTACTGGTGGGAAACGAACATTGAGGATTCCTCCAGAACTCGCGTATGGTGATCGAGGCGCAGGTTGCAAAGGAGGCTCATGCCTTATTCCTCCAGCTTCGGTTCTTCTCTTTGACATTGAGTACATAGGTAAAGCTTGAGAGAGCTTTTTTGCTTTTGCTTTGCCTTTTCTGAGCCATATCATACTCTTGTTTGAATCATCCTTATAGAAGAAAAAAATATGTCTATTATTTTTTCTACTATGTAATCAAGTGAATATCTCAGCTTTTTC

SEQ ID NO: 2439 - DNA, 1701 bp, Arabidopsis thaliana
  misc_feature (1)..(1701): Ceres cDNA ID no. 13604264
  misc_feature (1)..(1701): Also known as  Ceres CDNA ID no. 23827422
aagacacgaaaaagaattttaccgactggaagaagaaaaaacatcaaccagacaaaagaaaagaaaacaaaaacacatcttcgagatcaaacaaaccctaattatcatccatcgtcgccttctcaatatatatggccggaagagcagcgatgctcgttaacgtcgggacggttataatgaccgttttgaccctggctagtttggtcggaggcttcggtgtgaattggggcaatatcgcatcacatccgttgaatcccaacattgttgttcagatgcttaaggacaataagatcaataaagtgaagctttttgacgctgattcatggacgatgaatgctttggctggtacgggcatggaggttatggttggaatccctaataaccttcttgagtctctcgcagatgattacgataatgctaaagattgggttaaagaaaacgtgacccagtatattcgtaagggtggcgtcgacatcaagtacgtagccgtggggaacgagccgtttttgtctgcatacaacggatcgttcttgaagacaacatttccagcgttaaagaacattcacaaggcgttaaaagaagctggacacaccaatataatgaaagccacgatcccacaaaacgcagaagtttaccaatcagccaacgacaagccatcagaaggtgatttccgcaaggatgtcaaacaaacgatgcttgatatcgtcaatttcttccacgaaaacgacttacctttcaccgtcaacatttaccctttccttagtctttacctaaacgagcattttcccgttgagttcgcttttcttgacggtgatggtcagacaatgactgacaaaggaaagaattatgataacgtgtttgacgccaattacgacacacttgtttacgcgttgaagaaggctgggattcacgatatgaagattatcgttggagaggttggatggccaacggatggtcacaaatatgcatcgccgaagctagcggagaaattctatgcagggcttatgaaaagacttgctaaggacggtgggactccaacgaggcctgaaagattagaggtctatctcttcggtttcctcgacgaagacatgaagagtattcttccagggccttttgagagacattggggaatctttagatacgatgggacaccaaagtttatgctagatttcacgggacaaggacgccaaatggtgcccgttgcagctaaaggtgtgcagtacttggaaaaacaatggtgcgtagtgaacaaagacacggtcaatctagacgaagttggtcctgatctagactatgcgtgttaccacggggactgcaccgcgatggaagccgggtcaacttgtagtaagctaaccaaagtccaaaacatatcatacgcatttaacatgtatttccagatacaagaccaagacgttagggcttgcgatttcaaaggagctgcaatgatcaccaaggtcaatgcatccgtgggaagttgcttgttccctgttcagatcgttagtggaagtgatgatttcaggatcaactttgtgttcggaagattcgtcgtctttggacttgttcttcttggattgctcacggttatataatttgtttttttgttgttgtttggttttctttttgcaatttggagggatttattcgacacgattaattgttatttgttattcgttttaaaaatgtttacttttgagttagttc

SEQ ID NO: 2440 - protein, 1701 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
AAGACACGAAAAAGAATTTTACCGACTGGAAGAAGAAAAAACATCAACCAGACAAAAGAAAAGAAAACAAAAACACATCTTCGAGATCAAACAAACCCTAATTATCATCCATCGTCGCCTTCTCAATATATATGGCCGGAAGAGCAGCGATGCTCGTTAACGTCGGGACGGTTATAATGACCGTTTTGACCCTGGCTAGTTTGGTCGGAGGCTTCGGTGTGAATTGGGGCAATATCGCATCACATCCGTTGAATCCCAACATTGTTGTTCAGATGCTTAAGGACAATAAGATCAATAAAGTGAAGCTTTTTGACGCTGATTCATGGACGATGAATGCTTTGGCTGGTACGGGCATGGAGGTTATGGTTGGAATCCCTAATAACCTTCTTGAGTCTCTCGCAGATGATTACGATAATGCTAAAGATTGGGTTAAAGAAAACGTGACCCAGTATATTCGTAAGGGTGGCGTCGACATCAAGTACGTAGCCGTGGGGAACGAGCCGTTTTTGTCTGCATACAACGGATCGTTCTTGAAGACAACATTTCCAGCGTTAAAGAACATTCACAAGGCGTTAAAAGAAGCTGGACACACCAATATAATGAAAGCCACGATCCCACAAAACGCAGAAGTTTACCAATCAGCCAACGACAAGCCATCAGAAGGTGATTTCCGCAAGGATGTCAAACAAACGATGCTTGATATCGTCAATTTCTTCCACGAAAACGACTTACCTTTCACCGTCAACATTTACCCTTTCCTTAGTCTTTACCTAAACGAGCATTTTCCCGTTGAGTTCGCTTTTCTTGACGGTGATGGTCAGACAATGACTGACAAAGGAAAGAATTATGATAACGTGTTTGACGCCAATTACGACACACTTGTTTACGCGTTGAAGAAGGCTGGGATTCACGATATGAAGATTATCGTTGGAGAGGTTGGATGGCCAACGGATGGTCACAAATATGCATCGCCGAAGCTAGCGGAGAAATTCTATGCAGGGCTTATGAAAAGACTTGCTAAGGACGGTGGGACTCCAACGAGGCCTGAAAGATTAGAGGTCTATCTCTTCGGTTTCCTCGACGAAGACATGAAGAGTATTCTTCCAGGGCCTTTTGAGAGACATTGGGGAATCTTTAGATACGATGGGACACCAAAGTTTATGCTAGATTTCACGGGACAAGGACGCCAAATGGTGCCCGTTGCAGCTAAAGGTGTGCAGTACTTGGAAAAACAATGGTGCGTAGTGAACAAAGACACGGTCAATCTAGACGAAGTTGGTCCTGATCTAGACTATGCGTGTTACCACGGGGACTGCACCGCGATGGAAGCCGGGTCAACTTGTAGTAAGCTAACCAAAGTCCAAAACATATCATACGCATTTAACATGTATTTCCAGATACAAGACCAAGACGTTAGGGCTTGCGATTTCAAAGGAGCTGCAATGATCACCAAGGTCAATGCATCCGTGGGAAGTTGCTTGTTCCCTGTTCAGATCGTTAGTGGAAGTGATGATTTCAGGATCAACTTTGTGTTCGGAAGATTCGTCGTCTTTGGACTTGTTCTTCTTGGATTGCTCACGGTTATATAATTTGTTTTTTTGTTGTTGTTTGGTTTTCTTTTTGCAATTTGGAGGGATTTATTCGACACGATTAATTGTTATTTGTTATTCGTTTTAAAAATGTTTACTTTTGAGTTAGTTC

SEQ ID NO: 2441 - DNA, 1944 bp, Arabidopsis thaliana
  misc_feature (1)..(1944): Ceres cDNA ID no. 13604501
  misc_feature (1)..(1944): Also known as  Ceres CDNA ID no. 23827422
gaacaaaatttaaagccatcgattgccttgtcttgtctctttgcctgttaattatttgtctgaatcttcctctcctgatgatcactccaagtaacttcaaagaaacgctcagattcgacagttctatatatcaacaaacatcatctcaagctcttacctgatatctctgttttgatggatcaaagtcgggttttgcggtttataggccaagtggaaacctgtagagttgttcttctcatggttctggttgttgccttcgtttcaggccttcagtattttgagctctctccagtactactatctattgtttcacctggaaacagcactatttctgaattcagaaaatccaatgatacgactaaaagtgctgaaaatgaaacgtttcttgcatctcaagaagcatccaccgggcttaaaccgtataacagaactacagaggtattgaagagttctgagcacaagtttctgaatgattctcacaaaatagaagcttctggacaacgtagaagaagcaatgaaactgcaagttctctgcatcctcttcaaccaaagattcctcaaatccgcaagaaatatccccataggagcataacaaagccaccatcaattgtcatatcaataaagcagatgaacaatatgatattgaagcggcataatgatccaaaaaattcacttgcacctctctggggatcaaaagtggaccaagagcttaaaactgcaagagacaagatcaagaaagcggctttggtcaagaaagatgatactctttacgcacctctctaccacaacatatccatcttcaaaaggagctatgagctaatggaacaaactctgaaagtgtatgtctactcggaaggggatagaccaattttccatcagcctgaggcaataatggaagggatttacgcatcagaaggatggtttatgaaactaatggagagtagccatagattcttgacaaaagatcccaccaaagctcatttattctacatacctttcagttcaagaattcttcaacagaaactttacgttcatgactctcacagtcgtaataatcttgttaaatatcttggaaactacattgatctcatcgcttccaactacccttcctggaatagaacttgtggctccgatcatttcttcaccgcttgccatgactgggctccaaccgagactaggggaccgtacataaactgcatcagagcactctgtaacgccgatgttggcatagactttgtggtcggaaaagatgtttctttgccggaaactaaagtctcttctttgcaaaatccaaacggaaaaattggaggtagccgcccttccaagcgaaccatcctcgcttttttcgccgggagcttgcacggttacgttagacccatcttgcttaaccaatggtcatcgagacctgaacaagatatgaagatctttaatcgtatcgatcataaatcatacatccgttacatgaaacgcagcagattctgcgtttgcgctaaaggttacgaggttaatagccctagagtggttgagtcgattttgtacggttgtgttccggtgattatctctgataactttgtgccaccgtttcttgagattctgaattgggaatctttcgcagtgtttgtgccggagaaagagatcccgaatctaaggaagattctgatatcgattccggtgaggagatacgtggagatgcaaaagagggttttgaaggttcaaaaacatttcatgtggcatgatggtgaaccggttcggtatgatatatttcatatgattcttcattcggtttggtataaccgagtttttcaaacgttttagccagattaatcaggtttgacaagggttttggtttggcctttgctacttgccaataattaactacgtctccggaagattgtattttgtagattactgattcatattagccaattggacttgattacaaat

SEQ ID NO: 2442 - protein, 1944 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
GAACAAAATTTAAAGCCATCGATTGCCTTGTCTTGTCTCTTTGCCTGTTAATTATTTGTCTGAATCTTCCTCTCCTGATGATCACTCCAAGTAACTTCAAAGAAACGCTCAGATTCGACAGTTCTATATATCAACAAACATCATCTCAAGCTCTTACCTGATATCTCTGTTTTGATGGATCAAAGTCGGGTTTTGCGGTTTATAGGCCAAGTGGAAACCTGTAGAGTTGTTCTTCTCATGGTTCTGGTTGTTGCCTTCGTTTCAGGCCTTCAGTATTTTGAGCTCTCTCCAGTACTACTATCTATTGTTTCACCTGGAAACAGCACTATTTCTGAATTCAGAAAATCCAATGATACGACTAAAAGTGCTGAAAATGAAACGTTTCTTGCATCTCAAGAAGCATCCACCGGGCTTAAACCGTATAACAGAACTACAGAGGTATTGAAGAGTTCTGAGCACAAGTTTCTGAATGATTCTCACAAAATAGAAGCTTCTGGACAACGTAGAAGAAGCAATGAAACTGCAAGTTCTCTGCATCCTCTTCAACCAAAGATTCCTCAAATCCGCAAGAAATATCCCCATAGGAGCATAACAAAGCCACCATCAATTGTCATATCAATAAAGCAGATGAACAATATGATATTGAAGCGGCATAATGATCCAAAAAATTCACTTGCACCTCTCTGGGGATCAAAAGTGGACCAAGAGCTTAAAACTGCAAGAGACAAGATCAAGAAAGCGGCTTTGGTCAAGAAAGATGATACTCTTTACGCACCTCTCTACCACAACATATCCATCTTCAAAAGGAGCTATGAGCTAATGGAACAAACTCTGAAAGTGTATGTCTACTCGGAAGGGGATAGACCAATTTTCCATCAGCCTGAGGCAATAATGGAAGGGATTTACGCATCAGAAGGATGGTTTATGAAACTAATGGAGAGTAGCCATAGATTCTTGACAAAAGATCCCACCAAAGCTCATTTATTCTACATACCTTTCAGTTCAAGAATTCTTCAACAGAAACTTTACGTTCATGACTCTCACAGTCGTAATAATCTTGTTAAATATCTTGGAAACTACATTGATCTCATCGCTTCCAACTACCCTTCCTGGAATAGAACTTGTGGCTCCGATCATTTCTTCACCGCTTGCCATGACTGGGCTCCAACCGAGACTAGGGGACCGTACATAAACTGCATCAGAGCACTCTGTAACGCCGATGTTGGCATAGACTTTGTGGTCGGAAAAGATGTTTCTTTGCCGGAAACTAAAGTCTCTTCTTTGCAAAATCCAAACGGAAAAATTGGAGGTAGCCGCCCTTCCAAGCGAACCATCCTCGCTTTTTTCGCCGGGAGCTTGCACGGTTACGTTAGACCCATCTTGCTTAACCAATGGTCATCGAGACCTGAACAAGATATGAAGATCTTTAATCGTATCGATCATAAATCATACATCCGTTACATGAAACGCAGCAGATTCTGCGTTTGCGCTAAAGGTTACGAGGTTAATAGCCCTAGAGTGGTTGAGTCGATTTTGTACGGTTGTGTTCCGGTGATTATCTCTGATAACTTTGTGCCACCGTTTCTTGAGATTCTGAATTGGGAATCTTTCGCAGTGTTTGTGCCGGAGAAAGAGATCCCGAATCTAAGGAAGATTCTGATATCGATTCCGGTGAGGAGATACGTGGAGATGCAAAAGAGGGTTTTGAAGGTTCAAAAACATTTCATGTGGCATGATGGTGAACCGGTTCGGTATGATATATTTCATATGATTCTTCATTCGGTTTGGTATAACCGAGTTTTTCAAACGTTTTAGCCAGATTAATCAGGTTTGACAAGGGTTTTGGTTTGGCCTTTGCTACTTGCCAATAATTAACTACGTCTCCGGAAGATTGTATTTTGTAGATTACTGATTCATATTAGCCAATTGGACTTGATTACAAAT

SEQ ID NO: 2443 - DNA, 2314 bp, Arabidopsis thaliana
  misc_feature (1)..(2314): Ceres cDNA ID no. 13604521
  misc_feature (1)..(2314): Also known as  Ceres CDNA ID no. 23827422
atcttcttcctctacactgacacatttcgtcgaacacctttcgctaatgtcagtgagcaagtttccacatctctctcatggcgttcacactatcaatttcctcaatgaaccagtgtttttaagtgtgttgctcccatctccctctcggattcgagtattctcgtccatttccacctccgggatcggcggcggggtcgccaagtgccatggaacgagacatagcggcgccggtggtagaggtgataacgggttgaggagagatagtggattaggtttcgacgagagaggagagagaaaagtgcgttgtgaggttgatgtgatctcgtggagagaacggaggataagaggcgaaatctgggtcgattctgattctcaatctgtttggaatgttcttactgattatgaacgacttgctgatttcatacccaatctcgtttggagtggaagaattccttgtccacatccaggacgtatatggctggagcaacgaggccttcaaagagccttgtattggcatattgaggctcgtgttgtccttgatctccatgagtgtctagattctccaaatggtcgtgagcttcacttctctatggtagatggtgatttcaaaaagtttgagggaaagtggtctgtgaaatctggtatcaggtccgtaggaactgtcttgtcatacgaagtaaacgtaatcccaagatttaacttccctgccattttcttagagaggataatcagatcagatcttcctgtaaatctccgggccgtagctcgccaagctgagaaaatttataaagattgcggaaagccgtcaataatagaagatttgttgggtataatatcttcacagccagccccttctaatggtattgagttcgatagtcttgctacggagagatctgttgcctccagtgttggatcattagctcattcaaatgaattgaacaacaattggggagtgtatggaaaagcctgcaagcttgataaaccttgcaccgtggatgaagttcatcttcgtagatttgatggtctattggaaaatggaggtgttcaccgatgcgccgttgctagtataacagttaaagctcctgtttgtgaagtttggaaagttctaacgtcttatgagagtcttccagagatagttccaaatttggcaatcagcaagattttgtcacgcgataacaataaagtccgaatacttcaggaaggatgcaaaggcctgctttacatggtgcttcatgcaagagctgttctcgatttgcatgagattcgtgagcaggaaatcagatttgaacaggttgaaggagactttgactcgctagaggggaaatggatttttgaacaactaggaagtcaccacacacttctcaagtataccgtggagtccaaaatgagaaaagattcatttctttctgaagcaatcatggaagaggttatatatgaagatcttccgtcaaatttatgcgctatccgggattacattgagaaaagaggagagaaatcttcagagtcatgtaaactggagacatgtcaagtttcagaggaaacatgttcttcatctcgtgccaaatcagttgagacagtttacaataatgatgatggttcagaccaaactaagcagagacggaggattcctggtctacaaagagacattgaagtcttgaaatcagaaattctcaagttcatatcagaacatggacaagaaggattcatgcccatgaggaagcagcttcggttacatggaagagttgacattgaaaaagccattacaagaatgggtggatttaggagaatagctttgatgatgaatctttcacttgcttataaacaccgaaaaccgaaaggatattgggacaatctcgaaaacttgcaagaggagataggaagatttcaacagagttggggaatggatccatcatttatgccgagcagaaaatctttcgaacgagcaggtcgttatgacattgctcgggcgctcgagaaatggggaggattacacgaagtatctcgtcttttagcattgaacgtgagacatccaaacaggcagctaaattctcgtaaagacaacggtaacacgatactgagaactgaatctactgaggccgatttaaattcaacggttaataagaataataaaccttacgtctctcaagataccgagaaatggttgtacaatcttaaagatcttgatatcaattgggttcaatattgaagcattaattatgtacatttcactatttgtgtagtcttgtaactcgcaaagataaacatgtatttatgtaaattgtaacattggattgaaattatctgatctcttttt

SEQ ID NO: 2444 - protein, 2314 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATCTTCTTCCTCTACACTGACACATTTCGTCGAACACCTTTCGCTAATGTCAGTGAGCAAGTTTCCACATCTCTCTCATGGCGTTCACACTATCAATTTCCTCAATGAACCAGTGTTTTTAAGTGTGTTGCTCCCATCTCCCTCTCGGATTCGAGTATTCTCGTCCATTTCCACCTCCGGGATCGGCGGCGGGGTCGCCAAGTGCCATGGAACGAGACATAGCGGCGCCGGTGGTAGAGGTGATAACGGGTTGAGGAGAGATAGTGGATTAGGTTTCGACGAGAGAGGAGAGAGAAAAGTGCGTTGTGAGGTTGATGTGATCTCGTGGAGAGAACGGAGGATAAGAGGCGAAATCTGGGTCGATTCTGATTCTCAATCTGTTTGGAATGTTCTTACTGATTATGAACGACTTGCTGATTTCATACCCAATCTCGTTTGGAGTGGAAGAATTCCTTGTCCACATCCAGGACGTATATGGCTGGAGCAACGAGGCCTTCAAAGAGCCTTGTATTGGCATATTGAGGCTCGTGTTGTCCTTGATCTCCATGAGTGTCTAGATTCTCCAAATGGTCGTGAGCTTCACTTCTCTATGGTAGATGGTGATTTCAAAAAGTTTGAGGGAAAGTGGTCTGTGAAATCTGGTATCAGGTCCGTAGGAACTGTCTTGTCATACGAAGTAAACGTAATCCCAAGATTTAACTTCCCTGCCATTTTCTTAGAGAGGATAATCAGATCAGATCTTCCTGTAAATCTCCGGGCCGTAGCTCGCCAAGCTGAGAAAATTTATAAAGATTGCGGAAAGCCGTCAATAATAGAAGATTTGTTGGGTATAATATCTTCACAGCCAGCCCCTTCTAATGGTATTGAGTTCGATAGTCTTGCTACGGAGAGATCTGTTGCCTCCAGTGTTGGATCATTAGCTCATTCAAATGAATTGAACAACAATTGGGGAGTGTATGGAAAAGCCTGCAAGCTTGATAAACCTTGCACCGTGGATGAAGTTCATCTTCGTAGATTTGATGGTCTATTGGAAAATGGAGGTGTTCACCGATGCGCCGTTGCTAGTATAACAGTTAAAGCTCCTGTTTGTGAAGTTTGGAAAGTTCTAACGTCTTATGAGAGTCTTCCAGAGATAGTTCCAAATTTGGCAATCAGCAAGATTTTGTCACGCGATAACAATAAAGTCCGAATACTTCAGGAAGGATGCAAAGGCCTGCTTTACATGGTGCTTCATGCAAGAGCTGTTCTCGATTTGCATGAGATTCGTGAGCAGGAAATCAGATTTGAACAGGTTGAAGGAGACTTTGACTCGCTAGAGGGGAAATGGATTTTTGAACAACTAGGAAGTCACCACACACTTCTCAAGTATACCGTGGAGTCCAAAATGAGAAAAGATTCATTTCTTTCTGAAGCAATCATGGAAGAGGTTATATATGAAGATCTTCCGTCAAATTTATGCGCTATCCGGGATTACATTGAGAAAAGAGGAGAGAAATCTTCAGAGTCATGTAAACTGGAGACATGTCAAGTTTCAGAGGAAACATGTTCTTCATCTCGTGCCAAATCAGTTGAGACAGTTTACAATAATGATGATGGTTCAGACCAAACTAAGCAGAGACGGAGGATTCCTGGTCTACAAAGAGACATTGAAGTCTTGAAATCAGAAATTCTCAAGTTCATATCAGAACATGGACAAGAAGGATTCATGCCCATGAGGAAGCAGCTTCGGTTACATGGAAGAGTTGACATTGAAAAAGCCATTACAAGAATGGGTGGATTTAGGAGAATAGCTTTGATGATGAATCTTTCACTTGCTTATAAACACCGAAAACCGAAAGGATATTGGGACAATCTCGAAAACTTGCAAGAGGAGATAGGAAGATTTCAACAGAGTTGGGGAATGGATCCATCATTTATGCCGAGCAGAAAATCTTTCGAACGAGCAGGTCGTTATGACATTGCTCGGGCGCTCGAGAAATGGGGAGGATTACACGAAGTATCTCGTCTTTTAGCATTGAACGTGAGACATCCAAACAGGCAGCTAAATTCTCGTAAAGACAACGGTAACACGATACTGAGAACTGAATCTACTGAGGCCGATTTAAATTCAACGGTTAATAAGAATAATAAACCTTACGTCTCTCAAGATACCGAGAAATGGTTGTACAATCTTAAAGATCTTGATATCAATTGGGTTCAATATTGAAGCATTAATTATGTACATTTCACTATTTGTGTAGTCTTGTAACTCGCAAAGATAAACATGTATTTATGTAAATTGTAACATTGGATTGAAATTATCTGATCTCTTTTT

SEQ ID NO: 2445 - DNA, 863 bp, Arabidopsis thaliana
  misc_feature (1)..(863): Ceres cDNA ID no. 13604771
  misc_feature (1)..(863): Also known as  Ceres CDNA ID no. 23827422
ggctgtggcgggacccaagtctttgacaatggctgaagatgaaatagtagtcgaagaagagcaatcacagccacaggagattactccagttccaccatcttcttcgtcttcgccttcgttagtggtggaagacgacgatgagatgaagctcaagcacttggaattcattcaagtcgcggcggtttacttcgccgcctgtttctcgaccctctacgagttggctaaagacaacgctggtccactcaaactcggcgtcgagaacattgaagattgcgttcgaaccgtgcttgctccattatacgaaaaattccacgacgttcctttcaagcttctccttttcgtcgatcgtaaggtggacgatgtgttcttcgatgttgagacatatgttccgtcattggtgaagcaagcttctagccaagcgctcacggtggccacggaggtgcagcgcaccggcgttgtggacactaccaagagcattgcaagaagcgtccgggacaagtacgagccagcggcagagtattacgcagcgacgctgtggcgtttactgaatcaactgccgttgttccctgaagttgcgcatttagtgatccccacggcgttttactggtcagagaagtacaacgatgcggttcgttacgttggcgacagagactactttggggcagagtatctacccatgattcctattgagaagatctctgatattttggaacaagatcagtgtcgagctgattgactatttactcttctgaagccaaagattccttcttctatagagtatatatactgtatgtactctgtttttctttcctttctgcaatttgctatcccaagagatgtaatctttcttcaatatttcattt

SEQ ID NO: 2446 - protein, 863 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
GGCTGTGGCGGGACCCAAGTCTTTGACAATGGCTGAAGATGAAATAGTAGTCGAAGAAGAGCAATCACAGCCACAGGAGATTACTCCAGTTCCACCATCTTCTTCGTCTTCGCCTTCGTTAGTGGTGGAAGACGACGATGAGATGAAGCTCAAGCACTTGGAATTCATTCAAGTCGCGGCGGTTTACTTCGCCGCCTGTTTCTCGACCCTCTACGAGTTGGCTAAAGACAACGCTGGTCCACTCAAACTCGGCGTCGAGAACATTGAAGATTGCGTTCGAACCGTGCTTGCTCCATTATACGAAAAATTCCACGACGTTCCTTTCAAGCTTCTCCTTTTCGTCGATCGTAAGGTGGACGATGTGTTCTTCGATGTTGAGACATATGTTCCGTCATTGGTGAAGCAAGCTTCTAGCCAAGCGCTCACGGTGGCCACGGAGGTGCAGCGCACCGGCGTTGTGGACACTACCAAGAGCATTGCAAGAAGCGTCCGGGACAAGTACGAGCCAGCGGCAGAGTATTACGCAGCGACGCTGTGGCGTTTACTGAATCAACTGCCGTTGTTCCCTGAAGTTGCGCATTTAGTGATCCCCACGGCGTTTTACTGGTCAGAGAAGTACAACGATGCGGTTCGTTACGTTGGCGACAGAGACTACTTTGGGGCAGAGTATCTACCCATGATTCCTATTGAGAAGATCTCTGATATTTTGGAACAAGATCAGTGTCGAGCTGATTGACTATTTACTCTTCTGAAGCCAAAGATTCCTTCTTCTATAGAGTATATATACTGTATGTACTCTGTTTTTCTTTCCTTTCTGCAATTTGCTATCCCAAGAGATGTAATCTTTCTTCAATATTTCATTT

SEQ ID NO: 2447 - DNA, 1617 bp, Arabidopsis thaliana
  misc_feature (1)..(1617): Ceres cDNA ID no. 13604812
  misc_feature (1)..(1617): Also known as  Ceres CDNA ID no. 23827422
atcctccttcaacttccctctccctctctcttttaggaattttcctcagaaattggaggactcacactcttctgggtttctgctgcagccaaatcaccaaggagatacatactacaaccatggatgatgatgaatatgccaagctcatcaggagaatgaatcctcccagagttgtaatagacaacaacgcaagcgacgatgccactgttattcaggttgatagtgtgaacaaacatgggactctattggaagtagtacaagtgctcactgatatgaatcttgtgatcaagaaagcttacatctcttccgatggaggttggttcatggacgttttcaaagtcatcgaccaagatggcaataagatcagagacactcaagtccttgactatatccaaaagaggatagagagcaacgctgggtggttcattccacctttgagaagctcagttggtgtaatgcccactgacgaatacacatccattgagctcgctggaactgacagacccggtctcttgtctgaagtatctgctgttctcacagaccttcactgcaacgttgtgaacgctgagatatggactcacaacaccagagctgcagcggttattcatgtcacggacaattcaactcattctgccattactgacccgattcgcctttccaccatcaaggagctgctgtgcaatgtagtgaggacaaacagcggctcaagagctgcgaaaacagtcttctcttgttctgatacacacagggagagacggttgcatcagatcatgtttgatgatagggactacgagggagtcaaaagagcaaggacatcggcgtcaaggcccagtgtcacactaatgaacattgagaaggattataccgttgttaccatgaggtccaaagatagaccaaagcttgtgtttgacgtagtctgtactttgactgatatgcagtatgtggtgttccatggcatggtcagcacagaaccagtggaggcttatcaggaattttacatccgtcatgtggatggacttcccataaactcagaagcagagcaagaacgtgtcatacaatgtctggaagcagccattgagaggagagcatcggagggtttagagctggaattatcagcagaagaccgagttggtcttctctcagacataaccagaacattccgagagaacagcttaaccattgtgagagcagagatatcaacgcgagagggtaaggctaaagacacgttctacgttacagacgtgactggaaacccggttgaatcaaaaatcgtggagtcaatcagacaacagataggagtaagcaagctgaaggtgaagaagaaggagaaggagcattgctctgttcttggtacaagcaggccttcgcacgaaacaactacaatggggtatttgctaagtaacatcttcaaacccaagtagcttcaagcttcacctatctcactcatagtcatagagtgtgtgtgtgctttgtataggttagacagagtagggcatcatttaagctgatcgtagcgatcccctctcaacaagtcccttgtgtgtaaatttgtgtgaacaaaataacaggaactgcctttgaatagatacggcgtcagttaataccgttgattaatgg

SEQ ID NO: 2448 - protein, 1617 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATCCTCCTTCAACTTCCCTCTCCCTCTCTCTTTTAGGAATTTTCCTCAGAAATTGGAGGACTCACACTCTTCTGGGTTTCTGCTGCAGCCAAATCACCAAGGAGATACATACTACAACCATGGATGATGATGAATATGCCAAGCTCATCAGGAGAATGAATCCTCCCAGAGTTGTAATAGACAACAACGCAAGCGACGATGCCACTGTTATTCAGGTTGATAGTGTGAACAAACATGGGACTCTATTGGAAGTAGTACAAGTGCTCACTGATATGAATCTTGTGATCAAGAAAGCTTACATCTCTTCCGATGGAGGTTGGTTCATGGACGTTTTCAAAGTCATCGACCAAGATGGCAATAAGATCAGAGACACTCAAGTCCTTGACTATATCCAAAAGAGGATAGAGAGCAACGCTGGGTGGTTCATTCCACCTTTGAGAAGCTCAGTTGGTGTAATGCCCACTGACGAATACACATCCATTGAGCTCGCTGGAACTGACAGACCCGGTCTCTTGTCTGAAGTATCTGCTGTTCTCACAGACCTTCACTGCAACGTTGTGAACGCTGAGATATGGACTCACAACACCAGAGCTGCAGCGGTTATTCATGTCACGGACAATTCAACTCATTCTGCCATTACTGACCCGATTCGCCTTTCCACCATCAAGGAGCTGCTGTGCAATGTAGTGAGGACAAACAGCGGCTCAAGAGCTGCGAAAACAGTCTTCTCTTGTTCTGATACACACAGGGAGAGACGGTTGCATCAGATCATGTTTGATGATAGGGACTACGAGGGAGTCAAAAGAGCAAGGACATCGGCGTCAAGGCCCAGTGTCACACTAATGAACATTGAGAAGGATTATACCGTTGTTACCATGAGGTCCAAAGATAGACCAAAGCTTGTGTTTGACGTAGTCTGTACTTTGACTGATATGCAGTATGTGGTGTTCCATGGCATGGTCAGCACAGAACCAGTGGAGGCTTATCAGGAATTTTACATCCGTCATGTGGATGGACTTCCCATAAACTCAGAAGCAGAGCAAGAACGTGTCATACAATGTCTGGAAGCAGCCATTGAGAGGAGAGCATCGGAGGGTTTAGAGCTGGAATTATCAGCAGAAGACCGAGTTGGTCTTCTCTCAGACATAACCAGAACATTCCGAGAGAACAGCTTAACCATTGTGAGAGCAGAGATATCAACGCGAGAGGGTAAGGCTAAAGACACGTTCTACGTTACAGACGTGACTGGAAACCCGGTTGAATCAAAAATCGTGGAGTCAATCAGACAACAGATAGGAGTAAGCAAGCTGAAGGTGAAGAAGAAGGAGAAGGAGCATTGCTCTGTTCTTGGTACAAGCAGGCCTTCGCACGAAACAACTACAATGGGGTATTTGCTAAGTAACATCTTCAAACCCAAGTAGCTTCAAGCTTCACCTATCTCACTCATAGTCATAGAGTGTGTGTGTGCTTTGTATAGGTTAGACAGAGTAGGGCATCATTTAAGCTGATCGTAGCGATCCCCTCTCAACAAGTCCCTTGTGTGTAAATTTGTGTGAACAAAATAACAGGAACTGCCTTTGAATAGATACGGCGTCAGTTAATACCGTTGATTAATGG

SEQ ID NO: 2449 - DNA, 1103 bp, Arabidopsis thaliana
  misc_feature (1)..(1103): Ceres cDNA ID no. 13604847
  misc_feature (1)..(1103): Also known as  Ceres CDNA ID no. 23827422
atccaaaaccaaaagggagagactaagaatggggtcactaggagaagaaccacaagtagcagaagactgcatgggtttgcttcaactcctaagcaacggtaccgttttgagatccgagagcattgaccttattacccaacaaatcccattcaaaaacaaccaaaccgttctcttcaaagactcaatctatcacaaacctaacaaccttcacctccgtctctacaaacccatttccgcctccaaccgtaccgctctccctgtcgtggtcttcttccacggcgggggcttctgcttcgggtcacgttcttggcctcactttcacaacttctgtctaactcttgcatcgtcccttaacgcccttgtcgtctcacctgactaccggttagcacccgaacaccgcctcccggctgcctttgaggatgctgaggcggtgcttacatggctctgggaccaagctgtttccgatggtgtgaaccactggtttgaagatggaacagacgttgactttgacagggtttttgttgttggtgattcatccggtgggaacatagctcatcaactcgctgtccggttcggatccggttcaatcgagttgacaccggttcgggtacgcggttacgttcttatgggaccgttttttggcggggaagagaggactaactccgagaatggcccctctgaagctttgctcagcttggatttgcttgacaagttttggagattgtcactaccaaacggtgcaacaagagatcaccacatggctaacccttttggaccaacgagtcctacactcgaatcaattagcttagagccaatgttggtgattgtcggcggctcagaactcttgagagatagggccaaggaatatgcatataaattaaagaagatgggaggaaaaagggtagattacattgaattcgaaaacaaggagcatggtttctactccaactatccatcttccgaggctgcggaacaagttctccgtatcattggagactttatgaacaacttgtcttaagtattttagcatttggcttgttgaaggtaattaagtgtttaattcaattaggattccatctcaataatattaagtttgcttggtg

SEQ ID NO: 2450 - protein, 1103 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATCCAAAACCAAAAGGGAGAGACTAAGAATGGGGTCACTAGGAGAAGAACCACAAGTAGCAGAAGACTGCATGGGTTTGCTTCAACTCCTAAGCAACGGTACCGTTTTGAGATCCGAGAGCATTGACCTTATTACCCAACAAATCCCATTCAAAAACAACCAAACCGTTCTCTTCAAAGACTCAATCTATCACAAACCTAACAACCTTCACCTCCGTCTCTACAAACCCATTTCCGCCTCCAACCGTACCGCTCTCCCTGTCGTGGTCTTCTTCCACGGCGGGGGCTTCTGCTTCGGGTCACGTTCTTGGCCTCACTTTCACAACTTCTGTCTAACTCTTGCATCGTCCCTTAACGCCCTTGTCGTCTCACCTGACTACCGGTTAGCACCCGAACACCGCCTCCCGGCTGCCTTTGAGGATGCTGAGGCGGTGCTTACATGGCTCTGGGACCAAGCTGTTTCCGATGGTGTGAACCACTGGTTTGAAGATGGAACAGACGTTGACTTTGACAGGGTTTTTGTTGTTGGTGATTCATCCGGTGGGAACATAGCTCATCAACTCGCTGTCCGGTTCGGATCCGGTTCAATCGAGTTGACACCGGTTCGGGTACGCGGTTACGTTCTTATGGGACCGTTTTTTGGCGGGGAAGAGAGGACTAACTCCGAGAATGGCCCCTCTGAAGCTTTGCTCAGCTTGGATTTGCTTGACAAGTTTTGGAGATTGTCACTACCAAACGGTGCAACAAGAGATCACCACATGGCTAACCCTTTTGGACCAACGAGTCCTACACTCGAATCAATTAGCTTAGAGCCAATGTTGGTGATTGTCGGCGGCTCAGAACTCTTGAGAGATAGGGCCAAGGAATATGCATATAAATTAAAGAAGATGGGAGGAAAAAGGGTAGATTACATTGAATTCGAAAACAAGGAGCATGGTTTCTACTCCAACTATCCATCTTCCGAGGCTGCGGAACAAGTTCTCCGTATCATTGGAGACTTTATGAACAACTTGTCTTAAGTATTTTAGCATTTGGCTTGTTGAAGGTAATTAAGTGTTTAATTCAATTAGGATTCCATCTCAATAATATTAAGTTTGCTTGGTG

SEQ ID NO: 2451 - DNA, 1348 bp, Arabidopsis thaliana
  misc_feature (1)..(1348): Ceres cDNA ID no. 13604972
  misc_feature (1)..(1348): Also known as  Ceres CDNA ID no. 23827422
aacttgtgaaaacctttctttccaaatttgtttccatggcgcagcagagccaacgtccaatctcaaaccgtcacatctctctcctcaaccgtaacggtctcatcctccttctccttctagctctctttgttatcctcggtgtattcttacctttgacaaaatcttccttgttcatgtttccaaacacaacatcttcttctctttctccttcttcttctttatcggtctccgactggcgcgactattcccttgctcaagccgttaagtttgttgctaagaacgagactgtgatcgtctgtgctgttagctaccctttcttgccttttcttaacaactggttgattagcatttctagacagaaacatcaagaaaaagttcttgtgatcgctgaagactatgctactttgtacaaagtcaacgaaaagtggcctggtcatgctgttctcattcctccggcgttggatcctcaatccgcacacaaatttggttcccagggtttcttcaatctgacatctcggaggccacaacatctcttaaacattttggagctaggttacaatgttatgtacaatgatgttgatatggtctggctacaagatccatttgactatttacaaggaagctacgatgcatacttcatggatgacatgattgcgattaagcctttgaatcactcccatgatttaccacctctaagtcgaagcggagttacttatgtatgtagctgcatgattttcttgcgttccactgatggcggaaagcttctaatgaagacatgggtcgaggaaattcaagctcaaccttggaataacactcaagcaaagaaaccacatgatcagcctgcttttaatcgggcacttcacaaaacagctaatcaagtaaaagtctacttgcttccgcaatcagctttcccatcaggaggattgtacttcaggaatgagacatgggttaacgagacaagggggaaacatgtcatagtccacaataactacattatcggttacgacaagaagatgaaacgttttcaagactttagtctatggctagtcgatgatcatgctcttgagtccccactcggaaaactagagatatatcaagagcagaatactactactgaagggaaaaatctgacgaaaatagtgagaaaacagaggaaaaacaggggtaaaaaacacaagttaccctagagaggacttctccttacgtacgacaagtgtaggatctcgaaattgttgcgcggagatttattcaaactcgattacttagatatatgttcaaagtctcccattataatatgatatttatacataaatactcatcagcactatttcattaataacttttatgt

SEQ ID NO: 2452 - protein, 1348 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
AACTTGTGAAAACCTTTCTTTCCAAATTTGTTTCCATGGCGCAGCAGAGCCAACGTCCAATCTCAAACCGTCACATCTCTCTCCTCAACCGTAACGGTCTCATCCTCCTTCTCCTTCTAGCTCTCTTTGTTATCCTCGGTGTATTCTTACCTTTGACAAAATCTTCCTTGTTCATGTTTCCAAACACAACATCTTCTTCTCTTTCTCCTTCTTCTTCTTTATCGGTCTCCGACTGGCGCGACTATTCCCTTGCTCAAGCCGTTAAGTTTGTTGCTAAGAACGAGACTGTGATCGTCTGTGCTGTTAGCTACCCTTTCTTGCCTTTTCTTAACAACTGGTTGATTAGCATTTCTAGACAGAAACATCAAGAAAAAGTTCTTGTGATCGCTGAAGACTATGCTACTTTGTACAAAGTCAACGAAAAGTGGCCTGGTCATGCTGTTCTCATTCCTCCGGCGTTGGATCCTCAATCCGCACACAAATTTGGTTCCCAGGGTTTCTTCAATCTGACATCTCGGAGGCCACAACATCTCTTAAACATTTTGGAGCTAGGTTACAATGTTATGTACAATGATGTTGATATGGTCTGGCTACAAGATCCATTTGACTATTTACAAGGAAGCTACGATGCATACTTCATGGATGACATGATTGCGATTAAGCCTTTGAATCACTCCCATGATTTACCACCTCTAAGTCGAAGCGGAGTTACTTATGTATGTAGCTGCATGATTTTCTTGCGTTCCACTGATGGCGGAAAGCTTCTAATGAAGACATGGGTCGAGGAAATTCAAGCTCAACCTTGGAATAACACTCAAGCAAAGAAACCACATGATCAGCCTGCTTTTAATCGGGCACTTCACAAAACAGCTAATCAAGTAAAAGTCTACTTGCTTCCGCAATCAGCTTTCCCATCAGGAGGATTGTACTTCAGGAATGAGACATGGGTTAACGAGACAAGGGGGAAACATGTCATAGTCCACAATAACTACATTATCGGTTACGACAAGAAGATGAAACGTTTTCAAGACTTTAGTCTATGGCTAGTCGATGATCATGCTCTTGAGTCCCCACTCGGAAAACTAGAGATATATCAAGAGCAGAATACTACTACTGAAGGGAAAAATCTGACGAAAATAGTGAGAAAACAGAGGAAAAACAGGGGTAAAAAACACAAGTTACCCTAGAGAGGACTTCTCCTTACGTACGACAAGTGTAGGATCTCGAAATTGTTGCGCGGAGATTTATTCAAACTCGATTACTTAGATATATGTTCAAAGTCTCCCATTATAATATGATATTTATACATAAATACTCATCAGCACTATTTCATTAATAACTTTTATGT

SEQ ID NO: 2453 - DNA, 1861 bp, Arabidopsis thaliana
  misc_feature (1)..(1861): Ceres cDNA ID no. 13605051
  misc_feature (1)..(1861): Also known as  Ceres CDNA ID no. 23827422
atgttgaatttgtggctacgagaacatttagtatacgtttgccaccagcagaacctagtggctaagtttaggagtcagaaagcaatgaaattgttaagatttgctggtcttgttttcatttttatcacaaccttccagtttgtgaacatacgttattatggtggtgatatattctctttatcttctcaagataagtttccagtatcaattgatgtaagcacagaacccgtaagcacgttgtccggtcctgaaagattgaattctagtagttcaagatccgttgaggtagatgaagaggaaagcaccggtttaaaagaagaccatgtgattggctttgataagaatgacacagttcaaggccatgatagtttcgtagaggatgtcaaagataaggaaactcttgatttgcttccaggaaccaagagcagctcaaacgagagttacgagaaaatagtagaagatgctgatattgcttttgaaaatattaggaaaatggagattctggagagtaagtctgatccttctgttgataatctttcctcagaggtgaaaaagtttatgaatgtttcaaattctggggtggtttctatcactgagatgatgaatttactgcatcaaagccgcacttctcatgtctcactgaaagtaaaacggtcttccacaattgatcatgagctgttatatgcaagaactcaaattgagaacccaccgctgatagagaacgaccctttactgcatactcctctgtattggaatctctccatgttcaaaaggagctatgagctaatggagaaaaagctcaaggtatatgtctacagggaaggcaaaagacctgtactgcataagccggtgctgaaaggaatatatgcttctgaaggatggtttatgaaacaactcaagtccagcagaacatttgtcacaaaagaccctcgtaaagctcacctattttatcttcctttcagctccaaaatgttggaagaaactctgtatgtcccaggttctcacagcgataagaatctcattcagtttttgaagaactacctggacatgatttcttccaaatatagtttctggaataaaactggaggatcagatcattttctggttgcttgccacgactgggctccttccgagacgaggcagtacatggccaagtgcatcagagcattatgcaattctgatgtttcagaaggttttgtgttcggtaaagatgtagctcttcctgagacgactattcttgttcctaggagaccgcttagggctctcggaggcaaacctgtttcacaaaggcaaatacttgccttctttgcaggcggaatgcacggttaccttagacctctcctattgcaaaactggggaggaaacagagatccagacatgaaaatattcagtgagatacccaaatctaaagggaaaaagagttacatggagtacatgaagagcagcaagtattgcatctgcccaaaagggcacgaagtcaatagccctcgggtcgtggaggcattgttctatgagtgtgtcccggttatcatatccgataactttgtacctcccttcttcgaagttctgaattgggagtcttttgcggtatttgtcttggagaaagatattcctgatttgaagaacatattagtgtccataactgaggaaaggtatagagagatgcagatgagagtcaagatggtgcagaagcatttcctttggcattctaaacctgagagattcgatatatttcatatgatacttcactccatttggtacaatagagtttttcaaatttaaaaccacagagtaggtttgtgactgtagaacaagtaactaacagagattcattcgttaatatagcaaaaaagcaggttac

SEQ ID NO: 2454 - protein, 1861 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATGTTGAATTTGTGGCTACGAGAACATTTAGTATACGTTTGCCACCAGCAGAACCTAGTGGCTAAGTTTAGGAGTCAGAAAGCAATGAAATTGTTAAGATTTGCTGGTCTTGTTTTCATTTTTATCACAACCTTCCAGTTTGTGAACATACGTTATTATGGTGGTGATATATTCTCTTTATCTTCTCAAGATAAGTTTCCAGTATCAATTGATGTAAGCACAGAACCCGTAAGCACGTTGTCCGGTCCTGAAAGATTGAATTCTAGTAGTTCAAGATCCGTTGAGGTAGATGAAGAGGAAAGCACCGGTTTAAAAGAAGACCATGTGATTGGCTTTGATAAGAATGACACAGTTCAAGGCCATGATAGTTTCGTAGAGGATGTCAAAGATAAGGAAACTCTTGATTTGCTTCCAGGAACCAAGAGCAGCTCAAACGAGAGTTACGAGAAAATAGTAGAAGATGCTGATATTGCTTTTGAAAATATTAGGAAAATGGAGATTCTGGAGAGTAAGTCTGATCCTTCTGTTGATAATCTTTCCTCAGAGGTGAAAAAGTTTATGAATGTTTCAAATTCTGGGGTGGTTTCTATCACTGAGATGATGAATTTACTGCATCAAAGCCGCACTTCTCATGTCTCACTGAAAGTAAAACGGTCTTCCACAATTGATCATGAGCTGTTATATGCAAGAACTCAAATTGAGAACCCACCGCTGATAGAGAACGACCCTTTACTGCATACTCCTCTGTATTGGAATCTCTCCATGTTCAAAAGGAGCTATGAGCTAATGGAGAAAAAGCTCAAGGTATATGTCTACAGGGAAGGCAAAAGACCTGTACTGCATAAGCCGGTGCTGAAAGGAATATATGCTTCTGAAGGATGGTTTATGAAACAACTCAAGTCCAGCAGAACATTTGTCACAAAAGACCCTCGTAAAGCTCACCTATTTTATCTTCCTTTCAGCTCCAAAATGTTGGAAGAAACTCTGTATGTCCCAGGTTCTCACAGCGATAAGAATCTCATTCAGTTTTTGAAGAACTACCTGGACATGATTTCTTCCAAATATAGTTTCTGGAATAAAACTGGAGGATCAGATCATTTTCTGGTTGCTTGCCACGACTGGGCTCCTTCCGAGACGAGGCAGTACATGGCCAAGTGCATCAGAGCATTATGCAATTCTGATGTTTCAGAAGGTTTTGTGTTCGGTAAAGATGTAGCTCTTCCTGAGACGACTATTCTTGTTCCTAGGAGACCGCTTAGGGCTCTCGGAGGCAAACCTGTTTCACAAAGGCAAATACTTGCCTTCTTTGCAGGCGGAATGCACGGTTACCTTAGACCTCTCCTATTGCAAAACTGGGGAGGAAACAGAGATCCAGACATGAAAATATTCAGTGAGATACCCAAATCTAAAGGGAAAAAGAGTTACATGGAGTACATGAAGAGCAGCAAGTATTGCATCTGCCCAAAAGGGCACGAAGTCAATAGCCCTCGGGTCGTGGAGGCATTGTTCTATGAGTGTGTCCCGGTTATCATATCCGATAACTTTGTACCTCCCTTCTTCGAAGTTCTGAATTGGGAGTCTTTTGCGGTATTTGTCTTGGAGAAAGATATTCCTGATTTGAAGAACATATTAGTGTCCATAACTGAGGAAAGGTATAGAGAGATGCAGATGAGAGTCAAGATGGTGCAGAAGCATTTCCTTTGGCATTCTAAACCTGAGAGATTCGATATATTTCATATGATACTTCACTCCATTTGGTACAATAGAGTTTTTCAAATTTAAAACCACAGAGTAGGTTTGTGACTGTAGAACAAGTAACTAACAGAGATTCATTCGTTAATATAGCAAAAAAGCAGGTTAC

SEQ ID NO: 2455 - DNA, 1689 bp, Arabidopsis thaliana
  misc_feature (1)..(1689): Ceres cDNA ID no. 13605078
  misc_feature (1)..(1689): Also known as  Ceres CDNA ID no. 23827422
atgaagctttttcttagaaatgcttttaaaaccttaaaccctaagagaaaactagcgacgacgattcttccttcaatcaatttaattctcgttaaacccttctctcaatccaccaccattcccaaaaaacaggatcgagttcgtgaccatggctacgacaattacatggaagtggagaaaaaaatccgcaaagtcgtcaaatttcacagcttgattctctctcaacccaaccacacaatcgcaatctctcttctagacacgctcgctcgtcgtctaggtctcggcttcaagcaacacgaaccaggtgcttttctcctcaagttcccacacgtgtttgagatatacgagcacccagttcaaagaatcctctattgtcgattaacccgtaaagctttggatcaaatccgtcacgaacacgaagctgttctcgaccaaatacccgacgccgtgacccggttgaggaaactcgttatgatgtcgaatacgggtcggatccgtcttgaacatgtcaggattgctcggactgagtttggactccctgaagatttcgagtactctgtgattctgaaacatccacagttctttagactcattgatggtgaagagactcgagataagtacattgagattgtggaaaaggatcctaatttatcgatttgtgcaatagagagagttagagagattgagtatagaacaaaaggaattgatgcagaggatgttcgattctcattcgttgtgaattttcctcctggatttaagattggaaagtattttcgaattgctgtttggaaatggcagaggcttccttattggtcaccgtatgaggatatatcgggttacgatttgagatcgatggaagcgcagaatcgattagagaagagatctgttgcttgtattcatgaattgctgtctttgactgtggagaagaagatcacgcttgagagaattgctcattttaggaatgtgatgaatttgcctaagaaattgaaagagtttcttttgcaacatcaggggatattttacatatcgactcgaggaaattacgggaagcttcatacggtgtttcttagagaggggtataagagaggggaattggtagaaccgaatgatgtttatttagctaggaggagattagctgagcttgttttgatgagtcctagaaaggctaaggttgatgcagagttggttcgctacagagatggattggatgatgaagatgatgtcgaatgaacatacgattttcttgaccgttgtttcatctacactctcattctctgcgcatcactatttgtatccagaaagctagaagtggactgatgatgatgatgatgatgacgaagaatcgaagattgtgaaaaggtgcttattcacttggatggattaatgattgtgaatctcactcattgttctgaatcaatttgaatcgaagaagatgcctgcaagattgcttacttcagctgcaagatatactttggctctaccctttctcatcagcaatattccttaactcgattcttgattttcgcagatactaagaaacaacctggaatattttttgctcaagtcccctatggtttaagccaagaatccttattacctgtctacatattgcaaaccaaatttaaaaaggtttctttgcttatgcatcaacaaaaagacaattctttgtaataaatatcttcaattcat

SEQ ID NO: 2456 - protein, 1689 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATGAAGCTTTTTCTTAGAAATGCTTTTAAAACCTTAAACCCTAAGAGAAAACTAGCGACGACGATTCTTCCTTCAATCAATTTAATTCTCGTTAAACCCTTCTCTCAATCCACCACCATTCCCAAAAAACAGGATCGAGTTCGTGACCATGGCTACGACAATTACATGGAAGTGGAGAAAAAAATCCGCAAAGTCGTCAAATTTCACAGCTTGATTCTCTCTCAACCCAACCACACAATCGCAATCTCTCTTCTAGACACGCTCGCTCGTCGTCTAGGTCTCGGCTTCAAGCAACACGAACCAGGTGCTTTTCTCCTCAAGTTCCCACACGTGTTTGAGATATACGAGCACCCAGTTCAAAGAATCCTCTATTGTCGATTAACCCGTAAAGCTTTGGATCAAATCCGTCACGAACACGAAGCTGTTCTCGACCAAATACCCGACGCCGTGACCCGGTTGAGGAAACTCGTTATGATGTCGAATACGGGTCGGATCCGTCTTGAACATGTCAGGATTGCTCGGACTGAGTTTGGACTCCCTGAAGATTTCGAGTACTCTGTGATTCTGAAACATCCACAGTTCTTTAGACTCATTGATGGTGAAGAGACTCGAGATAAGTACATTGAGATTGTGGAAAAGGATCCTAATTTATCGATTTGTGCAATAGAGAGAGTTAGAGAGATTGAGTATAGAACAAAAGGAATTGATGCAGAGGATGTTCGATTCTCATTCGTTGTGAATTTTCCTCCTGGATTTAAGATTGGAAAGTATTTTCGAATTGCTGTTTGGAAATGGCAGAGGCTTCCTTATTGGTCACCGTATGAGGATATATCGGGTTACGATTTGAGATCGATGGAAGCGCAGAATCGATTAGAGAAGAGATCTGTTGCTTGTATTCATGAATTGCTGTCTTTGACTGTGGAGAAGAAGATCACGCTTGAGAGAATTGCTCATTTTAGGAATGTGATGAATTTGCCTAAGAAATTGAAAGAGTTTCTTTTGCAACATCAGGGGATATTTTACATATCGACTCGAGGAAATTACGGGAAGCTTCATACGGTGTTTCTTAGAGAGGGGTATAAGAGAGGGGAATTGGTAGAACCGAATGATGTTTATTTAGCTAGGAGGAGATTAGCTGAGCTTGTTTTGATGAGTCCTAGAAAGGCTAAGGTTGATGCAGAGTTGGTTCGCTACAGAGATGGATTGGATGATGAAGATGATGTCGAATGAACATACGATTTTCTTGACCGTTGTTTCATCTACACTCTCATTCTCTGCGCATCACTATTTGTATCCAGAAAGCTAGAAGTGGACTGATGATGATGATGATGATGACGAAGAATCGAAGATTGTGAAAAGGTGCTTATTCACTTGGATGGATTAATGATTGTGAATCTCACTCATTGTTCTGAATCAATTTGAATCGAAGAAGATGCCTGCAAGATTGCTTACTTCAGCTGCAAGATATACTTTGGCTCTACCCTTTCTCATCAGCAATATTCCTTAACTCGATTCTTGATTTTCGCAGATACTAAGAAACAACCTGGAATATTTTTTGCTCAAGTCCCCTATGGTTTAAGCCAAGAATCCTTATTACCTGTCTACATATTGCAAACCAAATTTAAAAAGGTTTCTTTGCTTATGCATCAACAAAAAGACAATTCTTTGTAATAAATATCTTCAATTCAT

SEQ ID NO: 2457 - DNA, 1682 bp, Arabidopsis thaliana
  misc_feature (1)..(1682): Ceres cDNA ID no. 13605108
  misc_feature (1)..(1682): Also known as  Ceres CDNA ID no. 23827422
aataccactatctcttctctctctcaatctctcaaaagatctccggtaacgttttaacgtcggtgaaaaaatgcggaagttaacggcggttaattcactactgaaacggaacaattatcttcttccgcgccatggctcctcacaaacagcagctcagagaacatcctccgtccgcgagaccgagaccgaaacaaaacttccgaaaatgcccccgttcaattattctccgccgccttacgacggtccatctacggcagagatcatcgcaaagcggcgagagttcctcagccccgctctttttcacttctacaacacacccttaaacattgtggaggcaaagatgcagtatgtgttcgacgagaatggacgtcgatatttagatgcctttggaggaatagcgacggtttcgtgcggccattgccacccggaagtagttaactccgtcgtcaaacagttgaaacttattaaccactccaccatcctttaccttaaccacaccatctccgatttcgctgaagcccttgtctccactcttccgggagatctcaaggtggtgtttttcacgaattcgggtacggaggcgaatgaacttgcgatgatgatggctagactgtatacaggatgtaacgacatcgtttcgcttaggaactcttatcatggaaacgcagctgctactatgggtgccactgctcagtccaactggaaattcaacgtcgttcagagtggagttcatcacgccataaatccagatccttacagaggaatatttggatccgacggtgaaaagtacgcgagtgatgtacacgatcttatccaattcggaacgtccggtcaagtcgccggtttcattggcgaatcaatccagggtgttggaggaatcgtagagcttgctcccggatacttaccggcggcttacgacatcgtgaggaaagccggaggagtttgcatcgccgatgaagtccaatccggttttgctcgtaccggaacccatttctgggggtttcaatcccatggtgttatccctgacatcgtcaccatggccaaggggatcggtaacggtataccacttggagcggttgtgacgacaccggagattgccggcgttttaagccgtcggagttactttaatactttcggcggaaatccaatgtgcacggccgcaggacacgcagtacttagagtccttcacgaagagaagctccaagagaatgctaacctcgttggctcacatcttaaacgtagacttacgctactcaaaaacaaatacgaactcattggagacgtgagagggagaggattgatgctaggagttgagtttgtcaaagaccgcgacttaaaaactcctgcaaaagcagagacccttcatttaatggatcaaatgaaagaaatgggagtgttggtggggaaaggtggattctatgggaatgtcttcagaatcactcctcctctctgcttcaccctctccgacgctgatttcctcgtggatgtgatggatcacgccatgtccaagatgtgatttactatctttatccgttctctaatgatcactcacccttgtatgtgtatataaataacacaatacatcataaagtagaattacaattggtgtttaccgaaatatatcacagatgcaagtatatgtaactaaatgtacagtactgtatacacttgatagaatctac

SEQ ID NO: 2458 - protein, 1682 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
AATACCACTATCTCTTCTCTCTCTCAATCTCTCAAAAGATCTCCGGTAACGTTTTAACGTCGGTGAAAAAATGCGGAAGTTAACGGCGGTTAATTCACTACTGAAACGGAACAATTATCTTCTTCCGCGCCATGGCTCCTCACAAACAGCAGCTCAGAGAACATCCTCCGTCCGCGAGACCGAGACCGAAACAAAACTTCCGAAAATGCCCCCGTTCAATTATTCTCCGCCGCCTTACGACGGTCCATCTACGGCAGAGATCATCGCAAAGCGGCGAGAGTTCCTCAGCCCCGCTCTTTTTCACTTCTACAACACACCCTTAAACATTGTGGAGGCAAAGATGCAGTATGTGTTCGACGAGAATGGACGTCGATATTTAGATGCCTTTGGAGGAATAGCGACGGTTTCGTGCGGCCATTGCCACCCGGAAGTAGTTAACTCCGTCGTCAAACAGTTGAAACTTATTAACCACTCCACCATCCTTTACCTTAACCACACCATCTCCGATTTCGCTGAAGCCCTTGTCTCCACTCTTCCGGGAGATCTCAAGGTGGTGTTTTTCACGAATTCGGGTACGGAGGCGAATGAACTTGCGATGATGATGGCTAGACTGTATACAGGATGTAACGACATCGTTTCGCTTAGGAACTCTTATCATGGAAACGCAGCTGCTACTATGGGTGCCACTGCTCAGTCCAACTGGAAATTCAACGTCGTTCAGAGTGGAGTTCATCACGCCATAAATCCAGATCCTTACAGAGGAATATTTGGATCCGACGGTGAAAAGTACGCGAGTGATGTACACGATCTTATCCAATTCGGAACGTCCGGTCAAGTCGCCGGTTTCATTGGCGAATCAATCCAGGGTGTTGGAGGAATCGTAGAGCTTGCTCCCGGATACTTACCGGCGGCTTACGACATCGTGAGGAAAGCCGGAGGAGTTTGCATCGCCGATGAAGTCCAATCCGGTTTTGCTCGTACCGGAACCCATTTCTGGGGGTTTCAATCCCATGGTGTTATCCCTGACATCGTCACCATGGCCAAGGGGATCGGTAACGGTATACCACTTGGAGCGGTTGTGACGACACCGGAGATTGCCGGCGTTTTAAGCCGTCGGAGTTACTTTAATACTTTCGGCGGAAATCCAATGTGCACGGCCGCAGGACACGCAGTACTTAGAGTCCTTCACGAAGAGAAGCTCCAAGAGAATGCTAACCTCGTTGGCTCACATCTTAAACGTAGACTTACGCTACTCAAAAACAAATACGAACTCATTGGAGACGTGAGAGGGAGAGGATTGATGCTAGGAGTTGAGTTTGTCAAAGACCGCGACTTAAAAACTCCTGCAAAAGCAGAGACCCTTCATTTAATGGATCAAATGAAAGAAATGGGAGTGTTGGTGGGGAAAGGTGGATTCTATGGGAATGTCTTCAGAATCACTCCTCCTCTCTGCTTCACCCTCTCCGACGCTGATTTCCTCGTGGATGTGATGGATCACGCCATGTCCAAGATGTGATTTACTATCTTTATCCGTTCTCTAATGATCACTCACCCTTGTATGTGTATATAAATAACACAATACATCATAAAGTAGAATTACAATTGGTGTTTACCGAAATATATCACAGATGCAAGTATATGTAACTAAATGTACAGTACTGTATACACTTGATAGAATCTAC

SEQ ID NO: 2459 - DNA, 1337 bp, Arabidopsis thaliana
  misc_feature (1)..(1337): Ceres cDNA ID no. 13605250
  misc_feature (1)..(1337): Also known as  Ceres CDNA ID no. 23827422
atggaacttctcgccggcgactgtcggaaacgagtcggcgacgactttgaggaagatattaacccattcgatggttcggacggtggttgcgggtggatgtacggtacccgtcaaatgggttctaacggaaacgacgacgctttggctacgctcgcagacttggcttcgcctcctcagaaattgaaacctataaggtgtggcgttaagcttccgtcgtcgtcggaggatcgacatcctcttgatattctcgccggaaccctagataggctgccggagatgggttttggctgcttcgaagctcctttgggatcgaagattgctgacgtggaggaaagtggtcaattgactcgtgggttttcaaaggaagaggatgattctcttcctcctcttcaaatggagtttcaagctcgaaatcgcatctcttgggatggtctctctctcagctcctctgttgatagcagcgatagtgactcatctccagacgttcgcaagaccgtcacgggtaaaagaaagcgggaaacaagggtaaagctggagcatttcttggagaagcttgtggggagtatgatgaagcggcaggagaagatgcataatcagttgattaatgtgatggagaagatggaagtggagagaatacgccgtgaggaagcttggaggcaacaggaaaccgagaggatgacacagaatgaagaagcacggaagcaagagatggcacgcaacttgtctctcatctctttcatcagaagtgttactggtgacgagatcgagatccctaaacagtgtgaattcccgcaaccactccagcagattcttccggaacaatgtaaagacgagaaatgtgaatccgctcagagagaaagagagataaagtttaggtactcaagcggcagtggcagcagtggtagaaggtggccgcaagaggaagtgcaggcattgataagttcgagaagcgatgtggaagagaagacggggatcaacaagggagcgatttgggatgagatatcagcaagaatgaaagaaagagggtacgaaagatctgcgaaaaagtgtaaggagaagtgggagaacatgaacaagtactataggagagtgacggaaggtgggcagaaacagcctgagcacagcaagactcgctcatactttgagaaacttggaaatttttacaagaccatttcctcgggagagagggaaaaatgagtgaaagattttaaatttaggtgtttttggcacgcaaaacgggagaacttgtagatgattacctcgagtttaatttttatatctttggtgtagtttataatttaaaactctacggctctgtatttgtagaaggttcgaat

SEQ ID NO: 2460 - protein, 1337 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATGGAACTTCTCGCCGGCGACTGTCGGAAACGAGTCGGCGACGACTTTGAGGAAGATATTAACCCATTCGATGGTTCGGACGGTGGTTGCGGGTGGATGTACGGTACCCGTCAAATGGGTTCTAACGGAAACGACGACGCTTTGGCTACGCTCGCAGACTTGGCTTCGCCTCCTCAGAAATTGAAACCTATAAGGTGTGGCGTTAAGCTTCCGTCGTCGTCGGAGGATCGACATCCTCTTGATATTCTCGCCGGAACCCTAGATAGGCTGCCGGAGATGGGTTTTGGCTGCTTCGAAGCTCCTTTGGGATCGAAGATTGCTGACGTGGAGGAAAGTGGTCAATTGACTCGTGGGTTTTCAAAGGAAGAGGATGATTCTCTTCCTCCTCTTCAAATGGAGTTTCAAGCTCGAAATCGCATCTCTTGGGATGGTCTCTCTCTCAGCTCCTCTGTTGATAGCAGCGATAGTGACTCATCTCCAGACGTTCGCAAGACCGTCACGGGTAAAAGAAAGCGGGAAACAAGGGTAAAGCTGGAGCATTTCTTGGAGAAGCTTGTGGGGAGTATGATGAAGCGGCAGGAGAAGATGCATAATCAGTTGATTAATGTGATGGAGAAGATGGAAGTGGAGAGAATACGCCGTGAGGAAGCTTGGAGGCAACAGGAAACCGAGAGGATGACACAGAATGAAGAAGCACGGAAGCAAGAGATGGCACGCAACTTGTCTCTCATCTCTTTCATCAGAAGTGTTACTGGTGACGAGATCGAGATCCCTAAACAGTGTGAATTCCCGCAACCACTCCAGCAGATTCTTCCGGAACAATGTAAAGACGAGAAATGTGAATCCGCTCAGAGAGAAAGAGAGATAAAGTTTAGGTACTCAAGCGGCAGTGGCAGCAGTGGTAGAAGGTGGCCGCAAGAGGAAGTGCAGGCATTGATAAGTTCGAGAAGCGATGTGGAAGAGAAGACGGGGATCAACAAGGGAGCGATTTGGGATGAGATATCAGCAAGAATGAAAGAAAGAGGGTACGAAAGATCTGCGAAAAAGTGTAAGGAGAAGTGGGAGAACATGAACAAGTACTATAGGAGAGTGACGGAAGGTGGGCAGAAACAGCCTGAGCACAGCAAGACTCGCTCATACTTTGAGAAACTTGGAAATTTTTACAAGACCATTTCCTCGGGAGAGAGGGAAAAATGAGTGAAAGATTTTAAATTTAGGTGTTTTTGGCACGCAAAACGGGAGAACTTGTAGATGATTACCTCGAGTTTAATTTTTATATCTTTGGTGTAGTTTATAATTTAAAACTCTACGGCTCTGTATTTGTAGAAGGTTCGAAT

SEQ ID NO: 2461 - DNA, 1929 bp, Arabidopsis thaliana
  misc_feature (1)..(1929): Ceres cDNA ID no. 13605751
  misc_feature (1)..(1929): Also known as  Ceres CDNA ID no. 23827422
gtcactgtcgacgaccactgcgtttcacactactctctctctcgctctctccaccgttaaacttcaatacccatttgtcatttcccccaaatctctccgatttcttaaatctaatttggatttactttgcctgtaaaaccattcgcattgttacgcatccgattttgcagttcgaaactcgagttcaacttcaatttgaggtagatttcgagaaaaagctgaagaatttcggaacaactaagattttaacggtggaattggggagtcttgaagcttatttttcctcctggtctcttttttcttatgtggtggtgcttgagagggtttttgtatgatataaatgctctagatcagagaaaaggtctaacatgaagttatcaaatattccgcaacgctatgtaatagtcttcttaactttcctcagcacatgtgtgtgttacatagagcgtgttggcttctctattgcatataccgttgctgctgatgctgctgggatcaatcaatcgagtaaaggaaccatactttctacattctttgttggctatgcatgttctcaagtccctggaggttgggcagctcagaaaattgggggaaggaaagttcttcttctgtcgtttgttttatggtcatcgacgtgtttcttggttccacttgatccaaacagagtcgggcttttggttgttgcccgtttacttgttggtgttgctcaaggtttcatctttccctctatccacacagttttggctcagtgggttcctcctcatgaaaggtctagattggtttcgataacgacatcaggaatgtatttaggtgcagctttaggaatgtggcttctccctgctttagttgagcttagaggtccggaatcagttttcttagcagaggcattagcaggtgttatatggtcattgctttggattaggtacgctactgacccacctcgatctgagcatccaaaagctgctgctgctggattcggaggtgctctgttaccgactaatgtaaaccaccataaagttactcatatcccgtggaagaaaatcatgctcagtttacccgtttgggcgattgtggttaacaatttcacattccattacgctttatatgtgttgatgaactggcttccaacgtatttcgagcttggactccagatcagtcttcaggggatggattcatcaaagatggtgccatacctcaacatgtttgtattctccattgttggtgggttcatcgcagactatttgatcaccaagagaatactctcggtaaccagaacccgcaagttcttgaacacagttgggttcctaattgcttcagcggcattgatggtcttacccatgtttagaacagaaaatggtgtgatcttatgttcctcagtggctcttgggtttttggcattaggaagagccggttttgcggtgaaccatatggatattgctccaagatatgcaggaatagtgatgggagtttcaaatactgctgggacattagctggaatcattggtgttgatttgactggaaagcttcttgaagcttctaaattggtttactcagatttgtcacatccagagagctggagagttgtgttcttcatcccgggtttgctctgtatctttagctctgttgtgtttctgctgttttctactggagaaaggatctttgattgaggaaagaaaaaaagatcaaaacttttagagaaacccttatcaagattagttagtaaaagcctgaatcgaagatcgattgattcggtaattgcggaattttgtgggaaatgtcgtttttgtgtgtgtagtaaagatcttttgagtgatggttttgaaatattgtcttcaggctcattggtattctttttttggtgaataaacttgatcacaccaaagagtattattggttgatctttcaatatatactatgaataaagaatcg

SEQ ID NO: 2462 - protein, 1929 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
GTCACTGTCGACGACCACTGCGTTTCACACTACTCTCTCTCTCGCTCTCTCCACCGTTAAACTTCAATACCCATTTGTCATTTCCCCCAAATCTCTCCGATTTCTTAAATCTAATTTGGATTTACTTTGCCTGTAAAACCATTCGCATTGTTACGCATCCGATTTTGCAGTTCGAAACTCGAGTTCAACTTCAATTTGAGGTAGATTTCGAGAAAAAGCTGAAGAATTTCGGAACAACTAAGATTTTAACGGTGGAATTGGGGAGTCTTGAAGCTTATTTTTCCTCCTGGTCTCTTTTTTCTTATGTGGTGGTGCTTGAGAGGGTTTTTGTATGATATAAATGCTCTAGATCAGAGAAAAGGTCTAACATGAAGTTATCAAATATTCCGCAACGCTATGTAATAGTCTTCTTAACTTTCCTCAGCACATGTGTGTGTTACATAGAGCGTGTTGGCTTCTCTATTGCATATACCGTTGCTGCTGATGCTGCTGGGATCAATCAATCGAGTAAAGGAACCATACTTTCTACATTCTTTGTTGGCTATGCATGTTCTCAAGTCCCTGGAGGTTGGGCAGCTCAGAAAATTGGGGGAAGGAAAGTTCTTCTTCTGTCGTTTGTTTTATGGTCATCGACGTGTTTCTTGGTTCCACTTGATCCAAACAGAGTCGGGCTTTTGGTTGTTGCCCGTTTACTTGTTGGTGTTGCTCAAGGTTTCATCTTTCCCTCTATCCACACAGTTTTGGCTCAGTGGGTTCCTCCTCATGAAAGGTCTAGATTGGTTTCGATAACGACATCAGGAATGTATTTAGGTGCAGCTTTAGGAATGTGGCTTCTCCCTGCTTTAGTTGAGCTTAGAGGTCCGGAATCAGTTTTCTTAGCAGAGGCATTAGCAGGTGTTATATGGTCATTGCTTTGGATTAGGTACGCTACTGACCCACCTCGATCTGAGCATCCAAAAGCTGCTGCTGCTGGATTCGGAGGTGCTCTGTTACCGACTAATGTAAACCACCATAAAGTTACTCATATCCCGTGGAAGAAAATCATGCTCAGTTTACCCGTTTGGGCGATTGTGGTTAACAATTTCACATTCCATTACGCTTTATATGTGTTGATGAACTGGCTTCCAACGTATTTCGAGCTTGGACTCCAGATCAGTCTTCAGGGGATGGATTCATCAAAGATGGTGCCATACCTCAACATGTTTGTATTCTCCATTGTTGGTGGGTTCATCGCAGACTATTTGATCACCAAGAGAATACTCTCGGTAACCAGAACCCGCAAGTTCTTGAACACAGTTGGGTTCCTAATTGCTTCAGCGGCATTGATGGTCTTACCCATGTTTAGAACAGAAAATGGTGTGATCTTATGTTCCTCAGTGGCTCTTGGGTTTTTGGCATTAGGAAGAGCCGGTTTTGCGGTGAACCATATGGATATTGCTCCAAGATATGCAGGAATAGTGATGGGAGTTTCAAATACTGCTGGGACATTAGCTGGAATCATTGGTGTTGATTTGACTGGAAAGCTTCTTGAAGCTTCTAAATTGGTTTACTCAGATTTGTCACATCCAGAGAGCTGGAGAGTTGTGTTCTTCATCCCGGGTTTGCTCTGTATCTTTAGCTCTGTTGTGTTTCTGCTGTTTTCTACTGGAGAAAGGATCTTTGATTGAGGAAAGAAAAAAAGATCAAAACTTTTAGAGAAACCCTTATCAAGATTAGTTAGTAAAAGCCTGAATCGAAGATCGATTGATTCGGTAATTGCGGAATTTTGTGGGAAATGTCGTTTTTGTGTGTGTAGTAAAGATCTTTTGAGTGATGGTTTTGAAATATTGTCTTCAGGCTCATTGGTATTCTTTTTTTGGTGAATAAACTTGATCACACCAAAGAGTATTATTGGTTGATCTTTCAATATATACTATGAATAAAGAATCG

SEQ ID NO: 2463 - DNA, 2658 bp, Arabidopsis thaliana
  misc_feature (1)..(2658): Ceres cDNA ID no. 13606003
  misc_feature (1)..(2658): Also known as  Ceres CDNA ID no. 23827422
gaagagaatccgatgcgtagaagactatcttccgtgctaatcaacaatcagtgcatcgcgtcccaacgccattaccacacatctcgacctgagaaacccacaaagaaagccagcagccatgaaccaactcacaaattcaccaggaagccatgggaggaagtgccatttctcaccgatctcaaagaaatcgaagacccagaggaagctctttctctcttccaccaataccaggaaatgggtttccgacacgactacccatcttactcttctctcatctacaagcttgcaaagtcccgtaacttcgacgccgtcgaccaaattctccgccttgttcgctatcgaaacgtccggtgcagagaatccctcttcatgggattgattcagcattacgggaaagccggttcggtcgacaaagccatcgatgttttccacaaaatcacctcctttgattgtgttcgcacgattcagtctctcaacactctcatcaacgttctggtcgataacggcgagttggaaaaggccaaaagctttttcgacggggcaaaggatatgcgtttgcgtcccaattcggtgtctttcaatattttgatcaaaggatttcttgataaatgcgattgggaagctgcatgtaaggtgttcgacgaaatgcttgagatggaggtgcaaccgagtgttgtgacatacaatagcctgattggtttcttatgccgaaatgacgatatgggtaaggcgaagagcttgcttgaagatatgattaagaaaagaatacgtccgaatgctgtgacatttgggttgttaatgaaaggtttatgttgtaagggagagtacaatgaagcaaagaagttgatgttcgatatggagtatcgtgggtgtaaaccgggtctcgttaactacggaattttgatgagtgatcttgggaagagagggagaattgatgaggcaaagcttctactcggcgagatgaagaaaagacggataaaaccagatgttgtgatctataacattctggtaaaccatctttgcactgagtgtagagtccctgaggcttatagagtgctgacggaaatgcagatgaaagggtgtaaaccaaatgcagctacataccgtatgatgattgatgggttttgtcgtatcgaggattttgattcagggttgaatgttttgaatgcaatgcttgcaagcagacactgtcccacacctgcaacgtttgtatgtatggttgctgggctgattaaaggcggtaacttggaccatgcttgctttgtgttagaggtgatgggaaagaaaaacttaagttttgggtctggtgcttggcaaaatctactttctgatctctgcatcaaggatggaggagtatattgtgaggctttgtcagaagtaatttccatctaagcaatgacctttttaaaggctgcaaagtactcttcttcctgattttagctctcgccattacttttgtctcagctgctcggcttcttgatgaagaagaagatattgggttggtccctttgcctaccacgagtcctggtcctttaccaacagttggttttaggcccctttcccactgctaattcaggccctgcaactggtatcgcttcaggtacaggttcagcctcagggggtttaggttccttgggtaccaatactggccccgggcctctatcgaccactggttctagtcttttaccagttgctagttcgggtaccttgcctgttactggccccggtcctctaccaaccagttctggtctcttaccgggtgctagttcgggtaacttgcctggttcaggttcagggcctttgcctactgttggttcaggtgctgcagctacgggtctgggcgcaggtgcagggtcagtgattggtggttcagttcctgacaacactttggttttcttcatgcacgatatactcggtggctcaaacccgacagcgagggctgtgactggagtcgtcgcaaacgcagccctcagtggccaaattccattcgctaagcccaatggtgcaaacctccctgttagtaacggcgttccatcagacaataacaacaatggaatcctgaacaataacaacgtcccacttctcgtcgggcttggcggaaccacttccaacattctacagaacaatggaaacaacatgttgaacggtcttcccgtggctaacggcggccagctcccatcgggttcgtctcttcagatgctcatgtttgggacattgacggtgatggacaacgaactaaccgaaggacacgaactcgggtctggtctgctgggtaaagcccaaggcttctacgtggcaagtgcccttgatgggaccagccagactatggctttcacggctatgtttgagagcggtggatatgaagatagcatcagtttcttcggtgtgcatagaacagctgcatcggaatctcatcttggggtaatgggcggtactggtaagtatgtgaatgcgagaggcttcgcaattgtcaagacttttacgggttcctccgggacccagcagcagcagccgcaccagttcacagatgggctcgagactgttctggagtgcaccgtttatctttcttactagtttcttttccctcttctcttatcttttttgtctaccaagaaaacgtgaaaacctattaatttgacaaccaatcccttgttattc

SEQ ID NO: 2464 - protein, 2658 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
GAAGAGAATCCGATGCGTAGAAGACTATCTTCCGTGCTAATCAACAATCAGTGCATCGCGTCCCAACGCCATTACCACACATCTCGACCTGAGAAACCCACAAAGAAAGCCAGCAGCCATGAACCAACTCACAAATTCACCAGGAAGCCATGGGAGGAAGTGCCATTTCTCACCGATCTCAAAGAAATCGAAGACCCAGAGGAAGCTCTTTCTCTCTTCCACCAATACCAGGAAATGGGTTTCCGACACGACTACCCATCTTACTCTTCTCTCATCTACAAGCTTGCAAAGTCCCGTAACTTCGACGCCGTCGACCAAATTCTCCGCCTTGTTCGCTATCGAAACGTCCGGTGCAGAGAATCCCTCTTCATGGGATTGATTCAGCATTACGGGAAAGCCGGTTCGGTCGACAAAGCCATCGATGTTTTCCACAAAATCACCTCCTTTGATTGTGTTCGCACGATTCAGTCTCTCAACACTCTCATCAACGTTCTGGTCGATAACGGCGAGTTGGAAAAGGCCAAAAGCTTTTTCGACGGGGCAAAGGATATGCGTTTGCGTCCCAATTCGGTGTCTTTCAATATTTTGATCAAAGGATTTCTTGATAAATGCGATTGGGAAGCTGCATGTAAGGTGTTCGACGAAATGCTTGAGATGGAGGTGCAACCGAGTGTTGTGACATACAATAGCCTGATTGGTTTCTTATGCCGAAATGACGATATGGGTAAGGCGAAGAGCTTGCTTGAAGATATGATTAAGAAAAGAATACGTCCGAATGCTGTGACATTTGGGTTGTTAATGAAAGGTTTATGTTGTAAGGGAGAGTACAATGAAGCAAAGAAGTTGATGTTCGATATGGAGTATCGTGGGTGTAAACCGGGTCTCGTTAACTACGGAATTTTGATGAGTGATCTTGGGAAGAGAGGGAGAATTGATGAGGCAAAGCTTCTACTCGGCGAGATGAAGAAAAGACGGATAAAACCAGATGTTGTGATCTATAACATTCTGGTAAACCATCTTTGCACTGAGTGTAGAGTCCCTGAGGCTTATAGAGTGCTGACGGAAATGCAGATGAAAGGGTGTAAACCAAATGCAGCTACATACCGTATGATGATTGATGGGTTTTGTCGTATCGAGGATTTTGATTCAGGGTTGAATGTTTTGAATGCAATGCTTGCAAGCAGACACTGTCCCACACCTGCAACGTTTGTATGTATGGTTGCTGGGCTGATTAAAGGCGGTAACTTGGACCATGCTTGCTTTGTGTTAGAGGTGATGGGAAAGAAAAACTTAAGTTTTGGGTCTGGTGCTTGGCAAAATCTACTTTCTGATCTCTGCATCAAGGATGGAGGAGTATATTGTGAGGCTTTGTCAGAAGTAATTTCCATCTAAGCAATGACCTTTTTAAAGGCTGCAAAGTACTCTTCTTCCTGATTTTAGCTCTCGCCATTACTTTTGTCTCAGCTGCTCGGCTTCTTGATGAAGAAGAAGATATTGGGTTGGTCCCTTTGCCTACCACGAGTCCTGGTCCTTTACCAACAGTTGGTTTTAGGCCCCTTTCCCACTGCTAATTCAGGCCCTGCAACTGGTATCGCTTCAGGTACAGGTTCAGCCTCAGGGGGTTTAGGTTCCTTGGGTACCAATACTGGCCCCGGGCCTCTATCGACCACTGGTTCTAGTCTTTTACCAGTTGCTAGTTCGGGTACCTTGCCTGTTACTGGCCCCGGTCCTCTACCAACCAGTTCTGGTCTCTTACCGGGTGCTAGTTCGGGTAACTTGCCTGGTTCAGGTTCAGGGCCTTTGCCTACTGTTGGTTCAGGTGCTGCAGCTACGGGTCTGGGCGCAGGTGCAGGGTCAGTGATTGGTGGTTCAGTTCCTGACAACACTTTGGTTTTCTTCATGCACGATATACTCGGTGGCTCAAACCCGACAGCGAGGGCTGTGACTGGAGTCGTCGCAAACGCAGCCCTCAGTGGCCAAATTCCATTCGCTAAGCCCAATGGTGCAAACCTCCCTGTTAGTAACGGCGTTCCATCAGACAATAACAACAATGGAATCCTGAACAATAACAACGTCCCACTTCTCGTCGGGCTTGGCGGAACCACTTCCAACATTCTACAGAACAATGGAAACAACATGTTGAACGGTCTTCCCGTGGCTAACGGCGGCCAGCTCCCATCGGGTTCGTCTCTTCAGATGCTCATGTTTGGGACATTGACGGTGATGGACAACGAACTAACCGAAGGACACGAACTCGGGTCTGGTCTGCTGGGTAAAGCCCAAGGCTTCTACGTGGCAAGTGCCCTTGATGGGACCAGCCAGACTATGGCTTTCACGGCTATGTTTGAGAGCGGTGGATATGAAGATAGCATCAGTTTCTTCGGTGTGCATAGAACAGCTGCATCGGAATCTCATCTTGGGGTAATGGGCGGTACTGGTAAGTATGTGAATGCGAGAGGCTTCGCAATTGTCAAGACTTTTACGGGTTCCTCCGGGACCCAGCAGCAGCAGCCGCACCAGTTCACAGATGGGCTCGAGACTGTTCTGGAGTGCACCGTTTATCTTTCTTACTAGTTTCTTTTCCCTCTTCTCTTATCTTTTTTGTCTACCAAGAAAACGTGAAAACCTATTAATTTGACAACCAATCCCTTGTTATTC

SEQ ID NO: 2465 - DNA, 1349 bp, Arabidopsis thaliana
  misc_feature (1)..(1349): Ceres cDNA ID no. 13606028
  misc_feature (1)..(1349): Also known as  Ceres CDNA ID no. 23827422
attcattatatgcacaaataataggttagatttggcttttagctttgcctacatctctttttttcttgtttcatccaaggagaagaaagcccccatggaagccaaagaagaaaccccgtggagctctattttagttccttctgttcaggagatggtgaaggataagatgatcacgaccgttcctcccagatatgttcggtatgatcaagacaaaactgaagtcgtcgtccatgattctggcctcatatccgagatccccatcatcgacatgaatcggttgtgttcttctaccgccgtggactctgaggttgagaaactcgactttgcttgcaaagaatatggatttttccagcttgtaaaccatggaatagacccaagtttcttggacaaaataaagtcagagattcaagatttcttcaaccttcccatggaagaaaaaaagaagttgtggcagacaccagcggtgatggaagggtttggacaagcttttgtggtttcagaagatcagaaactcgactgggcagatttattcttccttataatgcaacctgttcaattacgcaagcgtcacttgttccccaagctacctcttccctttagggatacgttagatatgtattccactcgagtaaagagtatagctaagatcttactagcgaaaatggcgaaagccttgcagatcaagccagaggaggtagaagaaatatttggtgatgatatgatgcagagtatgaggatgaactactatcccccgtgtccacaacctaatctggttacgggtctaattccgcattccgatgcagtcgggctcaccatacttttgcaggtgaatgaagttgacggtctccaaatcaagaaaaatggcaagtggttttttgtcaaacctctccaaaatgctttcattgtcaatgttggggacgtgttagagatcataacgaacgggacataccgaagcatcgagcaccgggcaatggtgaacttggagaaagagaggctctccattgcgacatttcacaacacgggaatggataaagaaattggtccggcgagaagccttgttcaaagacaagaggctgcaaagtttagaagcctgaaaactaaagactacttgaatggcttgttttcccgtgaactcaaaggaaaggcttatcttgatgctatgagaattgaagggaagtgatatcttgtttcccaagaaattctgttttctccaactggtcactgtcgtgttcatattctgtttttccttctctcttatgtctttggttcaaatctgttaaagaaaaaaacgcctgtgaataatacttaataagctcgttcgtcttcgtcaacatacaaaaatatcaact

SEQ ID NO: 2466 - protein, 1349 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATTCATTATATGCACAAATAATAGGTTAGATTTGGCTTTTAGCTTTGCCTACATCTCTTTTTTTCTTGTTTCATCCAAGGAGAAGAAAGCCCCCATGGAAGCCAAAGAAGAAACCCCGTGGAGCTCTATTTTAGTTCCTTCTGTTCAGGAGATGGTGAAGGATAAGATGATCACGACCGTTCCTCCCAGATATGTTCGGTATGATCAAGACAAAACTGAAGTCGTCGTCCATGATTCTGGCCTCATATCCGAGATCCCCATCATCGACATGAATCGGTTGTGTTCTTCTACCGCCGTGGACTCTGAGGTTGAGAAACTCGACTTTGCTTGCAAAGAATATGGATTTTTCCAGCTTGTAAACCATGGAATAGACCCAAGTTTCTTGGACAAAATAAAGTCAGAGATTCAAGATTTCTTCAACCTTCCCATGGAAGAAAAAAAGAAGTTGTGGCAGACACCAGCGGTGATGGAAGGGTTTGGACAAGCTTTTGTGGTTTCAGAAGATCAGAAACTCGACTGGGCAGATTTATTCTTCCTTATAATGCAACCTGTTCAATTACGCAAGCGTCACTTGTTCCCCAAGCTACCTCTTCCCTTTAGGGATACGTTAGATATGTATTCCACTCGAGTAAAGAGTATAGCTAAGATCTTACTAGCGAAAATGGCGAAAGCCTTGCAGATCAAGCCAGAGGAGGTAGAAGAAATATTTGGTGATGATATGATGCAGAGTATGAGGATGAACTACTATCCCCCGTGTCCACAACCTAATCTGGTTACGGGTCTAATTCCGCATTCCGATGCAGTCGGGCTCACCATACTTTTGCAGGTGAATGAAGTTGACGGTCTCCAAATCAAGAAAAATGGCAAGTGGTTTTTTGTCAAACCTCTCCAAAATGCTTTCATTGTCAATGTTGGGGACGTGTTAGAGATCATAACGAACGGGACATACCGAAGCATCGAGCACCGGGCAATGGTGAACTTGGAGAAAGAGAGGCTCTCCATTGCGACATTTCACAACACGGGAATGGATAAAGAAATTGGTCCGGCGAGAAGCCTTGTTCAAAGACAAGAGGCTGCAAAGTTTAGAAGCCTGAAAACTAAAGACTACTTGAATGGCTTGTTTTCCCGTGAACTCAAAGGAAAGGCTTATCTTGATGCTATGAGAATTGAAGGGAAGTGATATCTTGTTTCCCAAGAAATTCTGTTTTCTCCAACTGGTCACTGTCGTGTTCATATTCTGTTTTTCCTTCTCTCTTATGTCTTTGGTTCAAATCTGTTAAAGAAAAAAACGCCTGTGAATAATACTTAATAAGCTCGTTCGTCTTCGTCAACATACAAAAATATCAACT

SEQ ID NO: 2467 - DNA, 1396 bp, Arabidopsis thaliana
  misc_feature (1)..(1396): Ceres cDNA ID no. 13606032
  misc_feature (1)..(1396): Also known as  Ceres CDNA ID no. 23827422
aattcggcacgagccaaacttttgtttcgtccaggaaagaagccgacatggaagcaaaaggggcagcacagtggagctctatcctagttccatccgttcaagagatggttaaggagaagacgatcacgaccgttcctcctaggtacgtccggtctgatcaagacaaaactgaagtcgatgatgattttgatgtgaaaattgagatcccaatcatcgatatgaagcgtttgtgttcttcaaccaccatggattctgaggttgagaaactcgacttcgcttgcaaagagtggggatttttccagcttgtaaaccatggaatagactcaagtttcttggacaaagtaaagtcagagattcaagatttcttcaaccttcccatggaagaaaagaagaagttctggcagcgaccagatgagatagaaggtttcggacaagcttttgtggtttcagaagatcagaaactagattgggcagacttgttcttccataccgtgcaaccagttgaattacgcaagcctcacttgttccccaagctacctcttccctttagagatacactggagatgtattcttctgaagtgcagagcgtagctaagatcttaatagcgaaaatggcaagagccctagagatcaaaccagaggaactggaaaagttgtttgatgatgttgattcggttcaaagtatgaggatgaattactacccaccatgcccacaaccagatcaggttattggtctaaccccgcattctgattcggtcggactcactgtactgatgcaagtgaatgacgttgaaggtctccaaatcaagaaagatgggaaatgggttcctgttaaacccctcccaaatgctttcattgtcaatattggagacgtcttagagatcataactaatgggacataccgaagcatagagcatcgcggagttgtgaattcagagaaagagaggctctctattgcaacgtttcacaatgtgggaatgtataaagaagttggtcctgcaaaaagcctagttgaaagacaaaaggttgcaagattcaaaaggctgaccatgaaagagtataacgatggtttgttctctcgtactctcgacggaaaagcttatctagatgctttgagaatctaaagagagcaatgccttgtcgcccactactctgtttctctgttttcttgatttatgcaataaaacaatctctataatcttatcttcattgtctctctatttgcttcatttcgttaaagacaaaaatctcctgtagagaatgcttctacgtattgctacaataagacaataagtttgttcttagcaaaaaaaaggacaataagtttgttaaagtttcttgacacgttcgttgttgctcaaagatatacctaataatatgatcacatgattcacat

SEQ ID NO: 2468 - protein, 1396 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
AATTCGGCACGAGCCAAACTTTTGTTTCGTCCAGGAAAGAAGCCGACATGGAAGCAAAAGGGGCAGCACAGTGGAGCTCTATCCTAGTTCCATCCGTTCAAGAGATGGTTAAGGAGAAGACGATCACGACCGTTCCTCCTAGGTACGTCCGGTCTGATCAAGACAAAACTGAAGTCGATGATGATTTTGATGTGAAAATTGAGATCCCAATCATCGATATGAAGCGTTTGTGTTCTTCAACCACCATGGATTCTGAGGTTGAGAAACTCGACTTCGCTTGCAAAGAGTGGGGATTTTTCCAGCTTGTAAACCATGGAATAGACTCAAGTTTCTTGGACAAAGTAAAGTCAGAGATTCAAGATTTCTTCAACCTTCCCATGGAAGAAAAGAAGAAGTTCTGGCAGCGACCAGATGAGATAGAAGGTTTCGGACAAGCTTTTGTGGTTTCAGAAGATCAGAAACTAGATTGGGCAGACTTGTTCTTCCATACCGTGCAACCAGTTGAATTACGCAAGCCTCACTTGTTCCCCAAGCTACCTCTTCCCTTTAGAGATACACTGGAGATGTATTCTTCTGAAGTGCAGAGCGTAGCTAAGATCTTAATAGCGAAAATGGCAAGAGCCCTAGAGATCAAACCAGAGGAACTGGAAAAGTTGTTTGATGATGTTGATTCGGTTCAAAGTATGAGGATGAATTACTACCCACCATGCCCACAACCAGATCAGGTTATTGGTCTAACCCCGCATTCTGATTCGGTCGGACTCACTGTACTGATGCAAGTGAATGACGTTGAAGGTCTCCAAATCAAGAAAGATGGGAAATGGGTTCCTGTTAAACCCCTCCCAAATGCTTTCATTGTCAATATTGGAGACGTCTTAGAGATCATAACTAATGGGACATACCGAAGCATAGAGCATCGCGGAGTTGTGAATTCAGAGAAAGAGAGGCTCTCTATTGCAACGTTTCACAATGTGGGAATGTATAAAGAAGTTGGTCCTGCAAAAAGCCTAGTTGAAAGACAAAAGGTTGCAAGATTCAAAAGGCTGACCATGAAAGAGTATAACGATGGTTTGTTCTCTCGTACTCTCGACGGAAAAGCTTATCTAGATGCTTTGAGAATCTAAAGAGAGCAATGCCTTGTCGCCCACTACTCTGTTTCTCTGTTTTCTTGATTTATGCAATAAAACAATCTCTATAATCTTATCTTCATTGTCTCTCTATTTGCTTCATTTCGTTAAAGACAAAAATCTCCTGTAGAGAATGCTTCTACGTATTGCTACAATAAGACAATAAGTTTGTTCTTAGCAAAAAAAAGGACAATAAGTTTGTTAAAGTTTCTTGACACGTTCGTTGTTGCTCAAAGATATACCTAATAATATGATCACATGATTCACAT

SEQ ID NO: 2469 - DNA, 1612 bp, Arabidopsis thaliana
  misc_feature (1)..(1612): Ceres cDNA ID no. 13606952
  misc_feature (1)..(1612): Also known as  Ceres CDNA ID no. 23827422
atggccgatcaaatctccggcgagaagccggccggagttaatagattcgctcttcaatgtgctatcgtcgcctccatcgtctccatcatctttggttacgatactggtgttatgagtggagcgatggtgtttatagaagaagatttgaagacaaacgacgttcaaatagaagttctcactggaattctcaacctttgtgcccttgtcggatcattgctcgccggaagaacgtcggacataatcggacggcgttacacaatcgtcttggcctcaatactattcatgttaggctcaatattgatgggttggggtccgaattatccggttctcctatccggtagatgcaccgctggactcggagtcggttttgctctgatggttgctccggtttactctgccgagatcgcaactgcttcacatagaggactcttagcttctcttcctcacctttgtatcagtatagggattttactaggttatatcgtgaattacttcttctccaagttacctatgcatatcggttggagactcatgctcggtatagccgcggttccgtccctagtgctagcgttcgggatcttgaaaatgccggaatctccacggtggttgattatgcaaggccgtcttaaggaaggcaaggagatattggaattggtatctaattcccctgaagaagcagaactccgctttcaagacatcaaagctgctgcgggaatcgacccgaaatgcgtagacgatgttgtgaaaatggagggtaagaagactcatggtgaaggagtgtggaaagagctcattctaagaccaactcctgcagtgagacgtgttcttttaactgctcttgggattcatttcttccaacacgcctccggaatcgaagcagtgcttttatacggtccgaggatctttaagaaagcaggaatcacgactaaagacaagcttttcttggttactatcggtgtcggaatcatgaaaacgacgtttattttcactgcgactttattgttagacaaggtaggtcgaaggaagcttttgttgaccagcgttggaggaatggtcattgcgttgacaatgttgggatttgggcttacaatggcccaaaatgctggcgggaaattagcgtgggctttagtactgagcatagttgcggcttatagtttcgtggcgtttttctctattgggctcggcccaataacttgggtctacagttctgaggttttcccgttgaagcttagggcacaaggagcgagtctcggcgttgcggtgaacagagtaatgaacgccaccgtgtcgatgtcgtttttgtcgttgactagtgcgataaccaccggtggagctttctttatgttcgccggagttgcggcagtggcgtggaatttcttcttcttcctcttgccggagacgaaaggaaaatcacttgaagaaatcgaagcgctttttcaaagagacggtgataaagtacgcggcgaaaacggtgcagcttagcatgatgaatataatgttatcattaaatgaaacgacagcgtttggggtttctcactcattacacgacgtcgtttagttgtacttttgtgtggcttttatcaaattataaatcaacggtcaagattgacgc

SEQ ID NO: 2470 - protein, 1612 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATGGCCGATCAAATCTCCGGCGAGAAGCCGGCCGGAGTTAATAGATTCGCTCTTCAATGTGCTATCGTCGCCTCCATCGTCTCCATCATCTTTGGTTACGATACTGGTGTTATGAGTGGAGCGATGGTGTTTATAGAAGAAGATTTGAAGACAAACGACGTTCAAATAGAAGTTCTCACTGGAATTCTCAACCTTTGTGCCCTTGTCGGATCATTGCTCGCCGGAAGAACGTCGGACATAATCGGACGGCGTTACACAATCGTCTTGGCCTCAATACTATTCATGTTAGGCTCAATATTGATGGGTTGGGGTCCGAATTATCCGGTTCTCCTATCCGGTAGATGCACCGCTGGACTCGGAGTCGGTTTTGCTCTGATGGTTGCTCCGGTTTACTCTGCCGAGATCGCAACTGCTTCACATAGAGGACTCTTAGCTTCTCTTCCTCACCTTTGTATCAGTATAGGGATTTTACTAGGTTATATCGTGAATTACTTCTTCTCCAAGTTACCTATGCATATCGGTTGGAGACTCATGCTCGGTATAGCCGCGGTTCCGTCCCTAGTGCTAGCGTTCGGGATCTTGAAAATGCCGGAATCTCCACGGTGGTTGATTATGCAAGGCCGTCTTAAGGAAGGCAAGGAGATATTGGAATTGGTATCTAATTCCCCTGAAGAAGCAGAACTCCGCTTTCAAGACATCAAAGCTGCTGCGGGAATCGACCCGAAATGCGTAGACGATGTTGTGAAAATGGAGGGTAAGAAGACTCATGGTGAAGGAGTGTGGAAAGAGCTCATTCTAAGACCAACTCCTGCAGTGAGACGTGTTCTTTTAACTGCTCTTGGGATTCATTTCTTCCAACACGCCTCCGGAATCGAAGCAGTGCTTTTATACGGTCCGAGGATCTTTAAGAAAGCAGGAATCACGACTAAAGACAAGCTTTTCTTGGTTACTATCGGTGTCGGAATCATGAAAACGACGTTTATTTTCACTGCGACTTTATTGTTAGACAAGGTAGGTCGAAGGAAGCTTTTGTTGACCAGCGTTGGAGGAATGGTCATTGCGTTGACAATGTTGGGATTTGGGCTTACAATGGCCCAAAATGCTGGCGGGAAATTAGCGTGGGCTTTAGTACTGAGCATAGTTGCGGCTTATAGTTTCGTGGCGTTTTTCTCTATTGGGCTCGGCCCAATAACTTGGGTCTACAGTTCTGAGGTTTTCCCGTTGAAGCTTAGGGCACAAGGAGCGAGTCTCGGCGTTGCGGTGAACAGAGTAATGAACGCCACCGTGTCGATGTCGTTTTTGTCGTTGACTAGTGCGATAACCACCGGTGGAGCTTTCTTTATGTTCGCCGGAGTTGCGGCAGTGGCGTGGAATTTCTTCTTCTTCCTCTTGCCGGAGACGAAAGGAAAATCACTTGAAGAAATCGAAGCGCTTTTTCAAAGAGACGGTGATAAAGTACGCGGCGAAAACGGTGCAGCTTAGCATGATGAATATAATGTTATCATTAAATGAAACGACAGCGTTTGGGGTTTCTCACTCATTACACGACGTCGTTTAGTTGTACTTTTGTGTGGCTTTTATCAAATTATAAATCAACGGTCAAGATTGACGC

SEQ ID NO: 2471 - DNA, 1223 bp, Arabidopsis thaliana
  misc_feature (1)..(1223): Ceres cDNA ID no. 13606999
  misc_feature (1)..(1223): Also known as  Ceres CDNA ID no. 23827422
agtccctctctaaacgcataatcttacaataaaatggtgaaactcgcgacggcgcgtgagattagaacgtacggccctcggcttgggaggagcagagccgagtacatcaacgcaggtctatacttgtttgcaaccgtggtgctcatcggcggtttcacagcgacaggattctcatgggaaccaagatccggcctcgtccttattctcttagctctcgttcttataaccgccgtgaatgttcatgatcttgtggctcatctagctggaatcgattaccggttaaggttaatggagtatgatttgcaactggggctagtggaatttgcagtccctctggttcagatagcgggttcggtagtgtttttcttgggaatctttttcgtcttccatcaggctgagacaaaacgtggatacagtggaagagagcatcatgcattaaacttgctgatagcgggtccgttactttggttgataggatcgattcacaactcatgccaaatctacgagagagcggatagtcatgttcaaattctacagcagtgtgtttacattcctttcttggttggatcccttctattcttggtttccgcagttctcaatagcctcgacatatccgggtcatctcgtagtggattgaagcttcttggggaaagatggatttggcttgggatttccggggctatatgtttgtttgtgggaggattgctgaacgttgttaaggtttttaacttcgtccagatctctgggctccgcctcgagaaactacggggtggagctcaagaccgacttcttgaagggagagaaggatatctccctcttgttgctgaagaagaaagaataaggaaaatggaagctgatcacgaagcttctagtagagccaaaccccgggcacacacaacctccaaagccggagagggagctacagagaccgtggtggtatcatctccgacaccatacaaggatgttctcgttggacagatctgaggaagattagtcatgtttaaatgttcttttgtactccatatttgtttttagctgcggagaccacatattttgccgttcaacatatgttatgtgattcgtttcctttttggtcagtctttatgaatattgaaataggttacaatacatcaagactttagaagaagatttgtacactagaagaatattgatcttctttatgaataatgaaatagggtctttatacctatttctatttgacc

SEQ ID NO: 2472 - protein, 1223 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
AGTCCCTCTCTAAACGCATAATCTTACAATAAAATGGTGAAACTCGCGACGGCGCGTGAGATTAGAACGTACGGCCCTCGGCTTGGGAGGAGCAGAGCCGAGTACATCAACGCAGGTCTATACTTGTTTGCAACCGTGGTGCTCATCGGCGGTTTCACAGCGACAGGATTCTCATGGGAACCAAGATCCGGCCTCGTCCTTATTCTCTTAGCTCTCGTTCTTATAACCGCCGTGAATGTTCATGATCTTGTGGCTCATCTAGCTGGAATCGATTACCGGTTAAGGTTAATGGAGTATGATTTGCAACTGGGGCTAGTGGAATTTGCAGTCCCTCTGGTTCAGATAGCGGGTTCGGTAGTGTTTTTCTTGGGAATCTTTTTCGTCTTCCATCAGGCTGAGACAAAACGTGGATACAGTGGAAGAGAGCATCATGCATTAAACTTGCTGATAGCGGGTCCGTTACTTTGGTTGATAGGATCGATTCACAACTCATGCCAAATCTACGAGAGAGCGGATAGTCATGTTCAAATTCTACAGCAGTGTGTTTACATTCCTTTCTTGGTTGGATCCCTTCTATTCTTGGTTTCCGCAGTTCTCAATAGCCTCGACATATCCGGGTCATCTCGTAGTGGATTGAAGCTTCTTGGGGAAAGATGGATTTGGCTTGGGATTTCCGGGGCTATATGTTTGTTTGTGGGAGGATTGCTGAACGTTGTTAAGGTTTTTAACTTCGTCCAGATCTCTGGGCTCCGCCTCGAGAAACTACGGGGTGGAGCTCAAGACCGACTTCTTGAAGGGAGAGAAGGATATCTCCCTCTTGTTGCTGAAGAAGAAAGAATAAGGAAAATGGAAGCTGATCACGAAGCTTCTAGTAGAGCCAAACCCCGGGCACACACAACCTCCAAAGCCGGAGAGGGAGCTACAGAGACCGTGGTGGTATCATCTCCGACACCATACAAGGATGTTCTCGTTGGACAGATCTGAGGAAGATTAGTCATGTTTAAATGTTCTTTTGTACTCCATATTTGTTTTTAGCTGCGGAGACCACATATTTTGCCGTTCAACATATGTTATGTGATTCGTTTCCTTTTTGGTCAGTCTTTATGAATATTGAAATAGGTTACAATACATCAAGACTTTAGAAGAAGATTTGTACACTAGAAGAATATTGATCTTCTTTATGAATAATGAAATAGGGTCTTTATACCTATTTCTATTTGACC

SEQ ID NO: 2473 - DNA, 1060 bp, Arabidopsis thaliana
  misc_feature (1)..(1060): Ceres cDNA ID no. 13607014
  misc_feature (1)..(1060): Also known as  Ceres CDNA ID no. 23827422
atggattccgaaatcgcattcgactattctccgaggtttcgtatattcaagaacggtggcatcgaacgcctcgtacccgaaacattcgtcccaccgtcactaaatcccgaaaacggcgtcgtatctaaagatgccgtctattcaccggagaaaaacctctctctccgcatttacctccctcaaaattccgtctatgaaaccggcgagaagaaaatcccactactcgtctactttcatggcggaggattcatcatggaaacagctttctctccaatttaccacacttttctcacatcggcagtttcagccaccgattgcatcgctgtctcagtagaataccgtcgtgcacctgagcatccgattccaaccttgtacgaagattcatgggacgcgattcaatggatcttcactcatatcacaagatctggtcctgaagattggctaaacaaacacgccgatttcagtaaagtctttctcgccggagatagcgccggagctaacatcgcgcatcacatggcgattagagtagacaaagagaaactccccccggaaaatttcaaaatatcggggatgattctgtttcatccgtatttcttgtcaaaagctttgattgaggagatggaagtggaagcgatgagatattacgaaaggctttggagaatcgcgagtcctgatagtggaaacggtgtggaggatccgtggattaatgtggtcgggtcggatctaaccggattgggttgtaggcgggttttggtgatggtggcgggaaatgatgtgttggctaggggaggttggagttacgtggcggagctggagaagagtggatggatagggaaagtgaaagtgatggagactaaggaagaaggtcacgtttttcatttgagggatcctgattctgagaatgctcgtcgagttttgcgcaattttgcagagtttcttaaagaagaaacattttaagtgacgtcgttcaaatgaaaaatgcataaaatatcggttaccatgtcaatatatactaattaaggtttgtatgtttcatcaaacactaaatcttttattttgt

SEQ ID NO: 2474 - protein, 1060 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATGGATTCCGAAATCGCATTCGACTATTCTCCGAGGTTTCGTATATTCAAGAACGGTGGCATCGAACGCCTCGTACCCGAAACATTCGTCCCACCGTCACTAAATCCCGAAAACGGCGTCGTATCTAAAGATGCCGTCTATTCACCGGAGAAAAACCTCTCTCTCCGCATTTACCTCCCTCAAAATTCCGTCTATGAAACCGGCGAGAAGAAAATCCCACTACTCGTCTACTTTCATGGCGGAGGATTCATCATGGAAACAGCTTTCTCTCCAATTTACCACACTTTTCTCACATCGGCAGTTTCAGCCACCGATTGCATCGCTGTCTCAGTAGAATACCGTCGTGCACCTGAGCATCCGATTCCAACCTTGTACGAAGATTCATGGGACGCGATTCAATGGATCTTCACTCATATCACAAGATCTGGTCCTGAAGATTGGCTAAACAAACACGCCGATTTCAGTAAAGTCTTTCTCGCCGGAGATAGCGCCGGAGCTAACATCGCGCATCACATGGCGATTAGAGTAGACAAAGAGAAACTCCCCCCGGAAAATTTCAAAATATCGGGGATGATTCTGTTTCATCCGTATTTCTTGTCAAAAGCTTTGATTGAGGAGATGGAAGTGGAAGCGATGAGATATTACGAAAGGCTTTGGAGAATCGCGAGTCCTGATAGTGGAAACGGTGTGGAGGATCCGTGGATTAATGTGGTCGGGTCGGATCTAACCGGATTGGGTTGTAGGCGGGTTTTGGTGATGGTGGCGGGAAATGATGTGTTGGCTAGGGGAGGTTGGAGTTACGTGGCGGAGCTGGAGAAGAGTGGATGGATAGGGAAAGTGAAAGTGATGGAGACTAAGGAAGAAGGTCACGTTTTTCATTTGAGGGATCCTGATTCTGAGAATGCTCGTCGAGTTTTGCGCAATTTTGCAGAGTTTCTTAAAGAAGAAACATTTTAAGTGACGTCGTTCAAATGAAAAATGCATAAAATATCGGTTACCATGTCAATATATACTAATTAAGGTTTGTATGTTTCATCAAACACTAAATCTTTTATTTTGT

SEQ ID NO: 2475 - DNA, 1614 bp, Arabidopsis thaliana
  misc_feature (1)..(1614): Ceres cDNA ID no. 13607412
  misc_feature (1)..(1614): Also known as  Ceres CDNA ID no. 23827422
ctagtcctagtcctagtccacgcgcgaatatacaaacgtcttaaagccatttgatagaaccgatttccaagggttttgctcagaaaaaacacagagagagattttggaattcgatgaatagtggtgataccttatcgacgttagctcaatttatctcctcttccgagagatttttccggcgagctgacggtgatgtagtcttttgttattgctgggccaccgtgctcgcacttgtcttcattcttctctaccaattcttcctttcccggaaattccgattcttcagtcatgcttcttcttcttcccctgtcgtctcggtttctcaatctctcagctcccaatcaggaatatctactacacttgtttctgatgaagatctaaagggtctgattcaaaaattgggggaaagaagtgaggatgctgagatatgggaagatgttattaagaaaagcaaccctcgtatctcctacactgctaaatgctgcaaaccaacagatggtagtcccatgaagtatctgagtacaactgtgtttgaggattgctccccagaggttttgagggacttttacatggacaatgaatacaggaaacaatgggacaagactgtggttgagcatgagcaattgcaggttgacagtaatagtgggattgagattggtcgcactataaaaaagtttcccttgttgactccaagggagtatgtattagcgtggaaattgtgggaggggaaggataagttttactgtttcatcaaggaatgtgatcacaatatggtgccgcaacagaggaagtatgtacgtgtaagttatttcagatctggttggcgaattaggaaagttcctggtaggaacgcttgtgagatacacatggttcaccaggaggatgctggattaaatgttgagatggcaaagcttgctttctcaagaggcatatggagttacgtttgtaagatggaaaatgcacttcgcaagtacattgcaaccagtcatcgaccccaagggcccacattatctgctgtaagcttaatgaaaaagattccatcggagttagaaagtcagacagacgacattacaaactcctcgggaactaccactagtggtatgcacacaggtgaaggagccaaacggaagaaactgttgagaaagccttcaaagaaactgatagcaaatggtatgttacttgtgggcggtgccgttggtggtgcaatctgcctgtctcgtggtcactccgccttaggggcaaaggtcgcgttggcttacttcttgtcgaagatgagaaagcgtggagctcaactgagtcaaacttcccaaaacgctggtatttaagtcatgcatagatttggttttgatgaagcatgtgcaacttacttagattaagcttgtgtgatagggagtgtctgtaaaagtgattaaacgtgtgaatagaaaagttctatttctgcaatgtctctgatcacatgagctctggggtcttcaaagttttgtatacgtgtcgtggaagactttatatttgtgttaatgtgaatgtaaaaacttgtattttacagtcaagcccttgtttttctcaccaaatttcagaccaattgaatgaaattgttgtaatttttgtttgttc

SEQ ID NO: 2476 - protein, 1614 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
CTAGTCCTAGTCCTAGTCCACGCGCGAATATACAAACGTCTTAAAGCCATTTGATAGAACCGATTTCCAAGGGTTTTGCTCAGAAAAAACACAGAGAGAGATTTTGGAATTCGATGAATAGTGGTGATACCTTATCGACGTTAGCTCAATTTATCTCCTCTTCCGAGAGATTTTTCCGGCGAGCTGACGGTGATGTAGTCTTTTGTTATTGCTGGGCCACCGTGCTCGCACTTGTCTTCATTCTTCTCTACCAATTCTTCCTTTCCCGGAAATTCCGATTCTTCAGTCATGCTTCTTCTTCTTCCCCTGTCGTCTCGGTTTCTCAATCTCTCAGCTCCCAATCAGGAATATCTACTACACTTGTTTCTGATGAAGATCTAAAGGGTCTGATTCAAAAATTGGGGGAAAGAAGTGAGGATGCTGAGATATGGGAAGATGTTATTAAGAAAAGCAACCCTCGTATCTCCTACACTGCTAAATGCTGCAAACCAACAGATGGTAGTCCCATGAAGTATCTGAGTACAACTGTGTTTGAGGATTGCTCCCCAGAGGTTTTGAGGGACTTTTACATGGACAATGAATACAGGAAACAATGGGACAAGACTGTGGTTGAGCATGAGCAATTGCAGGTTGACAGTAATAGTGGGATTGAGATTGGTCGCACTATAAAAAAGTTTCCCTTGTTGACTCCAAGGGAGTATGTATTAGCGTGGAAATTGTGGGAGGGGAAGGATAAGTTTTACTGTTTCATCAAGGAATGTGATCACAATATGGTGCCGCAACAGAGGAAGTATGTACGTGTAAGTTATTTCAGATCTGGTTGGCGAATTAGGAAAGTTCCTGGTAGGAACGCTTGTGAGATACACATGGTTCACCAGGAGGATGCTGGATTAAATGTTGAGATGGCAAAGCTTGCTTTCTCAAGAGGCATATGGAGTTACGTTTGTAAGATGGAAAATGCACTTCGCAAGTACATTGCAACCAGTCATCGACCCCAAGGGCCCACATTATCTGCTGTAAGCTTAATGAAAAAGATTCCATCGGAGTTAGAAAGTCAGACAGACGACATTACAAACTCCTCGGGAACTACCACTAGTGGTATGCACACAGGTGAAGGAGCCAAACGGAAGAAACTGTTGAGAAAGCCTTCAAAGAAACTGATAGCAAATGGTATGTTACTTGTGGGCGGTGCCGTTGGTGGTGCAATCTGCCTGTCTCGTGGTCACTCCGCCTTAGGGGCAAAGGTCGCGTTGGCTTACTTCTTGTCGAAGATGAGAAAGCGTGGAGCTCAACTGAGTCAAACTTCCCAAAACGCTGGTATTTAAGTCATGCATAGATTTGGTTTTGATGAAGCATGTGCAACTTACTTAGATTAAGCTTGTGTGATAGGGAGTGTCTGTAAAAGTGATTAAACGTGTGAATAGAAAAGTTCTATTTCTGCAATGTCTCTGATCACATGAGCTCTGGGGTCTTCAAAGTTTTGTATACGTGTCGTGGAAGACTTTATATTTGTGTTAATGTGAATGTAAAAACTTGTATTTTACAGTCAAGCCCTTGTTTTTCTCACCAAATTTCAGACCAATTGAATGAAATTGTTGTAATTTTTGTTTGTTC

SEQ ID NO: 2477 - DNA, 1855 bp, Arabidopsis thaliana
  misc_feature (1)..(1855): Ceres cDNA ID no. 13607547
  misc_feature (1)..(1855): Also known as  Ceres CDNA ID no. 23827422
aaatcataaaaacacaagttttcgacagatcaactgttttcttcattacgtgttcttcaatggcgtcacttcactgattctattcctatcaaacccacttacccattcccttttatatgcacaaattctcataaagttttcaattttattccatttttctcggaagccatggaagctgctaatgagcctgttaatggcggatccgtacagatccgaacagagaacaacgaaagacgaaagcttcctaatttcttacaaagcgtcaacatgaaatacgtcaagctaggttatcattacctcattactcatctcttcaagctctgtttggttccattaatggcggttttagtcacagagatctctcgattaacaacagacgatctttaccagatttggcttcatctccaatacaatctcgttgctttcatctttctctctgctttagctatctttggctccaccgtttacatcatgagtcgtcccagatctgtttatctcgttgattactcttgttatcttcctccggagagtcttcaggttaagtatcagaagtttatggatcattctaagttgattgaagatttcaatgagtcatctttagagtttcagaggaagattcttgaacgttctggtttaggagaagagacttatctccctgaagctttacattgtatccctccgaggcctacgatgatggcggctcgtgaggaatctgagcaggtaatgtttggtgctcttgataagcttttcgagaataccaagattaaccctagggatattggtgtgttggttgtgaattgtagcttgtttaatcctacaccttcgttgtcagctatgattgttaacaagtataagcttagagggaatgttaagagttttaaccttggtggaatggggtgtagtgctggtgttatctctatcgatttagctaaagatatgttgcaagttcataggaatacttatgctgttgtggttagtactgagaacattactcagaattggtattttgggaataagaaggctatgttgattccgaattgtttgtttcgtgttggtggttcggcgattttgttgtcgaacaaggggaaagatcgtagacggtctaagtataagcttgttcataccgttaggactcataaaggagctgttgagaaggctttcaactgtgtttaccaagagcaagatgataatgggaagaccggggtttcgttgtcgaaagatcttatggctatagctggggaagctcttaaggcgaatatcactactttaggtcctttggttcttcctataagtgagcagattctgtttttcatgactttggttacgaagaaactgtttaactcgaagctgaagccgtatattccggatttcaagcttgcgtttgatcatttctgtatccatgctggtggtagagctgtgattgatgagcttgagaagaatctgcagctttcgcagactcatgtcgaggcatccagaatgacactgcacagatttggaaacacttcttcgagctcgatttggtatgaactggcttacatagaggctaaaggtaggatgaagaaaggaaaccgggtttggcagattgcttttggaagtgggtttaagtgtaacagtgcagtttgggtggctctaaacaatgtcaagccttcggttagtagtccgtgggaacactgcatcgaccgatatccggttaagctcgacttctgatttaatgaaaaaccatttgtttggttagtcctagtcttactagactctgccttgtttatttttcttcttttctggttaagctcttgtactcttaatgtgacgcttcttgattattactctcgcgttttattctatggcatctttatcc

SEQ ID NO: 2478 - protein, 1855 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
AAATCATAAAAACACAAGTTTTCGACAGATCAACTGTTTTCTTCATTACGTGTTCTTCAATGGCGTCACTTCACTGATTCTATTCCTATCAAACCCACTTACCCATTCCCTTTTATATGCACAAATTCTCATAAAGTTTTCAATTTTATTCCATTTTTCTCGGAAGCCATGGAAGCTGCTAATGAGCCTGTTAATGGCGGATCCGTACAGATCCGAACAGAGAACAACGAAAGACGAAAGCTTCCTAATTTCTTACAAAGCGTCAACATGAAATACGTCAAGCTAGGTTATCATTACCTCATTACTCATCTCTTCAAGCTCTGTTTGGTTCCATTAATGGCGGTTTTAGTCACAGAGATCTCTCGATTAACAACAGACGATCTTTACCAGATTTGGCTTCATCTCCAATACAATCTCGTTGCTTTCATCTTTCTCTCTGCTTTAGCTATCTTTGGCTCCACCGTTTACATCATGAGTCGTCCCAGATCTGTTTATCTCGTTGATTACTCTTGTTATCTTCCTCCGGAGAGTCTTCAGGTTAAGTATCAGAAGTTTATGGATCATTCTAAGTTGATTGAAGATTTCAATGAGTCATCTTTAGAGTTTCAGAGGAAGATTCTTGAACGTTCTGGTTTAGGAGAAGAGACTTATCTCCCTGAAGCTTTACATTGTATCCCTCCGAGGCCTACGATGATGGCGGCTCGTGAGGAATCTGAGCAGGTAATGTTTGGTGCTCTTGATAAGCTTTTCGAGAATACCAAGATTAACCCTAGGGATATTGGTGTGTTGGTTGTGAATTGTAGCTTGTTTAATCCTACACCTTCGTTGTCAGCTATGATTGTTAACAAGTATAAGCTTAGAGGGAATGTTAAGAGTTTTAACCTTGGTGGAATGGGGTGTAGTGCTGGTGTTATCTCTATCGATTTAGCTAAAGATATGTTGCAAGTTCATAGGAATACTTATGCTGTTGTGGTTAGTACTGAGAACATTACTCAGAATTGGTATTTTGGGAATAAGAAGGCTATGTTGATTCCGAATTGTTTGTTTCGTGTTGGTGGTTCGGCGATTTTGTTGTCGAACAAGGGGAAAGATCGTAGACGGTCTAAGTATAAGCTTGTTCATACCGTTAGGACTCATAAAGGAGCTGTTGAGAAGGCTTTCAACTGTGTTTACCAAGAGCAAGATGATAATGGGAAGACCGGGGTTTCGTTGTCGAAAGATCTTATGGCTATAGCTGGGGAAGCTCTTAAGGCGAATATCACTACTTTAGGTCCTTTGGTTCTTCCTATAAGTGAGCAGATTCTGTTTTTCATGACTTTGGTTACGAAGAAACTGTTTAACTCGAAGCTGAAGCCGTATATTCCGGATTTCAAGCTTGCGTTTGATCATTTCTGTATCCATGCTGGTGGTAGAGCTGTGATTGATGAGCTTGAGAAGAATCTGCAGCTTTCGCAGACTCATGTCGAGGCATCCAGAATGACACTGCACAGATTTGGAAACACTTCTTCGAGCTCGATTTGGTATGAACTGGCTTACATAGAGGCTAAAGGTAGGATGAAGAAAGGAAACCGGGTTTGGCAGATTGCTTTTGGAAGTGGGTTTAAGTGTAACAGTGCAGTTTGGGTGGCTCTAAACAATGTCAAGCCTTCGGTTAGTAGTCCGTGGGAACACTGCATCGACCGATATCCGGTTAAGCTCGACTTCTGATTTAATGAAAAACCATTTGTTTGGTTAGTCCTAGTCTTACTAGACTCTGCCTTGTTTATTTTTCTTCTTTTCTGGTTAAGCTCTTGTACTCTTAATGTGACGCTTCTTGATTATTACTCTCGCGTTTTATTCTATGGCATCTTTATCC

SEQ ID NO: 2479 - DNA, 1211 bp, Arabidopsis thaliana
  misc_feature (1)..(1211): Ceres cDNA ID no. 13607785
  misc_feature (1)..(1211): Also known as  Ceres CDNA ID no. 23827422
aaatttcgcaaactaattttttcactttcttcttcgttgatctctctgaaagcttctcttcttcttctcaccatgtctggttatcctccatcaagccaaggttacggttacggcggtaatccaccacctcctcagccaccgtacggatcaaccggcaataaccctcctccgtacggatcatccggcagcaatcctcctcctccgtacggatcatcagcctcctcaccgtacgcagttccctacggagctcagcccgctccttacggtgcaccaccgtcagcaccgtacgcgtctcttccaggagaccataataagccgcacaaagagaaacctcacggcgcctcctacggatctccatctcccggtggctacggtgctcatccatcgtctggaccttccgactacggtggttacggaggagcgccgcagcagtctggacatggaggaggttacggaggagcgccgcagcagtctggacatggaggaggttacggagctcctcctccgcaagcttcttatggaagtccgtttgcgtctctggttccgtcggcgtttcctcccggaacagatccgaacattgtggcttgtttccaagctgcggatcgggacaatagtggattcatcgatgataaggagcttcaaggagctctatcttcgtataatcagagcttcagcataagaactgttcatctccttatgtatctattcaccaacagcaatgtcaggaagattggaccaaaagagtttacttcacttttctttagtcttcagaattggaggtctatctttgagaggtttgataaggacagaagcggtagaatagatacaaacgagctgagagatgcactcatgagccttgggttttctgtttctcctgtgattttggatctgctggtttcaaagtttgacaaaagcggaggcaggaacagggctatcgaatatgacaatttcatcgagtgttgtttgactgtaaaggggctcaccgagaagttcaaggagaaggatacggcgttatcaggctcagctattttcaattacgagaacttcatgctcactgttttaccattcctcgtcgcttgagtgattgtttttttttttttttgttgaccaaagagattgttttctaactctattttctttgtgagcttttggatattttatttgttgtctttttatctttctccggtaagattcagacgtgggtcttcttt

SEQ ID NO: 2480 - protein, 1211 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
AAATTTCGCAAACTAATTTTTTCACTTTCTTCTTCGTTGATCTCTCTGAAAGCTTCTCTTCTTCTTCTCACCATGTCTGGTTATCCTCCATCAAGCCAAGGTTACGGTTACGGCGGTAATCCACCACCTCCTCAGCCACCGTACGGATCAACCGGCAATAACCCTCCTCCGTACGGATCATCCGGCAGCAATCCTCCTCCTCCGTACGGATCATCAGCCTCCTCACCGTACGCAGTTCCCTACGGAGCTCAGCCCGCTCCTTACGGTGCACCACCGTCAGCACCGTACGCGTCTCTTCCAGGAGACCATAATAAGCCGCACAAAGAGAAACCTCACGGCGCCTCCTACGGATCTCCATCTCCCGGTGGCTACGGTGCTCATCCATCGTCTGGACCTTCCGACTACGGTGGTTACGGAGGAGCGCCGCAGCAGTCTGGACATGGAGGAGGTTACGGAGGAGCGCCGCAGCAGTCTGGACATGGAGGAGGTTACGGAGCTCCTCCTCCGCAAGCTTCTTATGGAAGTCCGTTTGCGTCTCTGGTTCCGTCGGCGTTTCCTCCCGGAACAGATCCGAACATTGTGGCTTGTTTCCAAGCTGCGGATCGGGACAATAGTGGATTCATCGATGATAAGGAGCTTCAAGGAGCTCTATCTTCGTATAATCAGAGCTTCAGCATAAGAACTGTTCATCTCCTTATGTATCTATTCACCAACAGCAATGTCAGGAAGATTGGACCAAAAGAGTTTACTTCACTTTTCTTTAGTCTTCAGAATTGGAGGTCTATCTTTGAGAGGTTTGATAAGGACAGAAGCGGTAGAATAGATACAAACGAGCTGAGAGATGCACTCATGAGCCTTGGGTTTTCTGTTTCTCCTGTGATTTTGGATCTGCTGGTTTCAAAGTTTGACAAAAGCGGAGGCAGGAACAGGGCTATCGAATATGACAATTTCATCGAGTGTTGTTTGACTGTAAAGGGGCTCACCGAGAAGTTCAAGGAGAAGGATACGGCGTTATCAGGCTCAGCTATTTTCAATTACGAGAACTTCATGCTCACTGTTTTACCATTCCTCGTCGCTTGAGTGATTGTTTTTTTTTTTTTTTGTTGACCAAAGAGATTGTTTTCTAACTCTATTTTCTTTGTGAGCTTTTGGATATTTTATTTGTTGTCTTTTTATCTTTCTCCGGTAAGATTCAGACGTGGGTCTTCTTT

SEQ ID NO: 2481 - DNA, 1296 bp, Arabidopsis thaliana
  misc_feature (1)..(1296): Ceres cDNA ID no. 13607906
  misc_feature (1)..(1296): Also known as  Ceres CDNA ID no. 23827422
ataaaaatccttatccaaaaaagtgcaacctctttcgccgtagaaaatattccgggaaccatgctccgaagaatcacttgttcttcttcacttgcttcaccctctctcttcctccgcttctttcgccaactccctcgctcttactcctcaccgaccaccatcgccgtctcaggccgcaacattcgccgactatcaactccaaccactcttcgttgcatttgttcacactcttcatctgaaatcatctccgagcatcctccgttcgtcagggtttacaaagacggtcgtatcgaacgtctttccggcaccgaaacagtcccggcttctctaaacccacgaaacgacgtcgtttcaaaagacgttgtctactcaccggggcataacctctccgttcgtctctttctccctcacaaatcaacacaactcgccgccggtaacaaactccctctacttatctacttccacggcggagcttggataaacgaatcccctttctccccaatctaccacaatttcctcacggaggtagttaaatccgctaactgcctcgccgtctcggttcaataccgccgtgcaccggaagatccggttccggctgcctatgaagatacatggtctgctattcaatggattttctcacattcctgtggatctggtgaagaagattggattaacaaatacgctgatttcgaaagagtttttctcgccggagatagtgccggtggtaatatatctcatcacatggctatgagagctggtaaagagaagcttaagcctagaatcaaagggactgtgattgtgcatccagcgatttgggggaaagatccggtcgatgagcacgatgtgcaagatagagagatcagagacggagttgcagaagtttgggagaaaattgtgagtccgaatagtgttgatggagcggatgatccgtggtttaatgtggttggatccgggtcgaatttttccgggatgggatgtgacaaggttttggttgaggtggctgggaaagatgtgttttggcggcaaggattagcttacgcggcgaagctaaagaagagtgggtggaaaggagaggtggaggtgattgaggaagaagatgaagagcattgcttccatctcttaaatccaagttctgaaaatgctcccagcttcatgaagagatttgtggagtttatcactggttaacattgttctttgtgtgacacgaataaattttgatgtaacctttgaatttgatttggttctctatataattatggttaaggaattaaatacaggaatgactcggttgtgact

SEQ ID NO: 2482 - protein, 1296 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATAAAAATCCTTATCCAAAAAAGTGCAACCTCTTTCGCCGTAGAAAATATTCCGGGAACCATGCTCCGAAGAATCACTTGTTCTTCTTCACTTGCTTCACCCTCTCTCTTCCTCCGCTTCTTTCGCCAACTCCCTCGCTCTTACTCCTCACCGACCACCATCGCCGTCTCAGGCCGCAACATTCGCCGACTATCAACTCCAACCACTCTTCGTTGCATTTGTTCACACTCTTCATCTGAAATCATCTCCGAGCATCCTCCGTTCGTCAGGGTTTACAAAGACGGTCGTATCGAACGTCTTTCCGGCACCGAAACAGTCCCGGCTTCTCTAAACCCACGAAACGACGTCGTTTCAAAAGACGTTGTCTACTCACCGGGGCATAACCTCTCCGTTCGTCTCTTTCTCCCTCACAAATCAACACAACTCGCCGCCGGTAACAAACTCCCTCTACTTATCTACTTCCACGGCGGAGCTTGGATAAACGAATCCCCTTTCTCCCCAATCTACCACAATTTCCTCACGGAGGTAGTTAAATCCGCTAACTGCCTCGCCGTCTCGGTTCAATACCGCCGTGCACCGGAAGATCCGGTTCCGGCTGCCTATGAAGATACATGGTCTGCTATTCAATGGATTTTCTCACATTCCTGTGGATCTGGTGAAGAAGATTGGATTAACAAATACGCTGATTTCGAAAGAGTTTTTCTCGCCGGAGATAGTGCCGGTGGTAATATATCTCATCACATGGCTATGAGAGCTGGTAAAGAGAAGCTTAAGCCTAGAATCAAAGGGACTGTGATTGTGCATCCAGCGATTTGGGGGAAAGATCCGGTCGATGAGCACGATGTGCAAGATAGAGAGATCAGAGACGGAGTTGCAGAAGTTTGGGAGAAAATTGTGAGTCCGAATAGTGTTGATGGAGCGGATGATCCGTGGTTTAATGTGGTTGGATCCGGGTCGAATTTTTCCGGGATGGGATGTGACAAGGTTTTGGTTGAGGTGGCTGGGAAAGATGTGTTTTGGCGGCAAGGATTAGCTTACGCGGCGAAGCTAAAGAAGAGTGGGTGGAAAGGAGAGGTGGAGGTGATTGAGGAAGAAGATGAAGAGCATTGCTTCCATCTCTTAAATCCAAGTTCTGAAAATGCTCCCAGCTTCATGAAGAGATTTGTGGAGTTTATCACTGGTTAACATTGTTCTTTGTGTGACACGAATAAATTTTGATGTAACCTTTGAATTTGATTTGGTTCTCTATATAATTATGGTTAAGGAATTAAATACAGGAATGACTCGGTTGTGACT

SEQ ID NO: 2483 - DNA, 1219 bp, Arabidopsis thaliana
  misc_feature (1)..(1219): Ceres cDNA ID no. 13608020
  misc_feature (1)..(1219): Ceres CLONE  ID no. 147556
attctaatcatccccttgaattttccaagttttctccttttgtcttctctaactattttcccttaaaataaaaatccaatttttctttgtttcagtcctctcttctgctcattgatcttttaattaactttgattctctccgtttatggattaaccatttgatcgagataactctccaagaaatcgactgagttcgtaacttgttgttgtctgatcttttaaagattcaaccttttttggtccgatcatggctgttgctgagaatgctggtgtcaaagtggactcttctggtcagaatttagacaacaacaacactgctgcttcagctaccgagacgacaaagccgccatgtcctgatgatgatcaaagccctaaatctgactcatccactcctcttaccatcgattcgactcctgaaactgacgatcggatcaatgagactgctcaaaaggttcagactttaaatgggtttagtggaaatggtgagagagataacaatggagagatcaaagatttggctgatgcgttttctaagcttaatccgatggctcaggagtttgttcctccttctcttgctcgaagtcaatctggggttttgagaaatggattagggtttactaacaattttgcagccccacctaaacttgctgatgggaatgatcattttcctagaaggagaaggagttttggccaagggaagcgaagaatgaacaaaaggacaagcttggctcagaaggatgatgtaatcaggagaactgtatatgtctctgacatcgaccaacaggttacagaggagaacctcgcaggtgtctttattaactgtggacaggttgttgattgtcgtgtatgcggtgatccaaattctgtccttcgtttcgctttcattgaatttaccaatgaagagggagctagagctgctttgagcatgtcgggtactgtgctaggtttttaccctcttaaggttcttccttccaaaacagctattgctcctgttaacccgacttttcttccacgatctgaggatgagcgtgagatgtgcgttaggactgtttactgtaccaacattgacaagcggatcactcaaattgacttgaaaggcttctttgaaatgctttgcggggaggttcatcgtctgaggcttggagactatcaccaccaaacccgtattgcttttgttgagtttgcgatggcggaaagcgcaattgctgcgcttcactgc

SEQ ID NO: 2484 - protein, 324 aa, Arabidopsis thaliana
  misc_feature: PFam Name: RRM_1; PFam Description: RNA recognition motif.
  misc_feature: GI Number: 6714278; NR Description: F6N18.17 [Arabidopsis thaliana] gi|25403416|pir||F86452 protein F6N18.17 [imported] - Arabidopsis thaliana gi|15223304|ref|NP_174556.1| RNA-binding
  misc_feature: GI Number: 1174153; NR Description: RNA-binding protein
  misc_feature: GI Number: 50940511; NR Description: putative RNA-binding protein RBP37 [Oryza sativa (japonica cultivar-group)] >gi|50725622|dbj|BAD33089.1| putative RNA-binding protein RBP37
  misc_feature: GI Number: 50940513; NR Description: putative RNA-binding protein RBP37 [Oryza sativa (japonica cultivar-group)] >gi|50725623|dbj|BAD33090.1| putative RNA-binding protein RBP37
  misc_feature: GI Number: 14030687; NR Description: At1g32790 [Arabidopsis thaliana] >gi|25090128|gb|AAN72236.1| At1g32790/F6N18_9
MAVAENAGVKVDSSGQNLDNNNTAASATETTKPPCPDDDQSPKSDSSTPLTIDSTPETDDRINETAQKVQTLNGFSGNGERDNNGEIKDLADAFSKLNPMAQEFVPPSLARSQSGVLRNGLGFTNNFAAPPKLADGNDHFPRRRRSFGQGKRRMNKRTSLAQKDDVIRRTVYVSDIDQQVTEENLAGVFINCGQVVDCRVCGDPNSVLRFAFIEFTNEEGARAALSMSGTVLGFYPLKVLPSKTAIAPVNPTFLPRSEDEREMCVRTVYCTNIDKRITQIDLKGFFEMLCGEVHRLRLGDYHHQTRIAFVEFAMAESAIAALHC

SEQ ID NO: 2485 - DNA, 3682 bp, Arabidopsis thaliana
  misc_feature (1)..(3682): Ceres cDNA ID no. 13608184
  misc_feature (1)..(3682): Also known as  Ceres CDNA ID no. 23827422
attggctctctatgatttgacatttaagattattgctgcatttaattgtgctaaatcgattctgcactcatgcttcagctactgttctttgtgtccctgtaaatttaagtttttgagatctgaaactataagaaattttccgattttggttctcattagttgttagatctcttatctcactcgaagcttctttttttacgcggtttgatttattaatttcgttacttctctgtaaattctcgatctttagggttcttctcatcccctggtttaataatgggtccaatctcagttcttgttcactctaattttactttcacaatatctccaattacgcagatgctttttgacaaattttctccattaaaagtgtcttcttttttagctgtattaaatttataggtctctctatctgtactggtatagggttcatgattgagtctacaaaaacataatgaatgacctaaaagctattaactttcgtttctagatctgcttgcttctctttaatatcttcacctcattgctctaatagacattaatctccatttgaagttagtattcttttaccagttttactgatttttctttttcattcaggtaactgtgattgttgcaggatcttgtgtagaaacagatcacaagaagatgaatgataactcggtggtgcggctttgattatcttcagagattttagattctgtatccactctgttgcgatggggtcgtttgcaggcgcttgtgagattgtggaagagaaggatgatgaagtaagattgccaaaacattccgggagatatggtaaatcggttatgggatcatcaagtaaggatttggtggagcgtaagcaacgagagtatcatggttctcttgagtatgacattgatatgctttttcagtctatttctgttaaaccatctactacgaggttgatgagttcttctttccatcatcatgagacgagcgcgagtgccggtccaagcaggaccacaagcccttcgaagagaattgcgtccatgaaaaaaccagggacacctcagtctcctagatttgttggtctctctgattcagtttctttgaagcaggctcttagggatcgttgcatttctaaggcgtcggaaatggctgctcagaaacggttgtcgaaatctgctgctgcatctccgagggtctcagaagctgacaggataaagagtttgtataaccaagtttcgaatgaatctactagcagcaggtctgggcttgttcctgtggacaagggtaaaggaagtttggttgagatacctttgatgcctgtaaacgataaaccaagctcttcaaagagcgtacctcaacggtttgaagatccttctaaccccatttctgagccatctcaagctggaaccagttttggattacaaggagtggggaatcaaacgcgggagattaagctgttgcatagatccaacaaacctgggtcttgtcttagttctggcagtggagattatgagatagagttagatgaaaatgttgcgtctccttccactcatgcatttgttgaagatgatgtgatagaaatagacaaacacgttacttcactgccatctcactctagcaagaaagtcaatgcgacggagcttgacaagaatatttcctcatctgctgtagactcagagcagaaagggaagttggatgatgcacctaattcagggacagagaatggcaaaacagtacggaaggtaacaagaatgattccacgtcccaaacaaccgaaaaagaaaattttgcttaagaagaagttaaaaatcggggttgtgtcagcaacttacccaacaaaagacgatgaagaaattgttccttccttggactctagtgccaatcaacttctctgccagagatgtcactgttcgttgaagagcaccagcatcgatgacaacccaccttcatatacttctagtcataatcctaagatttgcacagatagtttgagctctgtttcaaataaagaagctcatcaaggatctgacgaaaactcctctggctcgtgtaatgtcagtcaaagctctgaagctgacattgtcataatgaaacaagatgtttcctctagcaataatagtggaatcggtgcaatggtagaaaaagaaaccgagaatccgacttccagtgagaaattcgagttctctctgagttcaaaagatagtcttggggattatagcaggagcacaagcattagtgaggagagtaatctgagccgatttagctgtgggaataagcctcacatgtcgatggatgtgagatgggaagcgattaagcatatcaaggttcaatacggctctttgggtttacgacacttcaaccttctgaagaaacttggttgtggagatataggaacagtctatctcgccgagctgattggtacaaactgtttgtttgccataaaggttatggacaacgagttcttggcgagaaggaaaaagtctccccgggcacaagcagaaagagaaatacttaaaatgttggaccatccttttcttcctacattatacgcgcaatttacttcggataatttatcttgtctagtcatggaatattgtcctggaggagatcttcatgtcctcagacagaagcagctaggccggtgtttccctgaacctgcagcaagattctatgtggccgaaattctccttgcactggagtacttacacatgcttggtatcatataccgagatctgaaaccggaaaacattcttgtccgtgaagatggacacattatgcttacggattttgacctctcactccgttgtgcagtgaacccgactcttgtcaggtcaaactctccacctggtaaagatcccgcaaggatttcaggtccatacaacacatccaactgcatacaaccattctgtatcaccgaaccatcttgccaggtttcgtgtttcagccctaggctctcctcaaaccaacaacaaggtagaaaaccaaaaaggggtgatcatctttcgaaaacccaacaacacttgagtagatcattgcctcagctcgtggctgaaccaaccgaagcaagatccaattcctttgtgggaacacacgagtacctagccccagagatcatcaaaggagaaggacatggcgctgcagttgactggtggactttcggggttctcctttacgagcttttatacgggaaaacaccattcaaaggttacaacaacgacgagactttggccaatgttgtgttacagaacctcaagtttcctgatagcccgcttgtaagcttccaggcaaaagacttgatcaggggacttcttgttaaggaaccagagaacaggctcgggtcagagaaaggttctgtagagatcaaaagacatcctttttttgaaggattgaattgggctctgatccggtgtgcaatcccgcctgagctaccggatttctatgagtatggtggtggaccagaggcagcggcggattcgcctggaggcagtaataataggtatcttgaatgtaaagccataggcgatcatcttgagttcgagttgttttaagcaagacatagatattctctggtataagcattcagagtaatcgttgttgtaagttattatatctaagttaaatctaaatgtcttatatgtaaatttagcgttctctgagacataatctgatatagtattctcaaaaaaggtaaatctcagagagatct

SEQ ID NO: 2486 - protein, 3682 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATTGGCTCTCTATGATTTGACATTTAAGATTATTGCTGCATTTAATTGTGCTAAATCGATTCTGCACTCATGCTTCAGCTACTGTTCTTTGTGTCCCTGTAAATTTAAGTTTTTGAGATCTGAAACTATAAGAAATTTTCCGATTTTGGTTCTCATTAGTTGTTAGATCTCTTATCTCACTCGAAGCTTCTTTTTTTACGCGGTTTGATTTATTAATTTCGTTACTTCTCTGTAAATTCTCGATCTTTAGGGTTCTTCTCATCCCCTGGTTTAATAATGGGTCCAATCTCAGTTCTTGTTCACTCTAATTTTACTTTCACAATATCTCCAATTACGCAGATGCTTTTTGACAAATTTTCTCCATTAAAAGTGTCTTCTTTTTTAGCTGTATTAAATTTATAGGTCTCTCTATCTGTACTGGTATAGGGTTCATGATTGAGTCTACAAAAACATAATGAATGACCTAAAAGCTATTAACTTTCGTTTCTAGATCTGCTTGCTTCTCTTTAATATCTTCACCTCATTGCTCTAATAGACATTAATCTCCATTTGAAGTTAGTATTCTTTTACCAGTTTTACTGATTTTTCTTTTTCATTCAGGTAACTGTGATTGTTGCAGGATCTTGTGTAGAAACAGATCACAAGAAGATGAATGATAACTCGGTGGTGCGGCTTTGATTATCTTCAGAGATTTTAGATTCTGTATCCACTCTGTTGCGATGGGGTCGTTTGCAGGCGCTTGTGAGATTGTGGAAGAGAAGGATGATGAAGTAAGATTGCCAAAACATTCCGGGAGATATGGTAAATCGGTTATGGGATCATCAAGTAAGGATTTGGTGGAGCGTAAGCAACGAGAGTATCATGGTTCTCTTGAGTATGACATTGATATGCTTTTTCAGTCTATTTCTGTTAAACCATCTACTACGAGGTTGATGAGTTCTTCTTTCCATCATCATGAGACGAGCGCGAGTGCCGGTCCAAGCAGGACCACAAGCCCTTCGAAGAGAATTGCGTCCATGAAAAAACCAGGGACACCTCAGTCTCCTAGATTTGTTGGTCTCTCTGATTCAGTTTCTTTGAAGCAGGCTCTTAGGGATCGTTGCATTTCTAAGGCGTCGGAAATGGCTGCTCAGAAACGGTTGTCGAAATCTGCTGCTGCATCTCCGAGGGTCTCAGAAGCTGACAGGATAAAGAGTTTGTATAACCAAGTTTCGAATGAATCTACTAGCAGCAGGTCTGGGCTTGTTCCTGTGGACAAGGGTAAAGGAAGTTTGGTTGAGATACCTTTGATGCCTGTAAACGATAAACCAAGCTCTTCAAAGAGCGTACCTCAACGGTTTGAAGATCCTTCTAACCCCATTTCTGAGCCATCTCAAGCTGGAACCAGTTTTGGATTACAAGGAGTGGGGAATCAAACGCGGGAGATTAAGCTGTTGCATAGATCCAACAAACCTGGGTCTTGTCTTAGTTCTGGCAGTGGAGATTATGAGATAGAGTTAGATGAAAATGTTGCGTCTCCTTCCACTCATGCATTTGTTGAAGATGATGTGATAGAAATAGACAAACACGTTACTTCACTGCCATCTCACTCTAGCAAGAAAGTCAATGCGACGGAGCTTGACAAGAATATTTCCTCATCTGCTGTAGACTCAGAGCAGAAAGGGAAGTTGGATGATGCACCTAATTCAGGGACAGAGAATGGCAAAACAGTACGGAAGGTAACAAGAATGATTCCACGTCCCAAACAACCGAAAAAGAAAATTTTGCTTAAGAAGAAGTTAAAAATCGGGGTTGTGTCAGCAACTTACCCAACAAAAGACGATGAAGAAATTGTTCCTTCCTTGGACTCTAGTGCCAATCAACTTCTCTGCCAGAGATGTCACTGTTCGTTGAAGAGCACCAGCATCGATGACAACCCACCTTCATATACTTCTAGTCATAATCCTAAGATTTGCACAGATAGTTTGAGCTCTGTTTCAAATAAAGAAGCTCATCAAGGATCTGACGAAAACTCCTCTGGCTCGTGTAATGTCAGTCAAAGCTCTGAAGCTGACATTGTCATAATGAAACAAGATGTTTCCTCTAGCAATAATAGTGGAATCGGTGCAATGGTAGAAAAAGAAACCGAGAATCCGACTTCCAGTGAGAAATTCGAGTTCTCTCTGAGTTCAAAAGATAGTCTTGGGGATTATAGCAGGAGCACAAGCATTAGTGAGGAGAGTAATCTGAGCCGATTTAGCTGTGGGAATAAGCCTCACATGTCGATGGATGTGAGATGGGAAGCGATTAAGCATATCAAGGTTCAATACGGCTCTTTGGGTTTACGACACTTCAACCTTCTGAAGAAACTTGGTTGTGGAGATATAGGAACAGTCTATCTCGCCGAGCTGATTGGTACAAACTGTTTGTTTGCCATAAAGGTTATGGACAACGAGTTCTTGGCGAGAAGGAAAAAGTCTCCCCGGGCACAAGCAGAAAGAGAAATACTTAAAATGTTGGACCATCCTTTTCTTCCTACATTATACGCGCAATTTACTTCGGATAATTTATCTTGTCTAGTCATGGAATATTGTCCTGGAGGAGATCTTCATGTCCTCAGACAGAAGCAGCTAGGCCGGTGTTTCCCTGAACCTGCAGCAAGATTCTATGTGGCCGAAATTCTCCTTGCACTGGAGTACTTACACATGCTTGGTATCATATACCGAGATCTGAAACCGGAAAACATTCTTGTCCGTGAAGATGGACACATTATGCTTACGGATTTTGACCTCTCACTCCGTTGTGCAGTGAACCCGACTCTTGTCAGGTCAAACTCTCCACCTGGTAAAGATCCCGCAAGGATTTCAGGTCCATACAACACATCCAACTGCATACAACCATTCTGTATCACCGAACCATCTTGCCAGGTTTCGTGTTTCAGCCCTAGGCTCTCCTCAAACCAACAACAAGGTAGAAAACCAAAAAGGGGTGATCATCTTTCGAAAACCCAACAACACTTGAGTAGATCATTGCCTCAGCTCGTGGCTGAACCAACCGAAGCAAGATCCAATTCCTTTGTGGGAACACACGAGTACCTAGCCCCAGAGATCATCAAAGGAGAAGGACATGGCGCTGCAGTTGACTGGTGGACTTTCGGGGTTCTCCTTTACGAGCTTTTATACGGGAAAACACCATTCAAAGGTTACAACAACGACGAGACTTTGGCCAATGTTGTGTTACAGAACCTCAAGTTTCCTGATAGCCCGCTTGTAAGCTTCCAGGCAAAAGACTTGATCAGGGGACTTCTTGTTAAGGAACCAGAGAACAGGCTCGGGTCAGAGAAAGGTTCTGTAGAGATCAAAAGACATCCTTTTTTTGAAGGATTGAATTGGGCTCTGATCCGGTGTGCAATCCCGCCTGAGCTACCGGATTTCTATGAGTATGGTGGTGGACCAGAGGCAGCGGCGGATTCGCCTGGAGGCAGTAATAATAGGTATCTTGAATGTAAAGCCATAGGCGATCATCTTGAGTTCGAGTTGTTTTAAGCAAGACATAGATATTCTCTGGTATAAGCATTCAGAGTAATCGTTGTTGTAAGTTATTATATCTAAGTTAAATCTAAATGTCTTATATGTAAATTTAGCGTTCTCTGAGACATAATCTGATATAGTATTCTCAAAAAAGGTAAATCTCAGAGAGATCT

SEQ ID NO: 2487 - DNA, 1400 bp, Arabidopsis thaliana
  misc_feature (1)..(1400): Ceres cDNA ID no. 13608212
  misc_feature (1)..(1400): Also known as  Ceres CDNA ID no. 23827422
acgcttcccaaccgcctgcctttttcagattacctccggtttctaccactctcgccgtcgccgtcaccggtactccgatcacctccgcacgattcatttcctatttgcatttttcacctctctagcggaaagtgagtcttctcgagaatgggagattgaagaagtaagagattcactgattgaggaagagagaaagttagttcagaaaaatggctccagtgagtaaagctgataagaaggcagccgtagatgctgctgcgtggatgttcaatgtcgtcacttctgttggtatcatcattgttaataaagctttaatggcgacttatggttatagctttgctacaacgttaactggtttacatttcgctacaacgactctgatgacgcttgttttaagatgtcttggttacattcagccttctcatcttccgtttacggagcttttgagatttattctgtttgctaatttctccattgttggaatgaatgtcagtcttatgtggaactctgttggtttttatcagattgctaagctcagcatgattcctgtatcttgtttgttggaaatggttttcgataagattcgttattccagagatacaaagcttagcataggactggttcttgtgggtgttggtgtttgcactgttactgatgttagtgtaaacactaaaggatttgtagccgctttcgttgctgtgtggagtactgctctgcaacaatactatgtacattaccttcagcgcaagtactcgcttaactcattcaacctattgggacataccgctccagcccaagccgcaacattactggtagttggcccgtttcttgattattggctgacagaaaaaagagtagacatgtacgattacaacttggtttcagtgctgtttataaccctgtcgtgcacaatagcgattggaaccaacctaagccagttcatctgcatcggaagattcacagctgtatcgttccaagtgctgggacacatgaagacgatcctggtgctgataatgggcttcttcttctttggtagagaaggtcttaacttgcacgtggttgttggaatgataattgcagtactgggtatgatctggtacggtaatgcctcttcgaagccaggaggcaaagagcgacgaaactattctcttccaactacccgtcaacagaaactcggagctgcttcggattctgacgacaacgaagacaaagcctagtagtaagtagtatattatcaggaacatcacatagttacgtctctgttttgagttgtttttttattagcttaatttatgattctcgtgctaaattttggtttggtacgaaagaaagcgaattttttcatacagacgtttgagatttttgtaatgcatttttgcgaaatcaagttacatcaacgc

SEQ ID NO: 2488 - protein, 1400 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ACGCTTCCCAACCGCCTGCCTTTTTCAGATTACCTCCGGTTTCTACCACTCTCGCCGTCGCCGTCACCGGTACTCCGATCACCTCCGCACGATTCATTTCCTATTTGCATTTTTCACCTCTCTAGCGGAAAGTGAGTCTTCTCGAGAATGGGAGATTGAAGAAGTAAGAGATTCACTGATTGAGGAAGAGAGAAAGTTAGTTCAGAAAAATGGCTCCAGTGAGTAAAGCTGATAAGAAGGCAGCCGTAGATGCTGCTGCGTGGATGTTCAATGTCGTCACTTCTGTTGGTATCATCATTGTTAATAAAGCTTTAATGGCGACTTATGGTTATAGCTTTGCTACAACGTTAACTGGTTTACATTTCGCTACAACGACTCTGATGACGCTTGTTTTAAGATGTCTTGGTTACATTCAGCCTTCTCATCTTCCGTTTACGGAGCTTTTGAGATTTATTCTGTTTGCTAATTTCTCCATTGTTGGAATGAATGTCAGTCTTATGTGGAACTCTGTTGGTTTTTATCAGATTGCTAAGCTCAGCATGATTCCTGTATCTTGTTTGTTGGAAATGGTTTTCGATAAGATTCGTTATTCCAGAGATACAAAGCTTAGCATAGGACTGGTTCTTGTGGGTGTTGGTGTTTGCACTGTTACTGATGTTAGTGTAAACACTAAAGGATTTGTAGCCGCTTTCGTTGCTGTGTGGAGTACTGCTCTGCAACAATACTATGTACATTACCTTCAGCGCAAGTACTCGCTTAACTCATTCAACCTATTGGGACATACCGCTCCAGCCCAAGCCGCAACATTACTGGTAGTTGGCCCGTTTCTTGATTATTGGCTGACAGAAAAAAGAGTAGACATGTACGATTACAACTTGGTTTCAGTGCTGTTTATAACCCTGTCGTGCACAATAGCGATTGGAACCAACCTAAGCCAGTTCATCTGCATCGGAAGATTCACAGCTGTATCGTTCCAAGTGCTGGGACACATGAAGACGATCCTGGTGCTGATAATGGGCTTCTTCTTCTTTGGTAGAGAAGGTCTTAACTTGCACGTGGTTGTTGGAATGATAATTGCAGTACTGGGTATGATCTGGTACGGTAATGCCTCTTCGAAGCCAGGAGGCAAAGAGCGACGAAACTATTCTCTTCCAACTACCCGTCAACAGAAACTCGGAGCTGCTTCGGATTCTGACGACAACGAAGACAAAGCCTAGTAGTAAGTAGTATATTATCAGGAACATCACATAGTTACGTCTCTGTTTTGAGTTGTTTTTTTATTAGCTTAATTTATGATTCTCGTGCTAAATTTTGGTTTGGTACGAAAGAAAGCGAATTTTTTCATACAGACGTTTGAGATTTTTGTAATGCATTTTTGCGAAATCAAGTTACATCAACGC

SEQ ID NO: 2489 - DNA, 1370 bp, Arabidopsis thaliana
  misc_feature (1)..(1370): Ceres cDNA ID no. 13608442
  misc_feature (1)..(1370): Also known as  Ceres CDNA ID no. 23827422
atcatccgcggttcacttccttcgtttcgaaattattagggttactgcgtatttgcactctccttcttcgtctctccagcttgacaatgcctcgctatgatgatcgctatggaaacactcgcctctatgttggtcgcttatcatctagaactcgtaccagagaccttgagcgtctctttagcagatacggaaggtttctgggggtttgcctaacctggagatgtttgatgaatgggtggactgtggtgtaattggtggaaattctcgtctggtgtatagagggtgcatcggcgattttgtttgttgatttattgcatgtttttattggaaatggcctcaaatctcaaaaactggtgtttggaagttccttaagtaatgatggccttgattttctggcaacaatttacgcagagtacgagatgtggatatgaagcgtgattatgcctttgttgaatttagtgatcctcgtgatgctgatgacgcaagatattacttggatggacgggatttcgatggaagtcgcatcactgtggaggcatcaagaggggctcctcgtggttcgcgggacaatggtagcagaggcccacctcctggttctggtcgctgttttaattgtggtgtcgatggccactgggcccgagactgcacagcaggagactggaagaataaatgttaccgctgtggtgaaagaggacacattgagagaaactgcaaaaacagtcctagtccaaagaaggccaggcagggtggaagctattccaggtcaccagtcaaatcccgctcccctcgtcgccgaaggagcccaagccgtagccgtagttacagtcgaggtcgcagctacagtcgatcgcgatccccagtgagaagagagaaaagcgtggaggacagatcacgcagtcctaaggcaatggagcgatctgtatctcccaaaggtagggaccaaagcctgagtccagaccgaaaagtgatagatgcaagcccaaagcgtggatcagactatgatggtagcccaaaagagaatggtaatggcaggaactctgcgagtcccattgttggaggtggtgaaagtcctgttggacttaatggtcaagacaggagcccgattgatgatgaggctgagcttagccgtccttcccctaaaggcagtgagtcaccttgatggttcacaggttaaaagctctatgtagcattctgtactgaaggatgttgtttcctttccctttctttctgcgtgatacttttcttttcgttgcgtgacaatcctggatgttactttgccttctctcttgatgactcttggtttgttttccgacaactttcaaactctgcgatgttacttttcattgtttagtaagaatcatgcatttatg

SEQ ID NO: 2490 - protein, 1370 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATCATCCGCGGTTCACTTCCTTCGTTTCGAAATTATTAGGGTTACTGCGTATTTGCACTCTCCTTCTTCGTCTCTCCAGCTTGACAATGCCTCGCTATGATGATCGCTATGGAAACACTCGCCTCTATGTTGGTCGCTTATCATCTAGAACTCGTACCAGAGACCTTGAGCGTCTCTTTAGCAGATACGGAAGGTTTCTGGGGGTTTGCCTAACCTGGAGATGTTTGATGAATGGGTGGACTGTGGTGTAATTGGTGGAAATTCTCGTCTGGTGTATAGAGGGTGCATCGGCGATTTTGTTTGTTGATTTATTGCATGTTTTTATTGGAAATGGCCTCAAATCTCAAAAACTGGTGTTTGGAAGTTCCTTAAGTAATGATGGCCTTGATTTTCTGGCAACAATTTACGCAGAGTACGAGATGTGGATATGAAGCGTGATTATGCCTTTGTTGAATTTAGTGATCCTCGTGATGCTGATGACGCAAGATATTACTTGGATGGACGGGATTTCGATGGAAGTCGCATCACTGTGGAGGCATCAAGAGGGGCTCCTCGTGGTTCGCGGGACAATGGTAGCAGAGGCCCACCTCCTGGTTCTGGTCGCTGTTTTAATTGTGGTGTCGATGGCCACTGGGCCCGAGACTGCACAGCAGGAGACTGGAAGAATAAATGTTACCGCTGTGGTGAAAGAGGACACATTGAGAGAAACTGCAAAAACAGTCCTAGTCCAAAGAAGGCCAGGCAGGGTGGAAGCTATTCCAGGTCACCAGTCAAATCCCGCTCCCCTCGTCGCCGAAGGAGCCCAAGCCGTAGCCGTAGTTACAGTCGAGGTCGCAGCTACAGTCGATCGCGATCCCCAGTGAGAAGAGAGAAAAGCGTGGAGGACAGATCACGCAGTCCTAAGGCAATGGAGCGATCTGTATCTCCCAAAGGTAGGGACCAAAGCCTGAGTCCAGACCGAAAAGTGATAGATGCAAGCCCAAAGCGTGGATCAGACTATGATGGTAGCCCAAAAGAGAATGGTAATGGCAGGAACTCTGCGAGTCCCATTGTTGGAGGTGGTGAAAGTCCTGTTGGACTTAATGGTCAAGACAGGAGCCCGATTGATGATGAGGCTGAGCTTAGCCGTCCTTCCCCTAAAGGCAGTGAGTCACCTTGATGGTTCACAGGTTAAAAGCTCTATGTAGCATTCTGTACTGAAGGATGTTGTTTCCTTTCCCTTTCTTTCTGCGTGATACTTTTCTTTTCGTTGCGTGACAATCCTGGATGTTACTTTGCCTTCTCTCTTGATGACTCTTGGTTTGTTTTCCGACAACTTTCAAACTCTGCGATGTTACTTTTCATTGTTTAGTAAGAATCATGCATTTATG

SEQ ID NO: 2491 - DNA, 1369 bp, Arabidopsis thaliana
  misc_feature (1)..(1369): Ceres cDNA ID no. 13608585
  misc_feature (1)..(1369): Also known as  Ceres CDNA ID no. 23827422
atatatacgaaacgtaccacaaatttctaactaaagcattcatagtctctcgaaagcctcttttcagaaccgaagctctttactttcgtccaccgggaaatatgccagtcgacgtagcctcaccggccggaaaaaccgtctgcgtcaccggagctggtggatacatcgcttcttggattgttaagatacttctcgagagaggttacacagtcaaaggaaccgtacggaatccagatgatccgaagaacacacatttgagagaactagaaggaggaaaggagagactgattctgtgcaaagcagatcttcaggactacgaggctcttaaggcggcgattgatggttgcgacggcgtctttcacacggcttctcctgtcaccgacgatccggaacaaatggtggagccggccgtgaatggagccaagtttgtaattaatgctgcggctgaggccaaggtcaagcgcgtggtcatcacctcctccattggtgccgtctacatggacccgaaccgtgaccctgaggctgtcgttgacgaaagttgttggagtgatcttgacttctgcaaaaacaccaagaattggtattgttacggcaagatggtggcggaacaagcggcgtgggagacagcaaaggagaaaggtgttgacttggtggtgttgaatccggtgctggttcttggaccgccgttacagccgacgatcaacgccagtctttaccacgtcctcaaatatctaaccggctcggctaagacttatgctaatttgactcaagcttatgtggatgttcgcgatgtcgcgctggctcatgttctggtctatgaggcaccctcggcctccggacgttatctcctagccgagagtgctcgccaccgcggggaagttgttgagattctggctaagctattcccggagtatcctcttccgaccaagtgcaaggacgagaagaaccctagagccaagccatacaaattcactaaccagaagattaaggacttaggcttagagttcacttccaccaagcaaagcctctacgacacagtcaagagcttacaagagaaaggccatcttgctcctcctcctcctcctccttcagcatcgcaagaatccgtggaaaatggcattaagatcgggtcttgaaaagcttattaattccctcaagtatcccccttaagtatccttaaccattgaagttgcttttgtttgttgtctctggttatgtgaaacctctgtttcaatatgtctcgtctggttatgaatctgtacactcagttctttggccaaaccgtttgatggattttgtagtcaagtcttcatgtttgatctatgtaatagattacacttaagtaaacaacttcatttttattctatgc

SEQ ID NO: 2492 - protein, 1369 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATATATACGAAACGTACCACAAATTTCTAACTAAAGCATTCATAGTCTCTCGAAAGCCTCTTTTCAGAACCGAAGCTCTTTACTTTCGTCCACCGGGAAATATGCCAGTCGACGTAGCCTCACCGGCCGGAAAAACCGTCTGCGTCACCGGAGCTGGTGGATACATCGCTTCTTGGATTGTTAAGATACTTCTCGAGAGAGGTTACACAGTCAAAGGAACCGTACGGAATCCAGATGATCCGAAGAACACACATTTGAGAGAACTAGAAGGAGGAAAGGAGAGACTGATTCTGTGCAAAGCAGATCTTCAGGACTACGAGGCTCTTAAGGCGGCGATTGATGGTTGCGACGGCGTCTTTCACACGGCTTCTCCTGTCACCGACGATCCGGAACAAATGGTGGAGCCGGCCGTGAATGGAGCCAAGTTTGTAATTAATGCTGCGGCTGAGGCCAAGGTCAAGCGCGTGGTCATCACCTCCTCCATTGGTGCCGTCTACATGGACCCGAACCGTGACCCTGAGGCTGTCGTTGACGAAAGTTGTTGGAGTGATCTTGACTTCTGCAAAAACACCAAGAATTGGTATTGTTACGGCAAGATGGTGGCGGAACAAGCGGCGTGGGAGACAGCAAAGGAGAAAGGTGTTGACTTGGTGGTGTTGAATCCGGTGCTGGTTCTTGGACCGCCGTTACAGCCGACGATCAACGCCAGTCTTTACCACGTCCTCAAATATCTAACCGGCTCGGCTAAGACTTATGCTAATTTGACTCAAGCTTATGTGGATGTTCGCGATGTCGCGCTGGCTCATGTTCTGGTCTATGAGGCACCCTCGGCCTCCGGACGTTATCTCCTAGCCGAGAGTGCTCGCCACCGCGGGGAAGTTGTTGAGATTCTGGCTAAGCTATTCCCGGAGTATCCTCTTCCGACCAAGTGCAAGGACGAGAAGAACCCTAGAGCCAAGCCATACAAATTCACTAACCAGAAGATTAAGGACTTAGGCTTAGAGTTCACTTCCACCAAGCAAAGCCTCTACGACACAGTCAAGAGCTTACAAGAGAAAGGCCATCTTGCTCCTCCTCCTCCTCCTCCTTCAGCATCGCAAGAATCCGTGGAAAATGGCATTAAGATCGGGTCTTGAAAAGCTTATTAATTCCCTCAAGTATCCCCCTTAAGTATCCTTAACCATTGAAGTTGCTTTTGTTTGTTGTCTCTGGTTATGTGAAACCTCTGTTTCAATATGTCTCGTCTGGTTATGAATCTGTACACTCAGTTCTTTGGCCAAACCGTTTGATGGATTTTGTAGTCAAGTCTTCATGTTTGATCTATGTAATAGATTACACTTAAGTAAACAACTTCATTTTTATTCTATGC

SEQ ID NO: 2493 - DNA, 2064 bp, Arabidopsis thaliana
  misc_feature (1)..(2064): Ceres cDNA ID no. 13608603
  misc_feature (1)..(2064): Also known as  Ceres CDNA ID no. 23827422
atggaggacgagccacttttaccacttatgggcctgttattagtggcccaagacgagacggatgtcggatcatgcgatttggctgttgcaatccatagacaccaccgagcgagcatcttcttcttcttcttcgctaaccggagtaatcgtaagcagcttcgactggtgaaaatgtgttactctctctctatacaatcttcaattgacttccataatcgaaacgctctaaaaatccatggagatcgagcaattttgacttcgaacttacctacactcaggaggattccgtttttgccggagcgagatcgccggagaaagttggtcctctgtaccgggagagtcgtaaactcattgaaattcaccggaaacacttccgtcgatctatgtggtattcctcgtcatcgattaagagtttcttgcagcgatgctcgccgtacaccggaagaaacggcggcggagttgacggcgcaacccaatttttcagaatttataacgtcggagagagtcaaagtggttgcgatgctcgcgcttgctttggcgctatgcaatgcggatcgtgttgtgatgtccgttgcgattgttcctctttcgctttctcgtggatggagcaaatcattttccggtatcgttcagtcatcgtttctatggggatacttaatttctccaattgctggtggaactttggtggaccgttatggtggtaaagtagtcatggcgtggggtgtggctttgtggtcgttggcaacttttcttaccccttgggcggctgatagttctttgtgggctcttcttgctgcaagagcgatggttggggttgctgaaggagtggctcttccttgtatgaacaacatggttgcgagatggtttcccccaacagaacgttctagggcggttggtattgcaatggcagggtttcagcttgggaatgttgtaggactcatgttgtctcctattcttatgtctcaaggaggtatatatggcccatttgtaatttttggactatcggggttcctttggttgctcgtgtggctctctgcaacgtcaagtgcaccagatcgacatcctcagattacaaagtctgaacttgagtatataaagcaaaagaagcaaatatctactatggagaacaaacgaattagcacaagtggaatacctccttttggacgccttctctccaagatgccgacttgggctgttatagttgcaaattccatgcatagctggggtttctttgtgattctttcatggatgcccatatacttcaattcagtatatcatgtgaacctcaaacaagctgcttggtttagtgccgttccatggagtatgatggctttcacaggatacattgctggtttttggtcggatttgttgatacggcgtggtacaagcatcaccttaacgcgaaaaatcatgcagtccattggtttcattggtcctggaattgctctcattggtctaacgacggcaaaacaacctttagtggcatcagcctggcttagtttagccgttgggcttaaatcattcagccatttggggtttcttattaatcttcaggaaattgctcccgaatattccggtgttctacatggaatgtgtcttactgctgggacattagctgcgatagttggcacagttggagctggtttctttgtagaactattgggctccttccagggattcatccttcttacagcaatattgtatctcctttctgctctcttttacaacatatacgcaactggagaaagagtagattttgacacaacagcttgaaggtgaccacaaagtcacttaataggtggatcagctagtaaagaagttgcaactctatatagaatcagcttttgctctccaagtaaataccaggaacaagacctcggctttgtacagaaactagaatttcttcgtctcgatggttctctccttgataaataaatgaaaaaatgtagcaagttatctatgttcaatgtcgtgaatcgccttagagaagataatgaaaacaatgttgacgtagtatttgtttgttatacggttcaatggtatagagacacgaagactttcatc

SEQ ID NO: 2494 - protein, 2064 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATGGAGGACGAGCCACTTTTACCACTTATGGGCCTGTTATTAGTGGCCCAAGACGAGACGGATGTCGGATCATGCGATTTGGCTGTTGCAATCCATAGACACCACCGAGCGAGCATCTTCTTCTTCTTCTTCGCTAACCGGAGTAATCGTAAGCAGCTTCGACTGGTGAAAATGTGTTACTCTCTCTCTATACAATCTTCAATTGACTTCCATAATCGAAACGCTCTAAAAATCCATGGAGATCGAGCAATTTTGACTTCGAACTTACCTACACTCAGGAGGATTCCGTTTTTGCCGGAGCGAGATCGCCGGAGAAAGTTGGTCCTCTGTACCGGGAGAGTCGTAAACTCATTGAAATTCACCGGAAACACTTCCGTCGATCTATGTGGTATTCCTCGTCATCGATTAAGAGTTTCTTGCAGCGATGCTCGCCGTACACCGGAAGAAACGGCGGCGGAGTTGACGGCGCAACCCAATTTTTCAGAATTTATAACGTCGGAGAGAGTCAAAGTGGTTGCGATGCTCGCGCTTGCTTTGGCGCTATGCAATGCGGATCGTGTTGTGATGTCCGTTGCGATTGTTCCTCTTTCGCTTTCTCGTGGATGGAGCAAATCATTTTCCGGTATCGTTCAGTCATCGTTTCTATGGGGATACTTAATTTCTCCAATTGCTGGTGGAACTTTGGTGGACCGTTATGGTGGTAAAGTAGTCATGGCGTGGGGTGTGGCTTTGTGGTCGTTGGCAACTTTTCTTACCCCTTGGGCGGCTGATAGTTCTTTGTGGGCTCTTCTTGCTGCAAGAGCGATGGTTGGGGTTGCTGAAGGAGTGGCTCTTCCTTGTATGAACAACATGGTTGCGAGATGGTTTCCCCCAACAGAACGTTCTAGGGCGGTTGGTATTGCAATGGCAGGGTTTCAGCTTGGGAATGTTGTAGGACTCATGTTGTCTCCTATTCTTATGTCTCAAGGAGGTATATATGGCCCATTTGTAATTTTTGGACTATCGGGGTTCCTTTGGTTGCTCGTGTGGCTCTCTGCAACGTCAAGTGCACCAGATCGACATCCTCAGATTACAAAGTCTGAACTTGAGTATATAAAGCAAAAGAAGCAAATATCTACTATGGAGAACAAACGAATTAGCACAAGTGGAATACCTCCTTTTGGACGCCTTCTCTCCAAGATGCCGACTTGGGCTGTTATAGTTGCAAATTCCATGCATAGCTGGGGTTTCTTTGTGATTCTTTCATGGATGCCCATATACTTCAATTCAGTATATCATGTGAACCTCAAACAAGCTGCTTGGTTTAGTGCCGTTCCATGGAGTATGATGGCTTTCACAGGATACATTGCTGGTTTTTGGTCGGATTTGTTGATACGGCGTGGTACAAGCATCACCTTAACGCGAAAAATCATGCAGTCCATTGGTTTCATTGGTCCTGGAATTGCTCTCATTGGTCTAACGACGGCAAAACAACCTTTAGTGGCATCAGCCTGGCTTAGTTTAGCCGTTGGGCTTAAATCATTCAGCCATTTGGGGTTTCTTATTAATCTTCAGGAAATTGCTCCCGAATATTCCGGTGTTCTACATGGAATGTGTCTTACTGCTGGGACATTAGCTGCGATAGTTGGCACAGTTGGAGCTGGTTTCTTTGTAGAACTATTGGGCTCCTTCCAGGGATTCATCCTTCTTACAGCAATATTGTATCTCCTTTCTGCTCTCTTTTACAACATATACGCAACTGGAGAAAGAGTAGATTTTGACACAACAGCTTGAAGGTGACCACAAAGTCACTTAATAGGTGGATCAGCTAGTAAAGAAGTTGCAACTCTATATAGAATCAGCTTTTGCTCTCCAAGTAAATACCAGGAACAAGACCTCGGCTTTGTACAGAAACTAGAATTTCTTCGTCTCGATGGTTCTCTCCTTGATAAATAAATGAAAAAATGTAGCAAGTTATCTATGTTCAATGTCGTGAATCGCCTTAGAGAAGATAATGAAAACAATGTTGACGTAGTATTTGTTTGTTATACGGTTCAATGGTATAGAGACACGAAGACTTTCATC

SEQ ID NO: 2495 - DNA, 1417 bp, Arabidopsis thaliana
  misc_feature (1)..(1417): Ceres cDNA ID no. 13608716
  misc_feature (1)..(1417): Also known as  Ceres CDNA ID no. 23827422
gtatccgactaactccaccgtttcgttcttcgttcttcatcggatctttcttcttcacgacgacaacattactgtatatctctttcgcaaaggaaaagttctgatctttgtattctcttatcattcgttatctaagtctcttcgattctcgaagcttttaaggcatttaaagagacgaaatgggtaataagctgggaaggaagagacagattgtggacgaaagatacacaaagccacaacaaggtttatacatgagcaaagatgttgacattaaaaagcttaagaaactcatcttagagtctaagcttgctccttgttatcctggtcttgaagaaaccccctcctcccatcatgatcttgaagaatgtcctatttgctttctgtattatccgagtcttaataggtcaagatgttgtatgaaaagcatttgtacagaatgctttctgcggatgaagagtcctaattcagctcaacctactcaatgccctttttgcaaaacatccaattatgctgtcgagtatcgtggagggaaaactaaagaggagaagagctttgaacaaattgaagagcagcgagttatagaagccaaaataaggatgaggcagaaggaagttgaagatgatgaagaaagaatgcagaaacgtctggagtcatattcttctagttctagcactagtgcagcgactcttgatacagagtatggttctgctgcagaggatgatgaggaaattgtttcatctcaagaatcatgtcttccatctcaccaccctcaggttacaagggacggtcagtttgactttgatcttgaagatataatggtcatggaagcaatatggctttcgatgcaggaaccaggaattcagagaaacacatcacctgatgatatttcagaaaaagatcgtaatgaggaaccatcaactccgtcatcatcatctccatcaggtgggctagcttgtgcaattgctgttcttgccgaacgtcagcaaatggttggcgtatcttcttcgaatcaaaacgttaaccttgcatcacaaaaccttgttccagacaatggtaacaacagtcattacaatgccatagaacaggatagtaaccattaccttcaaggagcaggaatcagctatacaagatcagatatgactgatgatagcggcggtgagacttccagggaagttacatggcaatagagagttcccaaaggtaaagaggaaagcttcaaagttgttatatagtcttttgtttatattatgttagcgggagtgaatggttttagattgttagttagttttgagggtgtatgttgatcacttcatacatgtgccaataagaaaaaccaaaacgattttcaattcctcctacagaaggttggttgtttggttgtattattatgaatggtaagcattgcacaaaaatgaaa

SEQ ID NO: 2496 - protein, 1417 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
GTATCCGACTAACTCCACCGTTTCGTTCTTCGTTCTTCATCGGATCTTTCTTCTTCACGACGACAACATTACTGTATATCTCTTTCGCAAAGGAAAAGTTCTGATCTTTGTATTCTCTTATCATTCGTTATCTAAGTCTCTTCGATTCTCGAAGCTTTTAAGGCATTTAAAGAGACGAAATGGGTAATAAGCTGGGAAGGAAGAGACAGATTGTGGACGAAAGATACACAAAGCCACAACAAGGTTTATACATGAGCAAAGATGTTGACATTAAAAAGCTTAAGAAACTCATCTTAGAGTCTAAGCTTGCTCCTTGTTATCCTGGTCTTGAAGAAACCCCCTCCTCCCATCATGATCTTGAAGAATGTCCTATTTGCTTTCTGTATTATCCGAGTCTTAATAGGTCAAGATGTTGTATGAAAAGCATTTGTACAGAATGCTTTCTGCGGATGAAGAGTCCTAATTCAGCTCAACCTACTCAATGCCCTTTTTGCAAAACATCCAATTATGCTGTCGAGTATCGTGGAGGGAAAACTAAAGAGGAGAAGAGCTTTGAACAAATTGAAGAGCAGCGAGTTATAGAAGCCAAAATAAGGATGAGGCAGAAGGAAGTTGAAGATGATGAAGAAAGAATGCAGAAACGTCTGGAGTCATATTCTTCTAGTTCTAGCACTAGTGCAGCGACTCTTGATACAGAGTATGGTTCTGCTGCAGAGGATGATGAGGAAATTGTTTCATCTCAAGAATCATGTCTTCCATCTCACCACCCTCAGGTTACAAGGGACGGTCAGTTTGACTTTGATCTTGAAGATATAATGGTCATGGAAGCAATATGGCTTTCGATGCAGGAACCAGGAATTCAGAGAAACACATCACCTGATGATATTTCAGAAAAAGATCGTAATGAGGAACCATCAACTCCGTCATCATCATCTCCATCAGGTGGGCTAGCTTGTGCAATTGCTGTTCTTGCCGAACGTCAGCAAATGGTTGGCGTATCTTCTTCGAATCAAAACGTTAACCTTGCATCACAAAACCTTGTTCCAGACAATGGTAACAACAGTCATTACAATGCCATAGAACAGGATAGTAACCATTACCTTCAAGGAGCAGGAATCAGCTATACAAGATCAGATATGACTGATGATAGCGGCGGTGAGACTTCCAGGGAAGTTACATGGCAATAGAGAGTTCCCAAAGGTAAAGAGGAAAGCTTCAAAGTTGTTATATAGTCTTTTGTTTATATTATGTTAGCGGGAGTGAATGGTTTTAGATTGTTAGTTAGTTTTGAGGGTGTATGTTGATCACTTCATACATGTGCCAATAAGAAAAACCAAAACGATTTTCAATTCCTCCTACAGAAGGTTGGTTGTTTGGTTGTATTATTATGAATGGTAAGCATTGCACAAAAATGAAA

SEQ ID NO: 2497 - DNA, 1244 bp, Arabidopsis thaliana
  misc_feature (1)..(1244): Ceres cDNA ID no. 13609302
  misc_feature (1)..(1244): Also known as  Ceres CDNA ID no. 23827422
atgctaagtttctctagagctagaagtcaaggaagaaacacaagacctcttggaggagggatggaatacttagaacctaaaaggaagagcaatgtaatgggcaagattatcttggttgtttctcttactgctttatgcatttttatgctcaagcacgcaccgagtttcacatcaccaaccgcgttctctcgtagcgaggaaggtgtgactcatgtgttagtcactggtggtgctggatatatcggatcacatgctgcgttgaggctcttaaaagattcataccgtgtaaccattgtggacaatctttctcggggaaatcttggtgccgtcaaggttttacaaggattgttcccagaacccgggaggcttcaatttatttatgctgacttaggagatgccaaagctgttgataaaatcttctcagagaacgcgtttgatgctgttatgcattttgctgcagtagcatatgttggagagagcactctagatcctctaaagtattaccacaacattacatcaaacacattagtagttcttgaagctgtggctagacataaagtgaagaagttgatatattcaagcacatgtgccacttatggagaacctgacaagatgcctattgttgaagttactccacaggtccccattaacccttatggaaaagctaagaagatggctgaagatatgatcctggatttctctaaaaactctgacatggcagtcatgatcctaagatactttaacgtgataggttcagatccagaaggtagactaggagaagctccaaagcccgagctacgtgaacacggacggatttcgggtgcctgtttcgatgcagctcgtggcgtgattccaggccttcaggtcaaaggaacagactacaaaacaggagatggaacttgtgttcgtgactacatagatgttactgaccttgtagatgctcacgtaaaagctctcgagaaagctaagcctagaaatgtgggaatatacaatgtaggtacaggaaaaggaagatcggtgaaagagtttgtggaagcatgtaagaaagcgacaggagtagatatcaaagtagattttttgcctcgaagacctggagattacgcagaggtttacagtgatccagcaaagattctgagagatcttaattggtctgctcgttacactaatcttcaagaaagtcttgaggttgcttggaagtggcaaaagactcatccccatggatatgcttcttcttaaagacgacc

SEQ ID NO: 2498 - protein, 1244 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATGCTAAGTTTCTCTAGAGCTAGAAGTCAAGGAAGAAACACAAGACCTCTTGGAGGAGGGATGGAATACTTAGAACCTAAAAGGAAGAGCAATGTAATGGGCAAGATTATCTTGGTTGTTTCTCTTACTGCTTTATGCATTTTTATGCTCAAGCACGCACCGAGTTTCACATCACCAACCGCGTTCTCTCGTAGCGAGGAAGGTGTGACTCATGTGTTAGTCACTGGTGGTGCTGGATATATCGGATCACATGCTGCGTTGAGGCTCTTAAAAGATTCATACCGTGTAACCATTGTGGACAATCTTTCTCGGGGAAATCTTGGTGCCGTCAAGGTTTTACAAGGATTGTTCCCAGAACCCGGGAGGCTTCAATTTATTTATGCTGACTTAGGAGATGCCAAAGCTGTTGATAAAATCTTCTCAGAGAACGCGTTTGATGCTGTTATGCATTTTGCTGCAGTAGCATATGTTGGAGAGAGCACTCTAGATCCTCTAAAGTATTACCACAACATTACATCAAACACATTAGTAGTTCTTGAAGCTGTGGCTAGACATAAAGTGAAGAAGTTGATATATTCAAGCACATGTGCCACTTATGGAGAACCTGACAAGATGCCTATTGTTGAAGTTACTCCACAGGTCCCCATTAACCCTTATGGAAAAGCTAAGAAGATGGCTGAAGATATGATCCTGGATTTCTCTAAAAACTCTGACATGGCAGTCATGATCCTAAGATACTTTAACGTGATAGGTTCAGATCCAGAAGGTAGACTAGGAGAAGCTCCAAAGCCCGAGCTACGTGAACACGGACGGATTTCGGGTGCCTGTTTCGATGCAGCTCGTGGCGTGATTCCAGGCCTTCAGGTCAAAGGAACAGACTACAAAACAGGAGATGGAACTTGTGTTCGTGACTACATAGATGTTACTGACCTTGTAGATGCTCACGTAAAAGCTCTCGAGAAAGCTAAGCCTAGAAATGTGGGAATATACAATGTAGGTACAGGAAAAGGAAGATCGGTGAAAGAGTTTGTGGAAGCATGTAAGAAAGCGACAGGAGTAGATATCAAAGTAGATTTTTTGCCTCGAAGACCTGGAGATTACGCAGAGGTTTACAGTGATCCAGCAAAGATTCTGAGAGATCTTAATTGGTCTGCTCGTTACACTAATCTTCAAGAAAGTCTTGAGGTTGCTTGGAAGTGGCAAAAGACTCATCCCCATGGATATGCTTCTTCTTAAAGACGACC

SEQ ID NO: 2499 - DNA, 1042 bp, Arabidopsis thaliana
  misc_feature (1)..(1042): Ceres cDNA ID no. 13609632
  misc_feature (1)..(1042): Also known as  Ceres CDNA ID no. 23827422
aaaacacaacatgaagattatgtgggaaacagcagttgtgttttgtctctgttcgttgtctttggtttcttcacacagcaggaaattcacaacaccaaacgtgacacgcctcacagatcaattcagtaagatcgccattgaaaatggcttctccagacgtttcggagctcacaatattcaggtcaatggctccctcgctaagctcactctcgacaaatcctccggagctgggttggtgtcaaagaacaagtatcactatggtttcttcagtgcaagactcaagcttcccgctggatttgcctctggtgttgtggttgctttctatttatcaaacgcagagacttatccgaaaagccacgacgagatagacatagaattgttgggtagaagtaggagagatgattggacgatccagacgaatgtatatgcaaatggaagtactagaacgggaagagaagagaagttttatttttggttcgatccaacgcaagcctttcacgactataccctcatttggaactcccaccatactgtatttttggtagacaacattccggttaggcagtttccaaaccggggagccttcacaagcgcgtacccgtctaaaccgatgtctctatacgtcaccgtttgggacggttcagagtgggccactaaaggtggtaagtaccccgtcaactacaagtacgcccctttcgtggtttccgttgctgacgtggagttaagtggctgttccgttaacaacggctcctctaccgggtccgggccatgtaccaagtcgggcgggtcgatttcgagtctggaccctgttgatggtcaggattttgccacgttgtcgaagaatcagatcaatgccatggattgggctaggagaaagctgatgttctattcttattgcagtgataagccaagatacaaagtcatgcctgctgagtgcaactgatttttttttttgttaaaacacacattgttactttctattgttttatgatataattttacgtaggatattagaggtttaaagtatgtttcaaacttcgcc

SEQ ID NO: 2500 - protein, 1042 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
AAAACACAACATGAAGATTATGTGGGAAACAGCAGTTGTGTTTTGTCTCTGTTCGTTGTCTTTGGTTTCTTCACACAGCAGGAAATTCACAACACCAAACGTGACACGCCTCACAGATCAATTCAGTAAGATCGCCATTGAAAATGGCTTCTCCAGACGTTTCGGAGCTCACAATATTCAGGTCAATGGCTCCCTCGCTAAGCTCACTCTCGACAAATCCTCCGGAGCTGGGTTGGTGTCAAAGAACAAGTATCACTATGGTTTCTTCAGTGCAAGACTCAAGCTTCCCGCTGGATTTGCCTCTGGTGTTGTGGTTGCTTTCTATTTATCAAACGCAGAGACTTATCCGAAAAGCCACGACGAGATAGACATAGAATTGTTGGGTAGAAGTAGGAGAGATGATTGGACGATCCAGACGAATGTATATGCAAATGGAAGTACTAGAACGGGAAGAGAAGAGAAGTTTTATTTTTGGTTCGATCCAACGCAAGCCTTTCACGACTATACCCTCATTTGGAACTCCCACCATACTGTATTTTTGGTAGACAACATTCCGGTTAGGCAGTTTCCAAACCGGGGAGCCTTCACAAGCGCGTACCCGTCTAAACCGATGTCTCTATACGTCACCGTTTGGGACGGTTCAGAGTGGGCCACTAAAGGTGGTAAGTACCCCGTCAACTACAAGTACGCCCCTTTCGTGGTTTCCGTTGCTGACGTGGAGTTAAGTGGCTGTTCCGTTAACAACGGCTCCTCTACCGGGTCCGGGCCATGTACCAAGTCGGGCGGGTCGATTTCGAGTCTGGACCCTGTTGATGGTCAGGATTTTGCCACGTTGTCGAAGAATCAGATCAATGCCATGGATTGGGCTAGGAGAAAGCTGATGTTCTATTCTTATTGCAGTGATAAGCCAAGATACAAAGTCATGCCTGCTGAGTGCAACTGATTTTTTTTTTTGTTAAAACACACATTGTTACTTTCTATTGTTTTATGATATAATTTTACGTAGGATATTAGAGGTTTAAAGTATGTTTCAAACTTCGCC

SEQ ID NO: 2501 - DNA, 1173 bp, Arabidopsis thaliana
  misc_feature (1)..(1173): Ceres cDNA ID no. 13609694
  misc_feature (1)..(1173): Also known as  Ceres CDNA ID no. 23827422
atgacggcggatcaagaactacaaatcattgttcggcagggaaaagaaccaaatccaacagttcaagatgaaagaaattcagtcagtagcagccaagcagaagtatctcactctaacacatacaaacggtggctcagggtgactttatatacattctttgtcatttcaggccaaacagttgctacaattttgggcagagtatactatgacaacggaggaaacagtaaatggctagcaacggtagttcaacttgttggctttcctgtgctacttccatattatatcttgtcatttaaaacacatgcaacaactgatagagatggaaaaagaacctcacctaggaaccgtgtattggtttacgtagtgcttggacttcttgtaggagcagattgctatctgtactccattggacttctttacttacccgtttctacctattccctgatctgtgcatctcagttagccttcaatgctttcttctcttattttcttaactcacaaaaacttacccctatcattttaaattctcttttcctcctaactatatcttccaccctacttgcattcaataatgaggagacagactccacaaaagttacaaaaggagagtatgtcaaaggtttcatatgcaccgttgctgcgtctgctggttatggtctagtcttatccctacaacagctagcctttctaaaagtcctaaagaagcaaaatttctcagaagttatggatatgataatctacgtgagtctagtggccagttgtgttagcgtggtggggctttttgctagcagtgagtggaaaactttgagcagtgaaatggataactacaaacatgggaaggtatcctacattatgaacctagtgtggacagctgttacctggcaggtattctccatcggtggcacaggactgatcttcgagctctcctctctattctcaaatgcaataagcgttttgggactcccagtggttcctatcttggctgtaatcattttccatgacaaaatgaatgggttaaaggtgatttctatgatcctagctatttggggtttcacttcctatgtctaccaacaatatcttgatgacaaaaacttgaagaaaaatcatgaaatcacaacaacagaatcccctgacccaccagaagcagaagagtcaacttggcaatcaaaataa

SEQ ID NO: 2502 - protein, 1173 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATGACGGCGGATCAAGAACTACAAATCATTGTTCGGCAGGGAAAAGAACCAAATCCAACAGTTCAAGATGAAAGAAATTCAGTCAGTAGCAGCCAAGCAGAAGTATCTCACTCTAACACATACAAACGGTGGCTCAGGGTGACTTTATATACATTCTTTGTCATTTCAGGCCAAACAGTTGCTACAATTTTGGGCAGAGTATACTATGACAACGGAGGAAACAGTAAATGGCTAGCAACGGTAGTTCAACTTGTTGGCTTTCCTGTGCTACTTCCATATTATATCTTGTCATTTAAAACACATGCAACAACTGATAGAGATGGAAAAAGAACCTCACCTAGGAACCGTGTATTGGTTTACGTAGTGCTTGGACTTCTTGTAGGAGCAGATTGCTATCTGTACTCCATTGGACTTCTTTACTTACCCGTTTCTACCTATTCCCTGATCTGTGCATCTCAGTTAGCCTTCAATGCTTTCTTCTCTTATTTTCTTAACTCACAAAAACTTACCCCTATCATTTTAAATTCTCTTTTCCTCCTAACTATATCTTCCACCCTACTTGCATTCAATAATGAGGAGACAGACTCCACAAAAGTTACAAAAGGAGAGTATGTCAAAGGTTTCATATGCACCGTTGCTGCGTCTGCTGGTTATGGTCTAGTCTTATCCCTACAACAGCTAGCCTTTCTAAAAGTCCTAAAGAAGCAAAATTTCTCAGAAGTTATGGATATGATAATCTACGTGAGTCTAGTGGCCAGTTGTGTTAGCGTGGTGGGGCTTTTTGCTAGCAGTGAGTGGAAAACTTTGAGCAGTGAAATGGATAACTACAAACATGGGAAGGTATCCTACATTATGAACCTAGTGTGGACAGCTGTTACCTGGCAGGTATTCTCCATCGGTGGCACAGGACTGATCTTCGAGCTCTCCTCTCTATTCTCAAATGCAATAAGCGTTTTGGGACTCCCAGTGGTTCCTATCTTGGCTGTAATCATTTTCCATGACAAAATGAATGGGTTAAAGGTGATTTCTATGATCCTAGCTATTTGGGGTTTCACTTCCTATGTCTACCAACAATATCTTGATGACAAAAACTTGAAGAAAAATCATGAAATCACAACAACAGAATCCCCTGACCCACCAGAAGCAGAAGAGTCAACTTGGCAATCAAAATAA

SEQ ID NO: 2503 - DNA, 1136 bp, Arabidopsis thaliana
  misc_feature (1)..(1136): Ceres cDNA ID no. 13610109
  misc_feature (1)..(1136): Also known as  Ceres CDNA ID no. 23827422
tttccttccgaaattagggcttccgtgtttcgcagtgctctccttcaatccccagcttgacaatgcctcgctatgatgatcgctatgggaacactcgtctttacgttggccgattatcatcgagaactaggacccgagaccttgaacgtctttttagcagatacggaagagtgcgagatgtggatatgaagcgagattatgctttcgttgaatttggtgatccccgtgatgctgatgatgcaagacattacctggacggacgagactttgatggaagtcgcatcactgtggagttttcacgaggggcacctcgtggttctcgggattttgatagcagaggcccaccacctggagctggtcgctgttttaactgtggtgtagatggtcattgggctcgtgactgcacagcaggggactggaagaacaagtgttaccgttgtggagagagaggacacattgagagaaactgcaaaaacagccccaagaagcttaggcgcagtggaagctactccaggtcacctgtaagatcccgttctcctcgtcgtagaagaagcccaagccggagtcttagccgtagccgaagctacagccgatcacgatccccggtgagaagaagagagaggagtgtggaggagagatcacgcagtccaaagcggatggatgactctctatcgccaagagccagagatcgtagtccggttcttgatgatgaaggcagcccaaagatcatagacgggagcccaccaccatcaccaaagcttcaaaaggaagtcggatctgaccgtgacggtggtagcccccaagacaatggcagaaactctgttgtcagtcctgttgtaggagccggtggtgacagttcgaaagaggaccggagccctgttgatgatgattacgagccaaaccgcacttcccctagaggaagtgagtctccttaactttgatggctcatggccacggcttgcaggcattgtagcatgtatactattggatcgactgttcctttctcttttaagtgtgtttgctttagaaccttttaagtttcatgttaccaagagttttttcatttgagacataatgttgttgcgtttcttttggacaagttttcgaagattgttataaggatttataaaagtttc

SEQ ID NO: 2504 - protein, 1136 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
TTTCCTTCCGAAATTAGGGCTTCCGTGTTTCGCAGTGCTCTCCTTCAATCCCCAGCTTGACAATGCCTCGCTATGATGATCGCTATGGGAACACTCGTCTTTACGTTGGCCGATTATCATCGAGAACTAGGACCCGAGACCTTGAACGTCTTTTTAGCAGATACGGAAGAGTGCGAGATGTGGATATGAAGCGAGATTATGCTTTCGTTGAATTTGGTGATCCCCGTGATGCTGATGATGCAAGACATTACCTGGACGGACGAGACTTTGATGGAAGTCGCATCACTGTGGAGTTTTCACGAGGGGCACCTCGTGGTTCTCGGGATTTTGATAGCAGAGGCCCACCACCTGGAGCTGGTCGCTGTTTTAACTGTGGTGTAGATGGTCATTGGGCTCGTGACTGCACAGCAGGGGACTGGAAGAACAAGTGTTACCGTTGTGGAGAGAGAGGACACATTGAGAGAAACTGCAAAAACAGCCCCAAGAAGCTTAGGCGCAGTGGAAGCTACTCCAGGTCACCTGTAAGATCCCGTTCTCCTCGTCGTAGAAGAAGCCCAAGCCGGAGTCTTAGCCGTAGCCGAAGCTACAGCCGATCACGATCCCCGGTGAGAAGAAGAGAGAGGAGTGTGGAGGAGAGATCACGCAGTCCAAAGCGGATGGATGACTCTCTATCGCCAAGAGCCAGAGATCGTAGTCCGGTTCTTGATGATGAAGGCAGCCCAAAGATCATAGACGGGAGCCCACCACCATCACCAAAGCTTCAAAAGGAAGTCGGATCTGACCGTGACGGTGGTAGCCCCCAAGACAATGGCAGAAACTCTGTTGTCAGTCCTGTTGTAGGAGCCGGTGGTGACAGTTCGAAAGAGGACCGGAGCCCTGTTGATGATGATTACGAGCCAAACCGCACTTCCCCTAGAGGAAGTGAGTCTCCTTAACTTTGATGGCTCATGGCCACGGCTTGCAGGCATTGTAGCATGTATACTATTGGATCGACTGTTCCTTTCTCTTTTAAGTGTGTTTGCTTTAGAACCTTTTAAGTTTCATGTTACCAAGAGTTTTTTCATTTGAGACATAATGTTGTTGCGTTTCTTTTGGACAAGTTTTCGAAGATTGTTATAAGGATTTATAAAAGTTTC

SEQ ID NO: 2505 - DNA, 1248 bp, Arabidopsis thaliana
  misc_feature (1)..(1248): Ceres cDNA ID no. 13610116
  misc_feature (1)..(1248): Also known as  Ceres CDNA ID no. 23827422
gtagggtttttaggggttttctctctctttgcaatcatggagtctctagggaagctacagcttcatcagcaaccaaatcacctctctttcactcatttctcttcatctttccccaaaaagccttcgtctttctctctcagatccttacccagatcaacatcatccttcaaatgcatttcaatcaaagcttcctcatccaagtctcaagactcgaagctctcaatcctcaaatccacatgcgtcagcttcactgcggcagcagcactgttccttgtgaatctccagctcaaaccttcaccggcgattgcggctcctgtggcggcgacgccgttaatggaatctctcaaacaaagtaacggaaacgtttcatttgaagaagaagagagatcactcgaagagtatcttgcttctcaccctgatgatgttgaagctctacgatctttaatggaggtaaggatcaaatctcgaaagcttctagaagctatagaattgattgataggttgattgaattggaaccagaggagaaggaatggccaatgttgaaagctaatatctttagttacagtggagatttagagtctgctaaaactggttttgaagagattctagtcaaagatccgcttcgtgtcgaggcttatcacggtttagttatggcttattctgattctggtgatgatttgaatgctgtggagaagagaattgaggaggcaatggttaggtgcaagaaggagaagaatcgtaaggacttgagagattttaagctactagtggcgcaaattcgggttattgaagggaagcataatgaagcattgaagttgtatgaggagcttgtgaaggaagagccgagagatttcaggccgtatctatgtcaagggattatatacacagtgttgaagaaggagaatgaggcggagaaacagtttgagaagtttaggagacttgtcccgaagaatcatccttatagagagtattttatggataatatggttgcttcgaagctctttgccgagaaggtacagcgagagatggctgaatgattgtcttacgaaatgctagtcgtgcttgaatgtggttttttttgtctcttttctgttgctaatggttttagatggttgtagtatgtaggttgagcttgaatttatgtcgtgatcgtgtgttgtagtacggatcgaatactcaatatgggaatcttgaattgcttgcactgttttttgagatgtgtatgtatacatcacgactcacgagtc

SEQ ID NO: 2506 - protein, 1248 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
GTAGGGTTTTTAGGGGTTTTCTCTCTCTTTGCAATCATGGAGTCTCTAGGGAAGCTACAGCTTCATCAGCAACCAAATCACCTCTCTTTCACTCATTTCTCTTCATCTTTCCCCAAAAAGCCTTCGTCTTTCTCTCTCAGATCCTTACCCAGATCAACATCATCCTTCAAATGCATTTCAATCAAAGCTTCCTCATCCAAGTCTCAAGACTCGAAGCTCTCAATCCTCAAATCCACATGCGTCAGCTTCACTGCGGCAGCAGCACTGTTCCTTGTGAATCTCCAGCTCAAACCTTCACCGGCGATTGCGGCTCCTGTGGCGGCGACGCCGTTAATGGAATCTCTCAAACAAAGTAACGGAAACGTTTCATTTGAAGAAGAAGAGAGATCACTCGAAGAGTATCTTGCTTCTCACCCTGATGATGTTGAAGCTCTACGATCTTTAATGGAGGTAAGGATCAAATCTCGAAAGCTTCTAGAAGCTATAGAATTGATTGATAGGTTGATTGAATTGGAACCAGAGGAGAAGGAATGGCCAATGTTGAAAGCTAATATCTTTAGTTACAGTGGAGATTTAGAGTCTGCTAAAACTGGTTTTGAAGAGATTCTAGTCAAAGATCCGCTTCGTGTCGAGGCTTATCACGGTTTAGTTATGGCTTATTCTGATTCTGGTGATGATTTGAATGCTGTGGAGAAGAGAATTGAGGAGGCAATGGTTAGGTGCAAGAAGGAGAAGAATCGTAAGGACTTGAGAGATTTTAAGCTACTAGTGGCGCAAATTCGGGTTATTGAAGGGAAGCATAATGAAGCATTGAAGTTGTATGAGGAGCTTGTGAAGGAAGAGCCGAGAGATTTCAGGCCGTATCTATGTCAAGGGATTATATACACAGTGTTGAAGAAGGAGAATGAGGCGGAGAAACAGTTTGAGAAGTTTAGGAGACTTGTCCCGAAGAATCATCCTTATAGAGAGTATTTTATGGATAATATGGTTGCTTCGAAGCTCTTTGCCGAGAAGGTACAGCGAGAGATGGCTGAATGATTGTCTTACGAAATGCTAGTCGTGCTTGAATGTGGTTTTTTTTGTCTCTTTTCTGTTGCTAATGGTTTTAGATGGTTGTAGTATGTAGGTTGAGCTTGAATTTATGTCGTGATCGTGTGTTGTAGTACGGATCGAATACTCAATATGGGAATCTTGAATTGCTTGCACTGTTTTTTGAGATGTGTATGTATACATCACGACTCACGAGTC

SEQ ID NO: 2507 - DNA, 1197 bp, Arabidopsis thaliana
  misc_feature (1)..(1197): Ceres cDNA ID no. 13610149
  misc_feature (1)..(1197): Also known as  Ceres CDNA ID no. 23827422
aaaaaattttcattcttcctccactctctcaattccaaaacactgcgccgggaagacatggacaccgagatggagacagaacaaatataccaggtcgatgtcggaaatctcttggctttcaatcccaatcaccgcttcccatctgctccttcttcaaggggggagcttgtgaaggagatcctaacggagggaacaaaacttgttcaggaaatagccaataaacttttcaactttccttctactgaaacaaatgatggtcctattgtccaattgcctccgcctacaaccaaacttcctagagagaaacatattccaaggcctaagcctcctacgaagtgggaagagtttgcgcttaagaaaggtatacagaagcgcaagaaggaaaaagttgtatgggatgaacaaactaatcagtttaagcgtcgccatggttatgaccgtgttaacgatgataatgatgttcccatcattgaggcgaaagaatcagatgaaccaggagtagatccttttgccaagagactagatgataagaagaagagagttggaaagcaagaaaagaatagacttcagaatctgaaggctgctgaaaaagctggtgctttaccaagccatgtccaacttgctgcaacatcattgcccatatcaggaacgaaagctcaaccaaagaaaattggaaaggatgaacttggagatgtagcaggtttagccgctacttcaaccgctagtggtggaaaattcgataaaaagttgcctggagaaaaacctccaaagaagcagggcaaacatcacaagtatttaccggttgtatcagggcgtggggatgttaacgcagaaaaagaacagacaaataatgtactcagcaagatattctcaaagcattcgcatgagatcctcaatgttggcaaggcgataaacatgtacaacgtcaagaaggagaagaagaagtcaggaaggtcagacaagttgaaacctaagaaggacatcaccaagaagcctgccaacaaagccaagtgaagagactctcccatgtctaatttactcttctatctgtctccatcttctatcacaaaacaaattttgggttgctctgttaaagtaatactttatgagtacgtttattttaatcttattgacttcatattttgcaccataaaacaatttaaagctcgcaaggtctagaaatccagtttgattttc

SEQ ID NO: 2508 - protein, 1197 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
AAAAAATTTTCATTCTTCCTCCACTCTCTCAATTCCAAAACACTGCGCCGGGAAGACATGGACACCGAGATGGAGACAGAACAAATATACCAGGTCGATGTCGGAAATCTCTTGGCTTTCAATCCCAATCACCGCTTCCCATCTGCTCCTTCTTCAAGGGGGGAGCTTGTGAAGGAGATCCTAACGGAGGGAACAAAACTTGTTCAGGAAATAGCCAATAAACTTTTCAACTTTCCTTCTACTGAAACAAATGATGGTCCTATTGTCCAATTGCCTCCGCCTACAACCAAACTTCCTAGAGAGAAACATATTCCAAGGCCTAAGCCTCCTACGAAGTGGGAAGAGTTTGCGCTTAAGAAAGGTATACAGAAGCGCAAGAAGGAAAAAGTTGTATGGGATGAACAAACTAATCAGTTTAAGCGTCGCCATGGTTATGACCGTGTTAACGATGATAATGATGTTCCCATCATTGAGGCGAAAGAATCAGATGAACCAGGAGTAGATCCTTTTGCCAAGAGACTAGATGATAAGAAGAAGAGAGTTGGAAAGCAAGAAAAGAATAGACTTCAGAATCTGAAGGCTGCTGAAAAAGCTGGTGCTTTACCAAGCCATGTCCAACTTGCTGCAACATCATTGCCCATATCAGGAACGAAAGCTCAACCAAAGAAAATTGGAAAGGATGAACTTGGAGATGTAGCAGGTTTAGCCGCTACTTCAACCGCTAGTGGTGGAAAATTCGATAAAAAGTTGCCTGGAGAAAAACCTCCAAAGAAGCAGGGCAAACATCACAAGTATTTACCGGTTGTATCAGGGCGTGGGGATGTTAACGCAGAAAAAGAACAGACAAATAATGTACTCAGCAAGATATTCTCAAAGCATTCGCATGAGATCCTCAATGTTGGCAAGGCGATAAACATGTACAACGTCAAGAAGGAGAAGAAGAAGTCAGGAAGGTCAGACAAGTTGAAACCTAAGAAGGACATCACCAAGAAGCCTGCCAACAAAGCCAAGTGAAGAGACTCTCCCATGTCTAATTTACTCTTCTATCTGTCTCCATCTTCTATCACAAAACAAATTTTGGGTTGCTCTGTTAAAGTAATACTTTATGAGTACGTTTATTTTAATCTTATTGACTTCATATTTTGCACCATAAAACAATTTAAAGCTCGCAAGGTCTAGAAATCCAGTTTGATTTTC

SEQ ID NO: 2509 - DNA, 1408 bp, Arabidopsis thaliana
  misc_feature (1)..(1408): Ceres cDNA ID no. 13610326
  misc_feature (1)..(1408): Also known as  Ceres CDNA ID no. 23827422
atgctgattcctctccttttcttcctcaactcataaacccgatcggccgattccttcacaattatccttaaaattttcgattttgattattgggtttctctctgatcatggcggttgttgagactggagcagcagctactgctgctgatgcaggaggagtcgtgatccagccgccgccgtcttcaccaccatcttcaatgactagtcaagattccggcgtttcttccgatgatcagaaccatcactctaggatcgatcaagttctccggcacgatcaaggtctttacagcaagatcgggtcacacgtggcgagatccgacggcgttgacggtggtgagagctttaagcgtgatatgagagagcttcaggagcttttctctaagcttaatcctatggctgaagagtttgttcctccttctctgaataaacaaggaggtaacggtgttaacggtggtttcttcacctctgctggttccttcttccgcaacaatggctttgctggtaccggaaatggcggatacggtaacgaaaacggtggtttccgacggaagaagagttttggtcaagggaaacgaaggatgaatgctcgaacaagcatggctcagcgagaagatgttatccgtagaaccgtctacgtctctgatctcgatcaacaggtcactgaagagcagcttgctggtttgtttgtgagctgtggacaggttgttgactgtcgcatatgcggtgacccaaactcggtccttcggtttgcattcatagagttcactgatgaagagggtgcgatgactgctctaaatttatcggggactatgttgggattctatcctgtgaaagttttaccatccaaaacagctatagcaccggttaacccgacatttttgcctaggactgaagatgagcgtgagatgtgtgcaagaactatctactgtactaacatagacaagaaggtgactcaatcagacgtgaagatcttttttgagtccttctgcggagaggtttatcgcctgaggctgcttggagattatcaacactcgactcgtattgcttttgtagagttcgtaatggcggaaagcgcaatagctgctctcaactgcagtggagttgttcttggttctttacctataagggtgagtccttcaaagacgcctgttcgtccgagatcaccgaggcatccaatgcattgatcttagctttacaggttttcacatatctcatgtctccgcaatatatatatcgctgtgtcgtcttaaaaacagcattacacagacatgtaaagatgtttgtctgcatctctcatctcttgttttcgaaatgtaactctgggatctgatgatgcttctttcttcttcctttacctgagaatcttttgggtaaaaaaaacctcgtagagagtttttatttatctctt

SEQ ID NO: 2510 - protein, 1408 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATGCTGATTCCTCTCCTTTTCTTCCTCAACTCATAAACCCGATCGGCCGATTCCTTCACAATTATCCTTAAAATTTTCGATTTTGATTATTGGGTTTCTCTCTGATCATGGCGGTTGTTGAGACTGGAGCAGCAGCTACTGCTGCTGATGCAGGAGGAGTCGTGATCCAGCCGCCGCCGTCTTCACCACCATCTTCAATGACTAGTCAAGATTCCGGCGTTTCTTCCGATGATCAGAACCATCACTCTAGGATCGATCAAGTTCTCCGGCACGATCAAGGTCTTTACAGCAAGATCGGGTCACACGTGGCGAGATCCGACGGCGTTGACGGTGGTGAGAGCTTTAAGCGTGATATGAGAGAGCTTCAGGAGCTTTTCTCTAAGCTTAATCCTATGGCTGAAGAGTTTGTTCCTCCTTCTCTGAATAAACAAGGAGGTAACGGTGTTAACGGTGGTTTCTTCACCTCTGCTGGTTCCTTCTTCCGCAACAATGGCTTTGCTGGTACCGGAAATGGCGGATACGGTAACGAAAACGGTGGTTTCCGACGGAAGAAGAGTTTTGGTCAAGGGAAACGAAGGATGAATGCTCGAACAAGCATGGCTCAGCGAGAAGATGTTATCCGTAGAACCGTCTACGTCTCTGATCTCGATCAACAGGTCACTGAAGAGCAGCTTGCTGGTTTGTTTGTGAGCTGTGGACAGGTTGTTGACTGTCGCATATGCGGTGACCCAAACTCGGTCCTTCGGTTTGCATTCATAGAGTTCACTGATGAAGAGGGTGCGATGACTGCTCTAAATTTATCGGGGACTATGTTGGGATTCTATCCTGTGAAAGTTTTACCATCCAAAACAGCTATAGCACCGGTTAACCCGACATTTTTGCCTAGGACTGAAGATGAGCGTGAGATGTGTGCAAGAACTATCTACTGTACTAACATAGACAAGAAGGTGACTCAATCAGACGTGAAGATCTTTTTTGAGTCCTTCTGCGGAGAGGTTTATCGCCTGAGGCTGCTTGGAGATTATCAACACTCGACTCGTATTGCTTTTGTAGAGTTCGTAATGGCGGAAAGCGCAATAGCTGCTCTCAACTGCAGTGGAGTTGTTCTTGGTTCTTTACCTATAAGGGTGAGTCCTTCAAAGACGCCTGTTCGTCCGAGATCACCGAGGCATCCAATGCATTGATCTTAGCTTTACAGGTTTTCACATATCTCATGTCTCCGCAATATATATATCGCTGTGTCGTCTTAAAAACAGCATTACACAGACATGTAAAGATGTTTGTCTGCATCTCTCATCTCTTGTTTTCGAAATGTAACTCTGGGATCTGATGATGCTTCTTTCTTCTTCCTTTACCTGAGAATCTTTTGGGTAAAAAAAACCTCGTAGAGAGTTTTTATTTATCTCTT

SEQ ID NO: 2511 - DNA, 1280 bp, Arabidopsis thaliana
  misc_feature (1)..(1280): Ceres cDNA ID no. 13610447
  misc_feature (1)..(1280): Also known as  Ceres CDNA ID no. 23827422
atcttttatttttcttttagaaaccaaacttttcagatttctctctctccatttggcgatagaagaagtcatgtaccaatcatcatcctccacgtcatcatcatcgcagagatcatcgcttcccggcggcggaggactgatccgttacggctcagctccgggatcgtttctaaactctgtggttgacgaagtcatcggaggaggctcatcaaacgctcgtgacttcaccggctatcaaccgtcgtcggataacttcatcggtaactttttcaccggagctgctgactcatcctcgctgagatccgattcgacgacttgtggagtcaacaactcatccgacggacagaaacagctaggcaataacaataataataatagtaataaagatatcttcctcgacagatcctacggtggattcaacgagatctcgcaacaacacaagagcaacgacatcggaggaggaaacagctcaggatcttactctctcgctagacaacgtagctctcccgccgatttcttcacctacctcgcctcagataaaaacaatttctcgttgaaccaaccaaccagtgattatagtccgcaaggagggtctaatgggggacgaggacattccagattgaagtctcagctaagcttcacgaatcacgactctctggctcggatcaacgaggtcaatgagaccccagtccacgacggttcaggccattcgttttctgcggctagctttggtgcagccactactgattcttgggatgacggttccggttcgatagggtttaccgtgactaggcccagtaaacgatccaaggacatggactctggtctcttttcgcagtatagtcttccttcagacacttcaatgaactacatggataacttcatgcagcttccagaagattctgtaccctgcaaaatccgggccaaacgcggctgcgccacccatcctagaagcatcgctgagcgggagaggagaacgagaataagtgggaagctaaagaagctacaagatcttgtccccaacatggataagcaaacaagctattcagacatgctggatttagctgtacaacacatcaaaggccttcagcatcaacttcagaatttgaaaaaagatcaagagaattgcacgtgtgggtgcagtgagaaaccaagctagctcaaacccaaaggtagggtcatcctaattttatttgcattgttccgattttatcatatgagagaattagagaagatgtaaataaaatagattatattaaatgtctaatcctcttataatt

SEQ ID NO: 2512 - protein, 1280 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATCTTTTATTTTTCTTTTAGAAACCAAACTTTTCAGATTTCTCTCTCTCCATTTGGCGATAGAAGAAGTCATGTACCAATCATCATCCTCCACGTCATCATCATCGCAGAGATCATCGCTTCCCGGCGGCGGAGGACTGATCCGTTACGGCTCAGCTCCGGGATCGTTTCTAAACTCTGTGGTTGACGAAGTCATCGGAGGAGGCTCATCAAACGCTCGTGACTTCACCGGCTATCAACCGTCGTCGGATAACTTCATCGGTAACTTTTTCACCGGAGCTGCTGACTCATCCTCGCTGAGATCCGATTCGACGACTTGTGGAGTCAACAACTCATCCGACGGACAGAAACAGCTAGGCAATAACAATAATAATAATAGTAATAAAGATATCTTCCTCGACAGATCCTACGGTGGATTCAACGAGATCTCGCAACAACACAAGAGCAACGACATCGGAGGAGGAAACAGCTCAGGATCTTACTCTCTCGCTAGACAACGTAGCTCTCCCGCCGATTTCTTCACCTACCTCGCCTCAGATAAAAACAATTTCTCGTTGAACCAACCAACCAGTGATTATAGTCCGCAAGGAGGGTCTAATGGGGGACGAGGACATTCCAGATTGAAGTCTCAGCTAAGCTTCACGAATCACGACTCTCTGGCTCGGATCAACGAGGTCAATGAGACCCCAGTCCACGACGGTTCAGGCCATTCGTTTTCTGCGGCTAGCTTTGGTGCAGCCACTACTGATTCTTGGGATGACGGTTCCGGTTCGATAGGGTTTACCGTGACTAGGCCCAGTAAACGATCCAAGGACATGGACTCTGGTCTCTTTTCGCAGTATAGTCTTCCTTCAGACACTTCAATGAACTACATGGATAACTTCATGCAGCTTCCAGAAGATTCTGTACCCTGCAAAATCCGGGCCAAACGCGGCTGCGCCACCCATCCTAGAAGCATCGCTGAGCGGGAGAGGAGAACGAGAATAAGTGGGAAGCTAAAGAAGCTACAAGATCTTGTCCCCAACATGGATAAGCAAACAAGCTATTCAGACATGCTGGATTTAGCTGTACAACACATCAAAGGCCTTCAGCATCAACTTCAGAATTTGAAAAAAGATCAAGAGAATTGCACGTGTGGGTGCAGTGAGAAACCAAGCTAGCTCAAACCCAAAGGTAGGGTCATCCTAATTTTATTTGCATTGTTCCGATTTTATCATATGAGAGAATTAGAGAAGATGTAAATAAAATAGATTATATTAAATGTCTAATCCTCTTATAATT

SEQ ID NO: 2513 - DNA, 1563 bp, Arabidopsis thaliana
  misc_feature (1)..(1563): Ceres cDNA ID no. 13610550
  misc_feature (1)..(1563): Also known as  Ceres CDNA ID no. 23827422
aatttaattcgatttcgacaatttcatttaattcttcgatttctccgcttgtcactgtttcgtatcgccattttctgtttgcatacacttgtatatatttatattaacagtccaaaattcttcgaaattgtcccgagctttgagcatataaaaaatgtcttcgataatccatggagctggagctgctacgacgacgttatcgacgtttaattccgtcgattccaagaaactcttcgttgctccttctcgcacaaatctttcagtgaggagccagagatatatagtggctggatctgatgcgagtaagaagagctttggttctggacttagagttcgtcactctcagaaattgattccaaatgctgttgcgacgaaggaggcggatacgtctgcgagcactggacatgaactattgcttttcgaggctcttcaggaaggtctggaagaagagatggacagagatccacatgtatgtgttatgggtgaagatgttggccattacggaggttcctacaaggtaaccaaaggccttgctgataaatttggtgacctcagggttctcgacactcctatttgtgaaaatgcattcaccggtatgggcattggagctgccatgactggtctaagacccgttattgaaggtatgaacatgggtttcctcctcctcgccttcaaccaaatctccaacaactgtggaatgcttcactacacatccggtggtcagtttacgatcccggttgtcatccgtggacctggtggagtgggacgccagcttggtgctgagcattcacagaggttagaatcttactttcagtccatccctgggatccagatggttgcttgctcaactccttacaacgccaaagggttgatgaaagccgcaataagaagcgagaaccctgtgattctgttcgaacacgtgctgctttacaatctcaaggagaaaatcccggatgaagattacgtctgtaaccttgaagaagctgagatggtcagacctggcgagcacattaccatcctcacttactcgcgaatgaggtaccatgtgatgcaggcagcaaaaactctggtgaacaaagggtatgaccccgaggttatcgacatcaggtcactgaaaccgttcgaccttcacacaattggaaactcggtgaagaaaacacatcgggttttgatcgtggaggagtgtatgagaaccggtgggattggggcaagtcttacagctgccatcaacgagaactttcatgactacttagatgctccggtgatgtgtttatcttctcaagacgttcctacaccttacgctggtacactggaggagtggaccgtggttcaaccggctcagatcgtgaccgctgtcgagcagctttgccagtaaattcatatttatccgatgaaccattatttatcatttacctctccatttcctttctctgtagcttagttcttaaagaatttgtctaagatggtttgtttttgttaaagtttgtctcctttgttgtgtcttttaatatggtttgtaactcagaatgtttgtttgttaattttatctcccactttctttta

SEQ ID NO: 2514 - protein, 1563 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
AATTTAATTCGATTTCGACAATTTCATTTAATTCTTCGATTTCTCCGCTTGTCACTGTTTCGTATCGCCATTTTCTGTTTGCATACACTTGTATATATTTATATTAACAGTCCAAAATTCTTCGAAATTGTCCCGAGCTTTGAGCATATAAAAAATGTCTTCGATAATCCATGGAGCTGGAGCTGCTACGACGACGTTATCGACGTTTAATTCCGTCGATTCCAAGAAACTCTTCGTTGCTCCTTCTCGCACAAATCTTTCAGTGAGGAGCCAGAGATATATAGTGGCTGGATCTGATGCGAGTAAGAAGAGCTTTGGTTCTGGACTTAGAGTTCGTCACTCTCAGAAATTGATTCCAAATGCTGTTGCGACGAAGGAGGCGGATACGTCTGCGAGCACTGGACATGAACTATTGCTTTTCGAGGCTCTTCAGGAAGGTCTGGAAGAAGAGATGGACAGAGATCCACATGTATGTGTTATGGGTGAAGATGTTGGCCATTACGGAGGTTCCTACAAGGTAACCAAAGGCCTTGCTGATAAATTTGGTGACCTCAGGGTTCTCGACACTCCTATTTGTGAAAATGCATTCACCGGTATGGGCATTGGAGCTGCCATGACTGGTCTAAGACCCGTTATTGAAGGTATGAACATGGGTTTCCTCCTCCTCGCCTTCAACCAAATCTCCAACAACTGTGGAATGCTTCACTACACATCCGGTGGTCAGTTTACGATCCCGGTTGTCATCCGTGGACCTGGTGGAGTGGGACGCCAGCTTGGTGCTGAGCATTCACAGAGGTTAGAATCTTACTTTCAGTCCATCCCTGGGATCCAGATGGTTGCTTGCTCAACTCCTTACAACGCCAAAGGGTTGATGAAAGCCGCAATAAGAAGCGAGAACCCTGTGATTCTGTTCGAACACGTGCTGCTTTACAATCTCAAGGAGAAAATCCCGGATGAAGATTACGTCTGTAACCTTGAAGAAGCTGAGATGGTCAGACCTGGCGAGCACATTACCATCCTCACTTACTCGCGAATGAGGTACCATGTGATGCAGGCAGCAAAAACTCTGGTGAACAAAGGGTATGACCCCGAGGTTATCGACATCAGGTCACTGAAACCGTTCGACCTTCACACAATTGGAAACTCGGTGAAGAAAACACATCGGGTTTTGATCGTGGAGGAGTGTATGAGAACCGGTGGGATTGGGGCAAGTCTTACAGCTGCCATCAACGAGAACTTTCATGACTACTTAGATGCTCCGGTGATGTGTTTATCTTCTCAAGACGTTCCTACACCTTACGCTGGTACACTGGAGGAGTGGACCGTGGTTCAACCGGCTCAGATCGTGACCGCTGTCGAGCAGCTTTGCCAGTAAATTCATATTTATCCGATGAACCATTATTTATCATTTACCTCTCCATTTCCTTTCTCTGTAGCTTAGTTCTTAAAGAATTTGTCTAAGATGGTTTGTTTTTGTTAAAGTTTGTCTCCTTTGTTGTGTCTTTTAATATGGTTTGTAACTCAGAATGTTTGTTTGTTAATTTTATCTCCCACTTTCTTTTA

SEQ ID NO: 2515 - DNA, 1420 bp, Arabidopsis thaliana
  misc_feature (1)..(1420): Ceres cDNA ID no. 13610588
  misc_feature (1)..(1420): Also known as  Ceres CDNA ID no. 23827422
gtattgtgttgttggagactgaaccatcaacgctttttcgacacttcttcttcttcctcctttctctcttcatgcaaaatcacagttacaagaaataaacaaaagattataaatcaaaacataaagagacaaaaatgagtgatggtcgagttaacgcagatcctcaacaagaagagaacatggttaaaccaccggttaagagatctctcactctcctcatcgtgacttacttttttctcttcttcggctctatcgcttcgagccttctcgcgaagtactatttcgtctacggtggctcgagccggtgggtctccacgtgggttcaatctgctggcttccctctcctcctcatcctaatctacttccctcactacgttctcaaaaccaccactcgccgtcctttcacgcgcttcacgctccgccatctcatcttctccgtgttgatcgggcttgttctcggtttcaacaacttcctcttctcatggggaacctcgtaccttccggtgtccacgtcatcgcttctcctctcgacacaactcgtcttcactctcattttgtctaggatcatagtgaaacagaagatcactttctcaaacctcaactgcgttgtcctgttgacgttaagctctgttttgttggctcttgattcgagtaaagataaaccgtccggtttaaccaaaaccaagtatttcatcgggtatgtatccacgatcggagccggtttactcttcgctctttacctccccgtgacggagaagctataccgtaccgtttattgttacgcgatggtcatggaggtgcaactggtgatggaattcgcagcgacggttttcgcgacaatcggtatggcttgcgaaggcgggtttaaggaaatggttaaggaagcgaaccatgttttcaccaaaggaccaacattttattggacgtttgcgatactagcaaatgtggtgacgtggcagctctctttcgcagccacgtcagggatggtttacttgacgtcaggtatcaccggaggtatctgcatgacggcgttgctcgcgatgaatgtgataggaggtgtggtggcttacggtgacgtgtttggtggagtgaagattgtgtcgacggtgctatgtatttggggattctcatcttacacatacgggatgtatatgaagatgaagaaggaggagaaggagaagggagaatattccggcgtaaagacgacggaagacagcggagagatggaggtggaaatgggaaatgttaaagatgacgtggcggcggcggatgatagggcttgaagatatctgtgtgattgagacggccgttatgattattattaggaaggaagccaacaaaaaaaaaaaaagtagtagtatctttttgtgttctttctttttctcaccttatgtttttttagtaatgcatttgcttttgt

SEQ ID NO: 2516 - protein, 1420 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
GTATTGTGTTGTTGGAGACTGAACCATCAACGCTTTTTCGACACTTCTTCTTCTTCCTCCTTTCTCTCTTCATGCAAAATCACAGTTACAAGAAATAAACAAAAGATTATAAATCAAAACATAAAGAGACAAAAATGAGTGATGGTCGAGTTAACGCAGATCCTCAACAAGAAGAGAACATGGTTAAACCACCGGTTAAGAGATCTCTCACTCTCCTCATCGTGACTTACTTTTTTCTCTTCTTCGGCTCTATCGCTTCGAGCCTTCTCGCGAAGTACTATTTCGTCTACGGTGGCTCGAGCCGGTGGGTCTCCACGTGGGTTCAATCTGCTGGCTTCCCTCTCCTCCTCATCCTAATCTACTTCCCTCACTACGTTCTCAAAACCACCACTCGCCGTCCTTTCACGCGCTTCACGCTCCGCCATCTCATCTTCTCCGTGTTGATCGGGCTTGTTCTCGGTTTCAACAACTTCCTCTTCTCATGGGGAACCTCGTACCTTCCGGTGTCCACGTCATCGCTTCTCCTCTCGACACAACTCGTCTTCACTCTCATTTTGTCTAGGATCATAGTGAAACAGAAGATCACTTTCTCAAACCTCAACTGCGTTGTCCTGTTGACGTTAAGCTCTGTTTTGTTGGCTCTTGATTCGAGTAAAGATAAACCGTCCGGTTTAACCAAAACCAAGTATTTCATCGGGTATGTATCCACGATCGGAGCCGGTTTACTCTTCGCTCTTTACCTCCCCGTGACGGAGAAGCTATACCGTACCGTTTATTGTTACGCGATGGTCATGGAGGTGCAACTGGTGATGGAATTCGCAGCGACGGTTTTCGCGACAATCGGTATGGCTTGCGAAGGCGGGTTTAAGGAAATGGTTAAGGAAGCGAACCATGTTTTCACCAAAGGACCAACATTTTATTGGACGTTTGCGATACTAGCAAATGTGGTGACGTGGCAGCTCTCTTTCGCAGCCACGTCAGGGATGGTTTACTTGACGTCAGGTATCACCGGAGGTATCTGCATGACGGCGTTGCTCGCGATGAATGTGATAGGAGGTGTGGTGGCTTACGGTGACGTGTTTGGTGGAGTGAAGATTGTGTCGACGGTGCTATGTATTTGGGGATTCTCATCTTACACATACGGGATGTATATGAAGATGAAGAAGGAGGAGAAGGAGAAGGGAGAATATTCCGGCGTAAAGACGACGGAAGACAGCGGAGAGATGGAGGTGGAAATGGGAAATGTTAAAGATGACGTGGCGGCGGCGGATGATAGGGCTTGAAGATATCTGTGTGATTGAGACGGCCGTTATGATTATTATTAGGAAGGAAGCCAACAAAAAAAAAAAAAGTAGTAGTATCTTTTTGTGTTCTTTCTTTTTCTCACCTTATGTTTTTTTAGTAATGCATTTGCTTTTGT

SEQ ID NO: 2517 - DNA, 1246 bp, Arabidopsis thaliana
  misc_feature (1)..(1246): Ceres cDNA ID no. 13610630
  misc_feature (1)..(1246): Also known as  Ceres CDNA ID no. 23827422
aacgccatttgttgtcactcactctgtaaagtataaaccctaaaaatcgaatctttccgattagccgatccctccaccggaaaatcggaagtagaagcgtaaatggcggatgttgaagatcgtgcggcgaaggggatctctgactacgatcaaggtggtgtaaagacgacggaactggaaaggaagattgaggatatggagaacaagaatcaggagctcacgagagagaatcgtgaattgaaggagaggttagagaggcttacgggagaaattgaagagatgaaagacgtagaagcggagatgaatcagagattcggagagatggagaaagagatcgaggagtacgaggaagagaagaaggctttggaagctatttctactagagctgtggagcttgaaactgaggtgtcgaatcttcatgacgatctgatcacttccttgaacggagtggataagacggcggaagaagtggcggagctgaagaaagcgttggcggagatagtggagaagctggaggggtgtgagaaggaagctgagggtttaaggaaagatagagctgaggttgagaagagggttagggatttggaaaggaagattggggttttggaagtgagggaaatggaggagaagagtaagaaacttagatcagaagaggaaatgagggagatagatgatgagaaaaagagagagattgaggaattgcagaagacagtcattgttttgaatctggaattggtgaagaatgtagaagaattgaagaaatggaagtctaagaagaagctcacggaggaagctttgagtgaaactcaaaaacgagagaaggagctggagttgaagaaggacgagttactgaagaaggttgaggaaggtaacaagacggtttttgctttgaatgagagaaccatgaagcctagtaatggagtcagagacacaaatggtggtgaccaaaagggttccttggaagctgagtatcagtggccagtggttgctgctggatcagttggagctgctggtttggttgcagcgacctttttcgtctgctattctaagctaaggtgattttgatgaatatgttagtgaaagaataactgatgaccaagttcttaagattgatatctgggatggaattatataggttggctacaaatttgttttgggtttggatttgagtttgtgatgtttgttggttgttggctatcatacttttgttgatgagatcagcatttggtaactgttctttatcact

SEQ ID NO: 2518 - protein, 1246 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
AACGCCATTTGTTGTCACTCACTCTGTAAAGTATAAACCCTAAAAATCGAATCTTTCCGATTAGCCGATCCCTCCACCGGAAAATCGGAAGTAGAAGCGTAAATGGCGGATGTTGAAGATCGTGCGGCGAAGGGGATCTCTGACTACGATCAAGGTGGTGTAAAGACGACGGAACTGGAAAGGAAGATTGAGGATATGGAGAACAAGAATCAGGAGCTCACGAGAGAGAATCGTGAATTGAAGGAGAGGTTAGAGAGGCTTACGGGAGAAATTGAAGAGATGAAAGACGTAGAAGCGGAGATGAATCAGAGATTCGGAGAGATGGAGAAAGAGATCGAGGAGTACGAGGAAGAGAAGAAGGCTTTGGAAGCTATTTCTACTAGAGCTGTGGAGCTTGAAACTGAGGTGTCGAATCTTCATGACGATCTGATCACTTCCTTGAACGGAGTGGATAAGACGGCGGAAGAAGTGGCGGAGCTGAAGAAAGCGTTGGCGGAGATAGTGGAGAAGCTGGAGGGGTGTGAGAAGGAAGCTGAGGGTTTAAGGAAAGATAGAGCTGAGGTTGAGAAGAGGGTTAGGGATTTGGAAAGGAAGATTGGGGTTTTGGAAGTGAGGGAAATGGAGGAGAAGAGTAAGAAACTTAGATCAGAAGAGGAAATGAGGGAGATAGATGATGAGAAAAAGAGAGAGATTGAGGAATTGCAGAAGACAGTCATTGTTTTGAATCTGGAATTGGTGAAGAATGTAGAAGAATTGAAGAAATGGAAGTCTAAGAAGAAGCTCACGGAGGAAGCTTTGAGTGAAACTCAAAAACGAGAGAAGGAGCTGGAGTTGAAGAAGGACGAGTTACTGAAGAAGGTTGAGGAAGGTAACAAGACGGTTTTTGCTTTGAATGAGAGAACCATGAAGCCTAGTAATGGAGTCAGAGACACAAATGGTGGTGACCAAAAGGGTTCCTTGGAAGCTGAGTATCAGTGGCCAGTGGTTGCTGCTGGATCAGTTGGAGCTGCTGGTTTGGTTGCAGCGACCTTTTTCGTCTGCTATTCTAAGCTAAGGTGATTTTGATGAATATGTTAGTGAAAGAATAACTGATGACCAAGTTCTTAAGATTGATATCTGGGATGGAATTATATAGGTTGGCTACAAATTTGTTTTGGGTTTGGATTTGAGTTTGTGATGTTTGTTGGTTGTTGGCTATCATACTTTTGTTGATGAGATCAGCATTTGGTAACTGTTCTTTATCACT

SEQ ID NO: 2519 - DNA, 1333 bp, Arabidopsis thaliana
  misc_feature (1)..(1333): Ceres cDNA ID no. 13610897
  misc_feature (1)..(1333): Also known as  Ceres CDNA ID no. 23827422
acatcttccttgtttcttctctctctctctctcccctcaaacttaaattcacattttaatacttgttacttcaactataataataataataatctttcttcattatatattttcctctcctctcagatcttctctctcaccatcttctcttgagatcaagattgagtattcttgtctcaagaatcgatactcgagagctcttatggaccaaaatggtcataacgacgaagcagaaacagtttcatgcggcaacggcaactgcaaaagcaagatcgtgcctggagatgatcacggtggagatgagagtagtggtaccaagagaaggaagaagagaaaaacgcaacaaaagacaatgaaacgacgtgaattaatgtcgtattgtgagctaccggagtacatgaaagacaacgaatacatattgaattattacagagctgattggtccattagagatgctttcttcagcgtatttagtttccacaatgagtccctcaatgtttggacacatttgattggttttatcttctttgtggcactaaccgtcgccaatattattcatcacgacggattcttccccgtggatgcaaagagtccagggaatgtaacaagatggcccttcttcgttttcttaggaggctcaatgttctgcctactcgcaagcagcatttgtcacctcttctgttgccactcaaaagagcttaatgtcttccttctccgaatagactatgccggtatcaccgccatgatcatcacttccttcttcccaccaatcttctacatcttccagtgcactcctcggtggtacttcatctacctcgcaggcatcacatccatgggaatcttcacaatcatcacacttttcaccccatcactttccgctcccaagtaccgagctttccgcgctttgctctttgcctccatggggctgtttgggattgtcccagctgcccacgcgctagtggtcaattggggaaacccgcaaaggaacgtgacgctcgtgtacgagttgcttatggcagtgttctatcttgttggaacaggattctacgtagggagagtgccagaaaggcttaaaccgggatggtttgatcgtgtgggacatagtcatcagatcttccatgtgttcgttttgttgggtgctttgtctcactatgcagctgctctcttgttcttggactggcgtgaccacgttggttgttaaaccatatatttgtaattcttttaaatataatattattaatttgttgtatcgtggtgaacaaaattgtaataacccatttgttttaaattgaattgtaattcaacttgtgttaattgttatgtttgttgaata

SEQ ID NO: 2520 - protein, 1333 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ACATCTTCCTTGTTTCTTCTCTCTCTCTCTCTCCCCTCAAACTTAAATTCACATTTTAATACTTGTTACTTCAACTATAATAATAATAATAATCTTTCTTCATTATATATTTTCCTCTCCTCTCAGATCTTCTCTCTCACCATCTTCTCTTGAGATCAAGATTGAGTATTCTTGTCTCAAGAATCGATACTCGAGAGCTCTTATGGACCAAAATGGTCATAACGACGAAGCAGAAACAGTTTCATGCGGCAACGGCAACTGCAAAAGCAAGATCGTGCCTGGAGATGATCACGGTGGAGATGAGAGTAGTGGTACCAAGAGAAGGAAGAAGAGAAAAACGCAACAAAAGACAATGAAACGACGTGAATTAATGTCGTATTGTGAGCTACCGGAGTACATGAAAGACAACGAATACATATTGAATTATTACAGAGCTGATTGGTCCATTAGAGATGCTTTCTTCAGCGTATTTAGTTTCCACAATGAGTCCCTCAATGTTTGGACACATTTGATTGGTTTTATCTTCTTTGTGGCACTAACCGTCGCCAATATTATTCATCACGACGGATTCTTCCCCGTGGATGCAAAGAGTCCAGGGAATGTAACAAGATGGCCCTTCTTCGTTTTCTTAGGAGGCTCAATGTTCTGCCTACTCGCAAGCAGCATTTGTCACCTCTTCTGTTGCCACTCAAAAGAGCTTAATGTCTTCCTTCTCCGAATAGACTATGCCGGTATCACCGCCATGATCATCACTTCCTTCTTCCCACCAATCTTCTACATCTTCCAGTGCACTCCTCGGTGGTACTTCATCTACCTCGCAGGCATCACATCCATGGGAATCTTCACAATCATCACACTTTTCACCCCATCACTTTCCGCTCCCAAGTACCGAGCTTTCCGCGCTTTGCTCTTTGCCTCCATGGGGCTGTTTGGGATTGTCCCAGCTGCCCACGCGCTAGTGGTCAATTGGGGAAACCCGCAAAGGAACGTGACGCTCGTGTACGAGTTGCTTATGGCAGTGTTCTATCTTGTTGGAACAGGATTCTACGTAGGGAGAGTGCCAGAAAGGCTTAAACCGGGATGGTTTGATCGTGTGGGACATAGTCATCAGATCTTCCATGTGTTCGTTTTGTTGGGTGCTTTGTCTCACTATGCAGCTGCTCTCTTGTTCTTGGACTGGCGTGACCACGTTGGTTGTTAAACCATATATTTGTAATTCTTTTAAATATAATATTATTAATTTGTTGTATCGTGGTGAACAAAATTGTAATAACCCATTTGTTTTAAATTGAATTGTAATTCAACTTGTGTTAATTGTTATGTTTGTTGAATA

SEQ ID NO: 2521 - DNA, 1486 bp, Arabidopsis thaliana
  misc_feature (1)..(1486): Ceres cDNA ID no. 13611057
  misc_feature (1)..(1486): Also known as  Ceres CDNA ID no. 23827422
atgcaagcatttgttagtataaacaaaaaagccacgtggcttctcttctccactcctctttttattccttcccaaacaagaaggttagttattattatttccagagaagcttctcttttgattctctcgctctctctttcttcatcgcctcttcgagcttcgatggttgggaatattctggtgaccggtggtgctggttacatcggaagtcacacggttcttcagcttcttctcggaggctataacaccgtcgttatagacaacctcgacaattcctctctcgtttcgatccaacgcgtcaaggatctcgccggagatcatggacaaaatctcaccgtccaccaggtggaccttcgcgataaacccgcacttgagaaggttttctccgaaacaaagtttgatgcagtaatgcattttgctggattgaaagcagttggtgagagcgtggcgaaaccacttctgtattataacaataacttgattgcgactattacacttttggaagtaatggctgcacacggatgtaaaaagcttgtattttcttcgtccgctactgtgtatggctggccaaaggaggttccttgtacagaagagtctcccctgtctggaatgagtccttatggacggacaaagctgttcatagaggacatttgccgtgatgtacaacgtggtgatcctgaatggagaatcataatgctgaggtactttaaccctgtgggagctcaccctagcggtcgcattggtgaggatccttgtgggactccaaataatctcatgccttatgtccagcaagtcgttgttgggaggctacctaacctaaaaatttatggaactgactataccactaaagatggcactggtgtacgagactatattcatgttgttgatctagcagatggccatatatgtgcgcttcaaaagctagacgatactgaaataggttgtgaggtatacaacctgggaaccggaaaaggaacaacagtgttggagatggttgatgcatttgagaaagcttctggaatgaaaatcccactggtgaaggttggaaggagaccaggtgatgcagaaaccgtctatgcgtcaacagaaaaagctgaacgcgaactaaactggaaggcaaattttggaatcgaagaaatgtgtagggatcagtggaactgggcaagcaacaatcctttcggttacggttcttcaccaaactcaacataacgaagctaatgtatccaacactccattctttttcttttgggtcgtcggctgttatctttatgttacacactcaggttttagctttaaagcctaaacacagtgagggagaagttacttctctattcatatatctgctttctccttttgtaatttatatatatcttatatacgcataggtttaacttaagcggatccttttgttttttggatttgtataatctctcttaggaaattaattgtcatgggattatatttgtattaaatagaaactgaattc

SEQ ID NO: 2522 - protein, 1486 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATGCAAGCATTTGTTAGTATAAACAAAAAAGCCACGTGGCTTCTCTTCTCCACTCCTCTTTTTATTCCTTCCCAAACAAGAAGGTTAGTTATTATTATTTCCAGAGAAGCTTCTCTTTTGATTCTCTCGCTCTCTCTTTCTTCATCGCCTCTTCGAGCTTCGATGGTTGGGAATATTCTGGTGACCGGTGGTGCTGGTTACATCGGAAGTCACACGGTTCTTCAGCTTCTTCTCGGAGGCTATAACACCGTCGTTATAGACAACCTCGACAATTCCTCTCTCGTTTCGATCCAACGCGTCAAGGATCTCGCCGGAGATCATGGACAAAATCTCACCGTCCACCAGGTGGACCTTCGCGATAAACCCGCACTTGAGAAGGTTTTCTCCGAAACAAAGTTTGATGCAGTAATGCATTTTGCTGGATTGAAAGCAGTTGGTGAGAGCGTGGCGAAACCACTTCTGTATTATAACAATAACTTGATTGCGACTATTACACTTTTGGAAGTAATGGCTGCACACGGATGTAAAAAGCTTGTATTTTCTTCGTCCGCTACTGTGTATGGCTGGCCAAAGGAGGTTCCTTGTACAGAAGAGTCTCCCCTGTCTGGAATGAGTCCTTATGGACGGACAAAGCTGTTCATAGAGGACATTTGCCGTGATGTACAACGTGGTGATCCTGAATGGAGAATCATAATGCTGAGGTACTTTAACCCTGTGGGAGCTCACCCTAGCGGTCGCATTGGTGAGGATCCTTGTGGGACTCCAAATAATCTCATGCCTTATGTCCAGCAAGTCGTTGTTGGGAGGCTACCTAACCTAAAAATTTATGGAACTGACTATACCACTAAAGATGGCACTGGTGTACGAGACTATATTCATGTTGTTGATCTAGCAGATGGCCATATATGTGCGCTTCAAAAGCTAGACGATACTGAAATAGGTTGTGAGGTATACAACCTGGGAACCGGAAAAGGAACAACAGTGTTGGAGATGGTTGATGCATTTGAGAAAGCTTCTGGAATGAAAATCCCACTGGTGAAGGTTGGAAGGAGACCAGGTGATGCAGAAACCGTCTATGCGTCAACAGAAAAAGCTGAACGCGAACTAAACTGGAAGGCAAATTTTGGAATCGAAGAAATGTGTAGGGATCAGTGGAACTGGGCAAGCAACAATCCTTTCGGTTACGGTTCTTCACCAAACTCAACATAACGAAGCTAATGTATCCAACACTCCATTCTTTTTCTTTTGGGTCGTCGGCTGTTATCTTTATGTTACACACTCAGGTTTTAGCTTTAAAGCCTAAACACAGTGAGGGAGAAGTTACTTCTCTATTCATATATCTGCTTTCTCCTTTTGTAATTTATATATATCTTATATACGCATAGGTTTAACTTAAGCGGATCCTTTTGTTTTTTGGATTTGTATAATCTCTCTTAGGAAATTAATTGTCATGGGATTATATTTGTATTAAATAGAAACTGAATTC

SEQ ID NO: 2523 - DNA, 1122 bp, Arabidopsis thaliana
  misc_feature (1)..(1122): Ceres cDNA ID no. 13611209
  misc_feature (1)..(1122): Also known as  Ceres CDNA ID no. 23827422
ccaaacatatacatcaaagcttgactctctttttctctcccatggaatcaacaaagaagcaagtctcgttggagctacttccatggttagttgtccacaccgatggaacggtagagagactagcgggaaccgaggtttgtcctcccggtttggatccaataaccggggttttctctaaagatatcattatcgaaccgaaaaccggtttatctgcccgaatctatcgacccttctcgattcaacccggtcagaagattcctctcatgctctattttcatggcggtgcatttctcatctcctccacttccttcccctcttaccacaccagtcttaacaaaattgtcaatcaggctaacgtcatagccgtctctgtcaattacagactagcaccagaacatccacttcctacagcgtacgaagactcatggactgcgctaaagaatatccaagccataaacgagccgtggatcaacgactacgccgacttggacagtttattcctagtgggagatagcgcgggagctaatatctcgcaccacctcgcatttcgagccaaacaatctgaccaaaccttgaaaatcaaaggcattggaatgatccacccatatttttgggggacacaacctatcggagcagagatcaaagacgaagcgaggaaacaaatggtggacggatggtgggaattcgtgtgcccatccgagaaaggatccgatgacccgtggattaatccgtttgcggacgggtcaccggatcttggagggttagggtgtgagagagtgatgattactgtggcggagaaagatatattgaatgagagagggaagatgtattacgaaagattggtgaagagtgagtggaaaggaaaggttgagattatggagacgaaagagaaagatcatgtttttcatattttcgagccagattgtgatgaagctatggagatggtacgatgcttggctctctttataaaccaagttgaagcttgatattatttgttttgccaaaatttgatggcttttttaatgtttgtataatttttacatgtttgttaatgttgttgttattgtcttttcttttaaatttgtgtattacatttatatgtggttaaatttgtgttttttc

SEQ ID NO: 2524 - protein, 1122 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
CCAAACATATACATCAAAGCTTGACTCTCTTTTTCTCTCCCATGGAATCAACAAAGAAGCAAGTCTCGTTGGAGCTACTTCCATGGTTAGTTGTCCACACCGATGGAACGGTAGAGAGACTAGCGGGAACCGAGGTTTGTCCTCCCGGTTTGGATCCAATAACCGGGGTTTTCTCTAAAGATATCATTATCGAACCGAAAACCGGTTTATCTGCCCGAATCTATCGACCCTTCTCGATTCAACCCGGTCAGAAGATTCCTCTCATGCTCTATTTTCATGGCGGTGCATTTCTCATCTCCTCCACTTCCTTCCCCTCTTACCACACCAGTCTTAACAAAATTGTCAATCAGGCTAACGTCATAGCCGTCTCTGTCAATTACAGACTAGCACCAGAACATCCACTTCCTACAGCGTACGAAGACTCATGGACTGCGCTAAAGAATATCCAAGCCATAAACGAGCCGTGGATCAACGACTACGCCGACTTGGACAGTTTATTCCTAGTGGGAGATAGCGCGGGAGCTAATATCTCGCACCACCTCGCATTTCGAGCCAAACAATCTGACCAAACCTTGAAAATCAAAGGCATTGGAATGATCCACCCATATTTTTGGGGGACACAACCTATCGGAGCAGAGATCAAAGACGAAGCGAGGAAACAAATGGTGGACGGATGGTGGGAATTCGTGTGCCCATCCGAGAAAGGATCCGATGACCCGTGGATTAATCCGTTTGCGGACGGGTCACCGGATCTTGGAGGGTTAGGGTGTGAGAGAGTGATGATTACTGTGGCGGAGAAAGATATATTGAATGAGAGAGGGAAGATGTATTACGAAAGATTGGTGAAGAGTGAGTGGAAAGGAAAGGTTGAGATTATGGAGACGAAAGAGAAAGATCATGTTTTTCATATTTTCGAGCCAGATTGTGATGAAGCTATGGAGATGGTACGATGCTTGGCTCTCTTTATAAACCAAGTTGAAGCTTGATATTATTTGTTTTGCCAAAATTTGATGGCTTTTTTAATGTTTGTATAATTTTTACATGTTTGTTAATGTTGTTGTTATTGTCTTTTCTTTTAAATTTGTGTATTACATTTATATGTGGTTAAATTTGTGTTTTTTC

SEQ ID NO: 2525 - DNA, 1463 bp, Arabidopsis thaliana
  misc_feature (1)..(1463): Ceres cDNA ID no. 13611301
  misc_feature (1)..(1463): Also known as  Ceres CDNA ID no. 23827422
atggcagggacagtagtattgagatgctgcactagtgtaaccaagggtttaaaggcatatttctttctcacgctccggcgaaaaaccctaatttctgctaagatcaaatcaggaatggtgctcagaaacttaaccatttcttacgaaatcatcaaatctctgaaacatgccaaagaacatagtttagggattcaaatccgatggatctcgagcctgaaagtggtatggaagaaagacacgaggctagacgaagccatcgagcaggacaagcgttacaagctctgtgctcgggttgtgaaagaagtcctgaacgagccaggtcaagtcattcctctcagatacctcgaaaaacggcgcgagaggctacgtctcactttcaaagctaagagctttgttgaaatgaacccttccctgttcgagatctactacgatcggatcaaacccaagtccgatcccgtccaattcctccgccccacgcctcgtctcagagctttcctcgacgaagagcagaggatttactctgagaatgagcctttacttgtttccaagctctgccaattgctgatgatggctaaagataaggttatcagtgcagataaactggttcatgtgaagagagatttcggatttccgaacgattttctgatgaaattggttcagaaataccctaattacttcaggctaaccggtttacctgaagaaggtaagtcctttcttgagctagtctcttggaaccctgatttcgccaaatcgaagattgagctgagagcagaagacgagacccttaaaaccggtgtccggattcgacccaattacaatgtgaaattgccgtctggttttttcctaaggaaggagatgagagagtggactagggattggttagagcaagactacatatcaccatatgaggatgtgtctcatttagaccaagcttctaaggaaatggagaaacgaactgttggtgttgtgcacgaattgctttctctgtcactgttgaaaagagtccctgtgcctacacttggcaagttctgcgatgagttccggttttccaacgcgttctcgagtgttttcactcgtcattcaggtatattctacttgtcgttaaaaggagggatcaagactgcagtgttgagagaagcttataaagacgatgagcttgttgatagagatcctttgcttgctattaaggataagttcctgaggttattagaggaaggatggcaagaaaggaaagatagactgaagctgcagagggaacaagttcagaaagacagggagatgatgttagcagcgaaaagcaatgaaccgatagagcgtctctgtgattaactttacaatcaagactctgtttatgtcctctgttttttctctaggcatagttcttggcctggtttggtctttagggtggatggttaagtttgtaagtttttggctaataagagataaataatcaaatgttaatc

SEQ ID NO: 2526 - protein, 1463 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATGGCAGGGACAGTAGTATTGAGATGCTGCACTAGTGTAACCAAGGGTTTAAAGGCATATTTCTTTCTCACGCTCCGGCGAAAAACCCTAATTTCTGCTAAGATCAAATCAGGAATGGTGCTCAGAAACTTAACCATTTCTTACGAAATCATCAAATCTCTGAAACATGCCAAAGAACATAGTTTAGGGATTCAAATCCGATGGATCTCGAGCCTGAAAGTGGTATGGAAGAAAGACACGAGGCTAGACGAAGCCATCGAGCAGGACAAGCGTTACAAGCTCTGTGCTCGGGTTGTGAAAGAAGTCCTGAACGAGCCAGGTCAAGTCATTCCTCTCAGATACCTCGAAAAACGGCGCGAGAGGCTACGTCTCACTTTCAAAGCTAAGAGCTTTGTTGAAATGAACCCTTCCCTGTTCGAGATCTACTACGATCGGATCAAACCCAAGTCCGATCCCGTCCAATTCCTCCGCCCCACGCCTCGTCTCAGAGCTTTCCTCGACGAAGAGCAGAGGATTTACTCTGAGAATGAGCCTTTACTTGTTTCCAAGCTCTGCCAATTGCTGATGATGGCTAAAGATAAGGTTATCAGTGCAGATAAACTGGTTCATGTGAAGAGAGATTTCGGATTTCCGAACGATTTTCTGATGAAATTGGTTCAGAAATACCCTAATTACTTCAGGCTAACCGGTTTACCTGAAGAAGGTAAGTCCTTTCTTGAGCTAGTCTCTTGGAACCCTGATTTCGCCAAATCGAAGATTGAGCTGAGAGCAGAAGACGAGACCCTTAAAACCGGTGTCCGGATTCGACCCAATTACAATGTGAAATTGCCGTCTGGTTTTTTCCTAAGGAAGGAGATGAGAGAGTGGACTAGGGATTGGTTAGAGCAAGACTACATATCACCATATGAGGATGTGTCTCATTTAGACCAAGCTTCTAAGGAAATGGAGAAACGAACTGTTGGTGTTGTGCACGAATTGCTTTCTCTGTCACTGTTGAAAAGAGTCCCTGTGCCTACACTTGGCAAGTTCTGCGATGAGTTCCGGTTTTCCAACGCGTTCTCGAGTGTTTTCACTCGTCATTCAGGTATATTCTACTTGTCGTTAAAAGGAGGGATCAAGACTGCAGTGTTGAGAGAAGCTTATAAAGACGATGAGCTTGTTGATAGAGATCCTTTGCTTGCTATTAAGGATAAGTTCCTGAGGTTATTAGAGGAAGGATGGCAAGAAAGGAAAGATAGACTGAAGCTGCAGAGGGAACAAGTTCAGAAAGACAGGGAGATGATGTTAGCAGCGAAAAGCAATGAACCGATAGAGCGTCTCTGTGATTAACTTTACAATCAAGACTCTGTTTATGTCCTCTGTTTTTTCTCTAGGCATAGTTCTTGGCCTGGTTTGGTCTTTAGGGTGGATGGTTAAGTTTGTAAGTTTTTGGCTAATAAGAGATAAATAATCAAATGTTAATC

SEQ ID NO: 2527 - DNA, 1039 bp, Arabidopsis thaliana
  misc_feature (1)..(1039): Ceres cDNA ID no. 13611314
  misc_feature (1)..(1039): Also known as  Ceres CDNA ID no. 23827422
aatatgcctaggaagaagaaagagtgtaacaaacaaacaaaaaagttagtgaactactaaacaacactcacaccaaaaagacgacgatggtttcgtttcgcttccctttctcgttttctcagcccccgcgtgccaccacgtcattctccggattctccatttccgctgtcgctgtctccgtcaccgttggcgccgcagccgccggagctgcgatcgcggcgtcccggaatcccagccatccgattctagagtgggccttctcctctcaccgttcgtctctttcaccatggggatctataactctagcagacgaatccgttgtcgaacctaagaccggtttctcgtttcccgcttcaatcggagattcccggcgattactcggcgtcggcctgaggaagaagagcttactgggattgaagaacatcgatgtctacgccttcggcgtgtatgctgattgtgatgatgtgaagaaacttgtgggagacaagtacgcaaatcttccagcttcagagatcaggggaaacaagtcattcatggatgatctcatggaagccgatattaagatgacgataaggctacagattgtctacggcaaactcaacatccgatccgtgcgtaatgctttccaagagtctgttggaaacagactcaagaagttcggtggctcagacaatgacgagttgcttcaaagcttcactagcctcttcaaagatgagtataagattccaagaaactccaccattgatttgacaaaagatccgggccatgtactcagcgttgcaattgaggggaaccatgtcgggagtgtgaagagccatctcttgtgtagatcaatcttagacttgtacattggtgaagaaccgtttgataagaatgcaagagaagattttctagacaatgcagcttctctagccttcgacaactagttcacaacaaaatgttgctttctttctttcttaacggattctctatatatacggcataatgttgaggaatgtatttgaaataaattgcttggggaattgggttttgttagtct

SEQ ID NO: 2528 - protein, 1039 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
AATATGCCTAGGAAGAAGAAAGAGTGTAACAAACAAACAAAAAAGTTAGTGAACTACTAAACAACACTCACACCAAAAAGACGACGATGGTTTCGTTTCGCTTCCCTTTCTCGTTTTCTCAGCCCCCGCGTGCCACCACGTCATTCTCCGGATTCTCCATTTCCGCTGTCGCTGTCTCCGTCACCGTTGGCGCCGCAGCCGCCGGAGCTGCGATCGCGGCGTCCCGGAATCCCAGCCATCCGATTCTAGAGTGGGCCTTCTCCTCTCACCGTTCGTCTCTTTCACCATGGGGATCTATAACTCTAGCAGACGAATCCGTTGTCGAACCTAAGACCGGTTTCTCGTTTCCCGCTTCAATCGGAGATTCCCGGCGATTACTCGGCGTCGGCCTGAGGAAGAAGAGCTTACTGGGATTGAAGAACATCGATGTCTACGCCTTCGGCGTGTATGCTGATTGTGATGATGTGAAGAAACTTGTGGGAGACAAGTACGCAAATCTTCCAGCTTCAGAGATCAGGGGAAACAAGTCATTCATGGATGATCTCATGGAAGCCGATATTAAGATGACGATAAGGCTACAGATTGTCTACGGCAAACTCAACATCCGATCCGTGCGTAATGCTTTCCAAGAGTCTGTTGGAAACAGACTCAAGAAGTTCGGTGGCTCAGACAATGACGAGTTGCTTCAAAGCTTCACTAGCCTCTTCAAAGATGAGTATAAGATTCCAAGAAACTCCACCATTGATTTGACAAAAGATCCGGGCCATGTACTCAGCGTTGCAATTGAGGGGAACCATGTCGGGAGTGTGAAGAGCCATCTCTTGTGTAGATCAATCTTAGACTTGTACATTGGTGAAGAACCGTTTGATAAGAATGCAAGAGAAGATTTTCTAGACAATGCAGCTTCTCTAGCCTTCGACAACTAGTTCACAACAAAATGTTGCTTTCTTTCTTTCTTAACGGATTCTCTATATATACGGCATAATGTTGAGGAATGTATTTGAAATAAATTGCTTGGGGAATTGGGTTTTGTTAGTCT

SEQ ID NO: 2529 - DNA, 2841 bp, Arabidopsis thaliana
  misc_feature (1)..(2841): Ceres cDNA ID no. 13611594
  misc_feature (1)..(2841): Also known as  Ceres CDNA ID no. 23827422
actgatacagtttaacagaaatctccacgaacctcgatttcataagcaaataaagatattttcggagaaatatcttaatgtcatgtcctcttgccttcaccttctctctcccgtctattttcccctttccttctcaactgcttccattttcccgccataaacatccttatcttcttcgcgccacaccaacctctgcaaccgaagatgttgcctccgccgtttctggcgcaccttcaatatttatctctcaatcacgctctccggagtggtggattgacttgctccggtccaaagttcgatctaatttgctccgtgaagctgttttgacttacgttgacatgattgttttgggtataaaacccgataattatgcgttccctgctttgctaaaggctgtagcagatcttcaggacatggaactggggaaacagattcatgcccatgtgtataaatttgggtacggtgtggattccgtgactgtggctaatacccttgtgaatttgtatagaaagtgtggagatttcggagctgtctataaggtgttcgatagaatatctgagagaaaccaagtctcttggaattctttaatttcttctttgtgtagttttgagaagtgggaaatggcgttagaggcatttcggtgtatgttggatgaaaatgtggaacctagttcgtttaccttggtgagtgtggttactgcttgttcgaatttgcctatgcctgagggattaatgatgggtaagcaggttcacgcctatggtttgagaaagggtgaattgaattcgtttataatcaacacattggtggctatgtatggtaaactgggaaaattagcatcttctaaagtcttacttggttcttttggaggccgtgacttggtcacatggaacactgtgttgagctcgttatgtcagaacgagcagttgcttgaagcattggaatatttgcgtgaaatggtgcttgaaggtgttgaaccagatgagttcactatttcaagtgttcttcctgcttgttcacacttggagatgcttcgcacagggaaagaattgcatgcttatgctttgaaaaatggctctttggatgagaattcctttgttggtagtgctttggttgacatgtattgcaattgcaagcaagtgttgagtggtcgtcgagtatttgatggaatgtttgatagaaagattggtctgtggaatgctatgatcgctgggtattcccagaatgagcatgacaaggaagcgttgttgcttttcattggaatggaagaaagtgctgggcttctggctaactctaccacaatggcaggtgttgttcctgcttgtgtccgttctggtgcgttctctagaaaggaagctatccatggatttgttgtgaagagaggtttagatagagacaggtttgtgcagaatacactgatggatatgtattctaggctgggaaagatcgatatcgccatgcggatattcggtaaaatggaagatagagatttagttacgtggaacacgatgattacgggttatgtattctcagaacaccatgaggacgcacttctcctgctacacaagatgcaaaaccttgaaagaaaagtgagcaagggggctagccgagttagtcttaaacctaattccatcactctgatgacaatccttcccagttgtgctgcactatcagcattagcaaaaggaaaagaaattcatgcttatgccatcaagaacaatttggcaactgatgtggctgtcggaagcgctttagttgacatgtacgcaaaatgcgggtgcctacagatgtcgagaaaagtgtttgatcagattccacaaaaaaatgttattacttggaatgtgattataatggcttacgggatgcatggaaacggtcaagaagccatagatctgctaagaatgatgatggttcagggagtaaaaccaaacgaggttacattcatctcagtatttgcagcttgtagccactcaggcatggtggatgaaggattaaggatattctatgttatgaaacccgactacggggttgaaccaagctcagatcattatgcttgtgttgtagatttgcttggaagggctggtagaattaaagaagcatatcaactcatgaatatgatgcctcgtgatttcaacaaagctggagcatggagtagcctccttggtgccagtcggattcacaataacctagaaattggagaaattgctgctcaaaatctcattcaactggaaccaaatgtagctagtcactatgtgttacttgccaatatttattcatcagcaggcctctgggataaagcaacagaggtaagaagaaatatgaaagagcaaggcgtgagaaaagaacctggatgtagctggattgagcatggcgatgaagtacataaatttgtagccggtgactcatctcacccgcaaagcgaaaagctcagtggatatctcgagacattgtgggagagaatgagaaaagaaggatatgtacctgacacatcttgtgtactccacaatgtagaggaagatgaaaaagagattctgctttgtggacacagtgagaagctagcaattgcgtttgggatacttaacacatcacccggtacaattattagggtggctaaaaacctcagggtttgtaatgattgtcatcttgcaaccaagtttatctcaaagattgttgatagagaaatcatcttgagagatgttaggaggtttcatcgtttcaagaatggaacttgctcctgtggagactattggtgaaagataagctccataaaactctcttttttcttcattgtatatcttgtaagtgttgattcttgtataagttatacagtataacacacagttg

SEQ ID NO: 2530 - protein, 2841 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ACTGATACAGTTTAACAGAAATCTCCACGAACCTCGATTTCATAAGCAAATAAAGATATTTTCGGAGAAATATCTTAATGTCATGTCCTCTTGCCTTCACCTTCTCTCTCCCGTCTATTTTCCCCTTTCCTTCTCAACTGCTTCCATTTTCCCGCCATAAACATCCTTATCTTCTTCGCGCCACACCAACCTCTGCAACCGAAGATGTTGCCTCCGCCGTTTCTGGCGCACCTTCAATATTTATCTCTCAATCACGCTCTCCGGAGTGGTGGATTGACTTGCTCCGGTCCAAAGTTCGATCTAATTTGCTCCGTGAAGCTGTTTTGACTTACGTTGACATGATTGTTTTGGGTATAAAACCCGATAATTATGCGTTCCCTGCTTTGCTAAAGGCTGTAGCAGATCTTCAGGACATGGAACTGGGGAAACAGATTCATGCCCATGTGTATAAATTTGGGTACGGTGTGGATTCCGTGACTGTGGCTAATACCCTTGTGAATTTGTATAGAAAGTGTGGAGATTTCGGAGCTGTCTATAAGGTGTTCGATAGAATATCTGAGAGAAACCAAGTCTCTTGGAATTCTTTAATTTCTTCTTTGTGTAGTTTTGAGAAGTGGGAAATGGCGTTAGAGGCATTTCGGTGTATGTTGGATGAAAATGTGGAACCTAGTTCGTTTACCTTGGTGAGTGTGGTTACTGCTTGTTCGAATTTGCCTATGCCTGAGGGATTAATGATGGGTAAGCAGGTTCACGCCTATGGTTTGAGAAAGGGTGAATTGAATTCGTTTATAATCAACACATTGGTGGCTATGTATGGTAAACTGGGAAAATTAGCATCTTCTAAAGTCTTACTTGGTTCTTTTGGAGGCCGTGACTTGGTCACATGGAACACTGTGTTGAGCTCGTTATGTCAGAACGAGCAGTTGCTTGAAGCATTGGAATATTTGCGTGAAATGGTGCTTGAAGGTGTTGAACCAGATGAGTTCACTATTTCAAGTGTTCTTCCTGCTTGTTCACACTTGGAGATGCTTCGCACAGGGAAAGAATTGCATGCTTATGCTTTGAAAAATGGCTCTTTGGATGAGAATTCCTTTGTTGGTAGTGCTTTGGTTGACATGTATTGCAATTGCAAGCAAGTGTTGAGTGGTCGTCGAGTATTTGATGGAATGTTTGATAGAAAGATTGGTCTGTGGAATGCTATGATCGCTGGGTATTCCCAGAATGAGCATGACAAGGAAGCGTTGTTGCTTTTCATTGGAATGGAAGAAAGTGCTGGGCTTCTGGCTAACTCTACCACAATGGCAGGTGTTGTTCCTGCTTGTGTCCGTTCTGGTGCGTTCTCTAGAAAGGAAGCTATCCATGGATTTGTTGTGAAGAGAGGTTTAGATAGAGACAGGTTTGTGCAGAATACACTGATGGATATGTATTCTAGGCTGGGAAAGATCGATATCGCCATGCGGATATTCGGTAAAATGGAAGATAGAGATTTAGTTACGTGGAACACGATGATTACGGGTTATGTATTCTCAGAACACCATGAGGACGCACTTCTCCTGCTACACAAGATGCAAAACCTTGAAAGAAAAGTGAGCAAGGGGGCTAGCCGAGTTAGTCTTAAACCTAATTCCATCACTCTGATGACAATCCTTCCCAGTTGTGCTGCACTATCAGCATTAGCAAAAGGAAAAGAAATTCATGCTTATGCCATCAAGAACAATTTGGCAACTGATGTGGCTGTCGGAAGCGCTTTAGTTGACATGTACGCAAAATGCGGGTGCCTACAGATGTCGAGAAAAGTGTTTGATCAGATTCCACAAAAAAATGTTATTACTTGGAATGTGATTATAATGGCTTACGGGATGCATGGAAACGGTCAAGAAGCCATAGATCTGCTAAGAATGATGATGGTTCAGGGAGTAAAACCAAACGAGGTTACATTCATCTCAGTATTTGCAGCTTGTAGCCACTCAGGCATGGTGGATGAAGGATTAAGGATATTCTATGTTATGAAACCCGACTACGGGGTTGAACCAAGCTCAGATCATTATGCTTGTGTTGTAGATTTGCTTGGAAGGGCTGGTAGAATTAAAGAAGCATATCAACTCATGAATATGATGCCTCGTGATTTCAACAAAGCTGGAGCATGGAGTAGCCTCCTTGGTGCCAGTCGGATTCACAATAACCTAGAAATTGGAGAAATTGCTGCTCAAAATCTCATTCAACTGGAACCAAATGTAGCTAGTCACTATGTGTTACTTGCCAATATTTATTCATCAGCAGGCCTCTGGGATAAAGCAACAGAGGTAAGAAGAAATATGAAAGAGCAAGGCGTGAGAAAAGAACCTGGATGTAGCTGGATTGAGCATGGCGATGAAGTACATAAATTTGTAGCCGGTGACTCATCTCACCCGCAAAGCGAAAAGCTCAGTGGATATCTCGAGACATTGTGGGAGAGAATGAGAAAAGAAGGATATGTACCTGACACATCTTGTGTACTCCACAATGTAGAGGAAGATGAAAAAGAGATTCTGCTTTGTGGACACAGTGAGAAGCTAGCAATTGCGTTTGGGATACTTAACACATCACCCGGTACAATTATTAGGGTGGCTAAAAACCTCAGGGTTTGTAATGATTGTCATCTTGCAACCAAGTTTATCTCAAAGATTGTTGATAGAGAAATCATCTTGAGAGATGTTAGGAGGTTTCATCGTTTCAAGAATGGAACTTGCTCCTGTGGAGACTATTGGTGAAAGATAAGCTCCATAAAACTCTCTTTTTTCTTCATTGTATATCTTGTAAGTGTTGATTCTTGTATAAGTTATACAGTATAACACACAGTTG

SEQ ID NO: 2531 - DNA, 1169 bp, Arabidopsis thaliana
  misc_feature (1)..(1169): Ceres cDNA ID no. 13611910
  misc_feature (1)..(1169): Also known as  Ceres CDNA ID no. 23827422
attcaataaattcttcttttcttgcattttcaactcaatctttatctcatgctttcgtcttcgtcttcgtcaacggtggagcaaccatcacgtggcggaagtccgggaatcaacgccgtgtcctccgatgttttacggtctaacatcctaacccgcctcgacggttcctctctcgccgccctaagctgcacgtgctccaacctaaactctttttgctccgacgagtccctctggaggcaacaatgttccgctacatggccttctacctcggatacacgtgtccaaagcatcatctcaacgttccccgacggtcaccggacgtttttttccgattcctttccgtttcttgaacatgatgttgggatcaatctcccaccgtccgttgatacctcggagttaatctcagccgttgatatattctacaaagatgacgtgattttctcaagggttcatgttacagagacagtctctggttggttcctttgctcacctatgcgtgtcgatcttgtcgaaccgaaagaactaattccgaccagagttttggttacggaccaatgtaaggatgacacgtggaaaagtgacttggaagagaatctctccttgagctggatactcattgacccgacatgtaaacgtgcggcggatgtatcaacccgtaaacctgtctcggtgcaccgtcattggttaaccggagaagtccacgtaaaattctcctctatttttgtcgtgggcaacaagaaaaggtcggagcaagtggagttcactgtaacggtggtgctggcggtgtttaaccggagggaagaggagacagcagtgatgcagataagagaggtgagcctagtagcagaggacaaggatgggaggaatttaggagggaaggttagtttggaaattttggtggcggccatggggatgaaacgtaggtttagggcgggaggggaagaagaagggaaagagaagtacatagaatatatggagaggaagaccgcgaaggcggagatgaagtggcggcgagggaaagaaacggctatggagacggcggcgtgctggatcgccgtcctcttacttggtttccttttgtgtttttatctgtttatgcataaaaatttagtagctattatgaaaaaactaataaaatagttaaataatatgttttgattcaaaacttc

SEQ ID NO: 2532 - protein, 1169 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATTCAATAAATTCTTCTTTTCTTGCATTTTCAACTCAATCTTTATCTCATGCTTTCGTCTTCGTCTTCGTCAACGGTGGAGCAACCATCACGTGGCGGAAGTCCGGGAATCAACGCCGTGTCCTCCGATGTTTTACGGTCTAACATCCTAACCCGCCTCGACGGTTCCTCTCTCGCCGCCCTAAGCTGCACGTGCTCCAACCTAAACTCTTTTTGCTCCGACGAGTCCCTCTGGAGGCAACAATGTTCCGCTACATGGCCTTCTACCTCGGATACACGTGTCCAAAGCATCATCTCAACGTTCCCCGACGGTCACCGGACGTTTTTTTCCGATTCCTTTCCGTTTCTTGAACATGATGTTGGGATCAATCTCCCACCGTCCGTTGATACCTCGGAGTTAATCTCAGCCGTTGATATATTCTACAAAGATGACGTGATTTTCTCAAGGGTTCATGTTACAGAGACAGTCTCTGGTTGGTTCCTTTGCTCACCTATGCGTGTCGATCTTGTCGAACCGAAAGAACTAATTCCGACCAGAGTTTTGGTTACGGACCAATGTAAGGATGACACGTGGAAAAGTGACTTGGAAGAGAATCTCTCCTTGAGCTGGATACTCATTGACCCGACATGTAAACGTGCGGCGGATGTATCAACCCGTAAACCTGTCTCGGTGCACCGTCATTGGTTAACCGGAGAAGTCCACGTAAAATTCTCCTCTATTTTTGTCGTGGGCAACAAGAAAAGGTCGGAGCAAGTGGAGTTCACTGTAACGGTGGTGCTGGCGGTGTTTAACCGGAGGGAAGAGGAGACAGCAGTGATGCAGATAAGAGAGGTGAGCCTAGTAGCAGAGGACAAGGATGGGAGGAATTTAGGAGGGAAGGTTAGTTTGGAAATTTTGGTGGCGGCCATGGGGATGAAACGTAGGTTTAGGGCGGGAGGGGAAGAAGAAGGGAAAGAGAAGTACATAGAATATATGGAGAGGAAGACCGCGAAGGCGGAGATGAAGTGGCGGCGAGGGAAAGAAACGGCTATGGAGACGGCGGCGTGCTGGATCGCCGTCCTCTTACTTGGTTTCCTTTTGTGTTTTTATCTGTTTATGCATAAAAATTTAGTAGCTATTATGAAAAAACTAATAAAATAGTTAAATAATATGTTTTGATTCAAAACTTC

SEQ ID NO: 2533 - DNA, 1490 bp, Arabidopsis thaliana
  misc_feature (1)..(1490): Ceres cDNA ID no. 13611913
  misc_feature (1)..(1490): Also known as  Ceres CDNA ID no. 23827422
acagttacttctctctttctctccctctcttcttcttcttcttcttctctctctcgtcgtcactctcagtagatcggaaaatggagccatggattgacgaattaaccgacgacttacagagtgtaagctttacatcagccggaaccaccgtgaatcgaagcacaagctccggttctcgctcttcctcctccgccgcagctttaacaccagcaccatcagctcacggttcattctcatcttcgaaactccctccttcactccgatcatctctctcactctccgatctcagattccgtctccgtctcggttccggcgacatcggctctgttttcttagccgaattcaaatccctaaccgccgtaacagaaaccaccgccgttaaattacctctgttagcagcgaaagttatggataaaaaggagctcgcgagcagaagcaaagaaggtagagctaagacggagagagagattctcgaatctcttgatcatccgtttcttccgacgctttacgccgccattgattctccgaaatggctctgtttattaacggagttttgtcccggcggtgaccttcacgttctccgtcaaaaacagactcataaacgtttccatgaatccgccgtcagattctatgtatcggaagtgatcgtagcgattgaatatcttcacatgttggggattgtgtaccgcgatttgaagcctgagaacgtgctggttcgatcagatggtcacatcatgttaactgattttgatctctccttaaaatgtgatgaatcgacttccacaccacagatagtgctgaaccggaacaatcttcctaatggctcgtctgaccagaacgagaaccaaggcatggaccaccgtcaaaccacatcatcctcttgcatgatccctaactgtattgtccctgctgtctcttgcttccacccgagaatccgaaggcgtaagaagaaaactgatcaccgtaacaacggtcctgagcttgtggctgaacctgtagatgtccggtccatgtcattcgttgggacgcatgagtacttggctcctgagattgtttcaggagaaggacatggtagtgcagtggactggtggacattagggatattcatgttcgagctgttctacggaacaacaccgttcaaaggaatggaccacgagctaacccttgccaatatcgtggctcgagcactcgaattcccgaaagaaccaacgattccaagcgcggccaaggatctgatctctcagctacttgccaaggatcctagccgacggttagggtcatctctaggtgcaacggccgtgaaacgtcatccatttttccaaggagtgaattgggcattgctcatgtgtactcgtcctccttttcttcctccgcctttccgcaaagaacttttgtcagatgacatttgtccggaaacccatgtcgactattattaataacttaattagcgctacgtaattaattaattttcttcagatataattatttct

SEQ ID NO: 2534 - protein, 1490 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ACAGTTACTTCTCTCTTTCTCTCCCTCTCTTCTTCTTCTTCTTCTTCTCTCTCTCGTCGTCACTCTCAGTAGATCGGAAAATGGAGCCATGGATTGACGAATTAACCGACGACTTACAGAGTGTAAGCTTTACATCAGCCGGAACCACCGTGAATCGAAGCACAAGCTCCGGTTCTCGCTCTTCCTCCTCCGCCGCAGCTTTAACACCAGCACCATCAGCTCACGGTTCATTCTCATCTTCGAAACTCCCTCCTTCACTCCGATCATCTCTCTCACTCTCCGATCTCAGATTCCGTCTCCGTCTCGGTTCCGGCGACATCGGCTCTGTTTTCTTAGCCGAATTCAAATCCCTAACCGCCGTAACAGAAACCACCGCCGTTAAATTACCTCTGTTAGCAGCGAAAGTTATGGATAAAAAGGAGCTCGCGAGCAGAAGCAAAGAAGGTAGAGCTAAGACGGAGAGAGAGATTCTCGAATCTCTTGATCATCCGTTTCTTCCGACGCTTTACGCCGCCATTGATTCTCCGAAATGGCTCTGTTTATTAACGGAGTTTTGTCCCGGCGGTGACCTTCACGTTCTCCGTCAAAAACAGACTCATAAACGTTTCCATGAATCCGCCGTCAGATTCTATGTATCGGAAGTGATCGTAGCGATTGAATATCTTCACATGTTGGGGATTGTGTACCGCGATTTGAAGCCTGAGAACGTGCTGGTTCGATCAGATGGTCACATCATGTTAACTGATTTTGATCTCTCCTTAAAATGTGATGAATCGACTTCCACACCACAGATAGTGCTGAACCGGAACAATCTTCCTAATGGCTCGTCTGACCAGAACGAGAACCAAGGCATGGACCACCGTCAAACCACATCATCCTCTTGCATGATCCCTAACTGTATTGTCCCTGCTGTCTCTTGCTTCCACCCGAGAATCCGAAGGCGTAAGAAGAAAACTGATCACCGTAACAACGGTCCTGAGCTTGTGGCTGAACCTGTAGATGTCCGGTCCATGTCATTCGTTGGGACGCATGAGTACTTGGCTCCTGAGATTGTTTCAGGAGAAGGACATGGTAGTGCAGTGGACTGGTGGACATTAGGGATATTCATGTTCGAGCTGTTCTACGGAACAACACCGTTCAAAGGAATGGACCACGAGCTAACCCTTGCCAATATCGTGGCTCGAGCACTCGAATTCCCGAAAGAACCAACGATTCCAAGCGCGGCCAAGGATCTGATCTCTCAGCTACTTGCCAAGGATCCTAGCCGACGGTTAGGGTCATCTCTAGGTGCAACGGCCGTGAAACGTCATCCATTTTTCCAAGGAGTGAATTGGGCATTGCTCATGTGTACTCGTCCTCCTTTTCTTCCTCCGCCTTTCCGCAAAGAACTTTTGTCAGATGACATTTGTCCGGAAACCCATGTCGACTATTATTAATAACTTAATTAGCGCTACGTAATTAATTAATTTTCTTCAGATATAATTATTTCT

SEQ ID NO: 2535 - DNA, 1140 bp, Arabidopsis thaliana
  misc_feature (1)..(1140): Ceres cDNA ID no. 13612453
  misc_feature (1)..(1140): Also known as  Ceres CDNA ID no. 23827422
acacacaccaatcttatcataactcaccaaccaatcaactaaccatggattccgagatcgccgtcgactgctctccattgctcaaaatctacaagagtggccgcatcgagcgactcatgggtgaagccaccgtcccaccttcttccgaaccacaaaacggagtcgtttccaaggacgttgtttattctgccgacaacaacctatccgtccgtatttacctcccggagaaagccgccgccgagaccgactcgaaactccctctcctcgtttacttccacggtggaggattcatcattgagacagctttctctccaacttaccacactttcctcacgacgtctgtctctgcgtcgaactgtgtagcggtctctgttgattaccgtcgtgcaccggagcatccgatctccgtcccgttcgatgattcttggacagctctcaaatgggtattcacccatatcactggatctggtcaagaagattggttaaacaaacatgctgacttcagcagagtgttcctctccggagacagtgcaggagcaaacatcgtgcatcacatggcgatgagagctgcgaaagagaaactcagtcctggtttgaacgatacaggaatctctggaatcatcttgcttcatccttacttctggtcgaaaacaccaatcgacgagaaggatacgaaagatgaaacgttgaggatgaagatagaggcgttttggatgatggcaagtcctaatagcaaagatggaacagatgatccgttgctcaacgtggtgcaatcagagtcggtggatttgtctgggttgggttgtggtaaggttttggtaatggtggctgagaaagatgcgttggtgaggcagggttggggttacgcggctaagcttgagaagtctggttggaaaggagaggttgaagtggtggagagtgaaggagaagatcatgtttttcatttgttgaaacctgaatgtgataatgctattgaagtcatgcataaattctcagggtttattaagggagggaactagctttgtgctctctagagatattggaataatttggtactacatattttagttgcgtctctcagtttctgtaatgtttcagtgattggcttttcgcccaaagcaacacaataaaaattgaaga

SEQ ID NO: 2536 - protein, 1140 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ACACACACCAATCTTATCATAACTCACCAACCAATCAACTAACCATGGATTCCGAGATCGCCGTCGACTGCTCTCCATTGCTCAAAATCTACAAGAGTGGCCGCATCGAGCGACTCATGGGTGAAGCCACCGTCCCACCTTCTTCCGAACCACAAAACGGAGTCGTTTCCAAGGACGTTGTTTATTCTGCCGACAACAACCTATCCGTCCGTATTTACCTCCCGGAGAAAGCCGCCGCCGAGACCGACTCGAAACTCCCTCTCCTCGTTTACTTCCACGGTGGAGGATTCATCATTGAGACAGCTTTCTCTCCAACTTACCACACTTTCCTCACGACGTCTGTCTCTGCGTCGAACTGTGTAGCGGTCTCTGTTGATTACCGTCGTGCACCGGAGCATCCGATCTCCGTCCCGTTCGATGATTCTTGGACAGCTCTCAAATGGGTATTCACCCATATCACTGGATCTGGTCAAGAAGATTGGTTAAACAAACATGCTGACTTCAGCAGAGTGTTCCTCTCCGGAGACAGTGCAGGAGCAAACATCGTGCATCACATGGCGATGAGAGCTGCGAAAGAGAAACTCAGTCCTGGTTTGAACGATACAGGAATCTCTGGAATCATCTTGCTTCATCCTTACTTCTGGTCGAAAACACCAATCGACGAGAAGGATACGAAAGATGAAACGTTGAGGATGAAGATAGAGGCGTTTTGGATGATGGCAAGTCCTAATAGCAAAGATGGAACAGATGATCCGTTGCTCAACGTGGTGCAATCAGAGTCGGTGGATTTGTCTGGGTTGGGTTGTGGTAAGGTTTTGGTAATGGTGGCTGAGAAAGATGCGTTGGTGAGGCAGGGTTGGGGTTACGCGGCTAAGCTTGAGAAGTCTGGTTGGAAAGGAGAGGTTGAAGTGGTGGAGAGTGAAGGAGAAGATCATGTTTTTCATTTGTTGAAACCTGAATGTGATAATGCTATTGAAGTCATGCATAAATTCTCAGGGTTTATTAAGGGAGGGAACTAGCTTTGTGCTCTCTAGAGATATTGGAATAATTTGGTACTACATATTTTAGTTGCGTCTCTCAGTTTCTGTAATGTTTCAGTGATTGGCTTTTCGCCCAAAGCAACACAATAAAAATTGAAGA

SEQ ID NO: 2537 - DNA, 1293 bp, Arabidopsis thaliana
  misc_feature (1)..(1293): Ceres cDNA ID no. 13612594
  misc_feature (1)..(1293): Also known as  Ceres CDNA ID no. 23827422
ggaaccaattggttctgatttcagatttcgaatttttttaatttgaatccaaatggagaaagcagagaacgagaagaagccatcggctgtatctgacgtcggagcatgggctatgaacgtaacgagctccgttgggatcatcatggctaataaacaactaatgtcatcatctggattcggcttcagcttcgcgacaactctcacgggatttcactttgctcttactgctctcgttggtatggtgtcgaatgcgactggtttatcagcatctaagcatgttcctctttgggagcttctttggttctcactcgttgctaatatctcaatcgctgctatgaattttagtcttatgttgaactctgttggcttctaccagatatcgaaattgagcatgattccagttgtttgtgtgatggaatgggttctacatagtaagcattactcgagagaagtgaaggcatctgtcatggttgttgttgtaggagttgggatttgtactgttactgatgtcaaagttaatgccaaaggtttcatttgtgcttgcactgccgttttctccacttctctccagcagatctcaataggttcactgcagaagaaatactcgatcggatcattcgagttgctgagtaagacagctccaatccaagccatttcactcctcatctttggtccatttgttgactatttcttgagtggcagattcatttcgacttacaagatgacttatagcgcaatgttatgcattcttctctcctgcgcattggcggttttctgcaacataagccaatatctctgcatcggaagattctctgctacctcattccaagttcttggccacatgaaaacagtctgtgtcttaacattaggatggcttatctttgattcggagatgacattcaagaacatagcagggatggtcttagccgtggtgggaatggtgatatacagttgggcagtcgagttagagaaacagagaaagtcgaaagtgataccgcatggtaaacacagtatgacagaagatgagattaaacttctcaaagaaggtatagaacatatggatttgaaagacatggagcttggaaataataaagcataaatatagctctattcaagagaaacgttttttggttatatttttggttactcatttcccccatcatgtactcttttcttttgccctttttttcgttctttgtctcaaagaacctttttagcctcttattgatgagctctcctctgcagagcacattcttttttctatagaaatatatgattcctctacttctttgc

SEQ ID NO: 2538 - protein, 1293 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
GGAACCAATTGGTTCTGATTTCAGATTTCGAATTTTTTTAATTTGAATCCAAATGGAGAAAGCAGAGAACGAGAAGAAGCCATCGGCTGTATCTGACGTCGGAGCATGGGCTATGAACGTAACGAGCTCCGTTGGGATCATCATGGCTAATAAACAACTAATGTCATCATCTGGATTCGGCTTCAGCTTCGCGACAACTCTCACGGGATTTCACTTTGCTCTTACTGCTCTCGTTGGTATGGTGTCGAATGCGACTGGTTTATCAGCATCTAAGCATGTTCCTCTTTGGGAGCTTCTTTGGTTCTCACTCGTTGCTAATATCTCAATCGCTGCTATGAATTTTAGTCTTATGTTGAACTCTGTTGGCTTCTACCAGATATCGAAATTGAGCATGATTCCAGTTGTTTGTGTGATGGAATGGGTTCTACATAGTAAGCATTACTCGAGAGAAGTGAAGGCATCTGTCATGGTTGTTGTTGTAGGAGTTGGGATTTGTACTGTTACTGATGTCAAAGTTAATGCCAAAGGTTTCATTTGTGCTTGCACTGCCGTTTTCTCCACTTCTCTCCAGCAGATCTCAATAGGTTCACTGCAGAAGAAATACTCGATCGGATCATTCGAGTTGCTGAGTAAGACAGCTCCAATCCAAGCCATTTCACTCCTCATCTTTGGTCCATTTGTTGACTATTTCTTGAGTGGCAGATTCATTTCGACTTACAAGATGACTTATAGCGCAATGTTATGCATTCTTCTCTCCTGCGCATTGGCGGTTTTCTGCAACATAAGCCAATATCTCTGCATCGGAAGATTCTCTGCTACCTCATTCCAAGTTCTTGGCCACATGAAAACAGTCTGTGTCTTAACATTAGGATGGCTTATCTTTGATTCGGAGATGACATTCAAGAACATAGCAGGGATGGTCTTAGCCGTGGTGGGAATGGTGATATACAGTTGGGCAGTCGAGTTAGAGAAACAGAGAAAGTCGAAAGTGATACCGCATGGTAAACACAGTATGACAGAAGATGAGATTAAACTTCTCAAAGAAGGTATAGAACATATGGATTTGAAAGACATGGAGCTTGGAAATAATAAAGCATAAATATAGCTCTATTCAAGAGAAACGTTTTTTGGTTATATTTTTGGTTACTCATTTCCCCCATCATGTACTCTTTTCTTTTGCCCTTTTTTTCGTTCTTTGTCTCAAAGAACCTTTTTAGCCTCTTATTGATGAGCTCTCCTCTGCAGAGCACATTCTTTTTTCTATAGAAATATATGATTCCTCTACTTCTTTGC

SEQ ID NO: 2539 - DNA, 1338 bp, Arabidopsis thaliana
  misc_feature (1)..(1338): Ceres cDNA ID no. 13612654
  misc_feature (1)..(1338): Also known as  Ceres CDNA ID no. 23827422
agaatctgtttctttcttcacccaccaaaagtagcaaacctttgccacctaaaaatcttaccagttgggtgaaagttgccaaaatagagcttgcttttgtcgcaatcctatatttttcagattgattgttggtgggtttgtgtaaatggcggctcttttaggcagatcctgccggaaactgagttttccgagcttgagtcacggagctaggagggtatcgacggaaactggaaaaccattgaatctatactctgctattaatcaagcgcttcacatcgctttggacaccgatcctcggtcttatgtctttggggaagacgttggctttggtggagtctttcgctgtacaacaggtttagctgaacgattcgggaaaaaccgtgtcttcaatactcctctttgtgagcagggcattgttggatttggcattggtctagcagcaatgggtaatcgagcaattgtagagattcagtttgcagattatatatatcctgcttttgatcagattgttaatgaagctgcaaagttcagataccgaagtggtaaccaattcaactgtggaggacttacgataagagcaccatatggagcagttggtcatggtggacattaccattcacaatcccctgaagctttcttttgccatgtccctggtattaaggttgttatccctcggagtccacgagaagcaaagggactgttgttgtcatgtatccgtgatccaaatcccgttgttttcttcgaaccaaagtggctgtatcgtcaagcagtagaagaagtccctgagcatgactatatgatacctttatcagaagcagaggttataagagaaggcaatgacattacactggttggatggggagctcagcttaccgttatggaacaagcttgtctggacgcggaaaaggaaggaatatcatgtgaactgatagatctcaagacactgcttccttgggacaaagaaaccgttgaggcttcagttaaaaagactggcagacttcttataagccatgaagctcctgtaacaggaggttttggagcagagatctctgcaacaattctggaacgttgctttttgaagttagaagctccagtaagcagagtttgtggtctggatactccatttcctcttgtgtttgaaccattctacatgcccaccaagaacaagatattggatgcaatcaaatcgactgtgaattactagccgtactatctgtagtttactgtttacactaggactaatgtaatcgcatgtctttgttatcaattcgtctaatgtaacactaccgattaactttaatgaatttcaagataacgaaaacatgttataataggact

SEQ ID NO: 2540 - protein, 1338 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
AGAATCTGTTTCTTTCTTCACCCACCAAAAGTAGCAAACCTTTGCCACCTAAAAATCTTACCAGTTGGGTGAAAGTTGCCAAAATAGAGCTTGCTTTTGTCGCAATCCTATATTTTTCAGATTGATTGTTGGTGGGTTTGTGTAAATGGCGGCTCTTTTAGGCAGATCCTGCCGGAAACTGAGTTTTCCGAGCTTGAGTCACGGAGCTAGGAGGGTATCGACGGAAACTGGAAAACCATTGAATCTATACTCTGCTATTAATCAAGCGCTTCACATCGCTTTGGACACCGATCCTCGGTCTTATGTCTTTGGGGAAGACGTTGGCTTTGGTGGAGTCTTTCGCTGTACAACAGGTTTAGCTGAACGATTCGGGAAAAACCGTGTCTTCAATACTCCTCTTTGTGAGCAGGGCATTGTTGGATTTGGCATTGGTCTAGCAGCAATGGGTAATCGAGCAATTGTAGAGATTCAGTTTGCAGATTATATATATCCTGCTTTTGATCAGATTGTTAATGAAGCTGCAAAGTTCAGATACCGAAGTGGTAACCAATTCAACTGTGGAGGACTTACGATAAGAGCACCATATGGAGCAGTTGGTCATGGTGGACATTACCATTCACAATCCCCTGAAGCTTTCTTTTGCCATGTCCCTGGTATTAAGGTTGTTATCCCTCGGAGTCCACGAGAAGCAAAGGGACTGTTGTTGTCATGTATCCGTGATCCAAATCCCGTTGTTTTCTTCGAACCAAAGTGGCTGTATCGTCAAGCAGTAGAAGAAGTCCCTGAGCATGACTATATGATACCTTTATCAGAAGCAGAGGTTATAAGAGAAGGCAATGACATTACACTGGTTGGATGGGGAGCTCAGCTTACCGTTATGGAACAAGCTTGTCTGGACGCGGAAAAGGAAGGAATATCATGTGAACTGATAGATCTCAAGACACTGCTTCCTTGGGACAAAGAAACCGTTGAGGCTTCAGTTAAAAAGACTGGCAGACTTCTTATAAGCCATGAAGCTCCTGTAACAGGAGGTTTTGGAGCAGAGATCTCTGCAACAATTCTGGAACGTTGCTTTTTGAAGTTAGAAGCTCCAGTAAGCAGAGTTTGTGGTCTGGATACTCCATTTCCTCTTGTGTTTGAACCATTCTACATGCCCACCAAGAACAAGATATTGGATGCAATCAAATCGACTGTGAATTACTAGCCGTACTATCTGTAGTTTACTGTTTACACTAGGACTAATGTAATCGCATGTCTTTGTTATCAATTCGTCTAATGTAACACTACCGATTAACTTTAATGAATTTCAAGATAACGAAAACATGTTATAATAGGACT

SEQ ID NO: 2541 - DNA, 1424 bp, Arabidopsis thaliana
  misc_feature (1)..(1424): Ceres cDNA ID no. 13612911
  misc_feature (1)..(1424): Also known as  Ceres CDNA ID no. 23827422
atgtctatggcagagattttcgagagagttgacaaaaataaagatggaaaaatttcatgggacaaatttgaggaggccattcgcgttttttctcctaaaataacatctgaagaaattgataagatgttcatagttcttgttgttgatggtggcggtcaaattgatgatgtggagtttccttcatgcttgatggttaatggtggaggagaaaaagatgatcaagaagaagttgttatgaaaaaacctctatgcatttccaaattcgaaccaaagatacacggcgagaccaacacgaaaccgacgataggaacgccggtgaacgaagcaatgcttgggctttcttacggtgagctcttactcatcgtcggcgccacagctgctcttgtaggacccaaggatcttccgattattgctagagcaggaggaagattattcggacgagccattggttacatcaatatggctcgtggtcacttggatggtgtcatgaaacaacctcagatgcaagagatatcgaaagaagttcaagatttacgagcacaagtagatgcgattagccatggagcaagattttctctatttgattctagtcctttgactcgaagagtggataaccaaaaaactcaagaacctagtccaagcaccaccaatgggattgttacatccgttaatgttgaagaaaaacagaagcctgtagatcattatacaaaggctcaagaatttagtggctcgtcgtcagcttctgttaacctgcacgctcaagcaacatcatttgcacgattatctgagacagtcaatggaaaaactcacagtctaaacagtgattcacctgttcttccagtatcagctgagatggcaaagttgcttcctcaacgcaaagagagtgcaagaggatctgatttaatgttagaggcggttcttgaagcggaagtagcacacaaggcgaaaagctttttcgcacaagccgagaaagaaactccagctttgaaagggaagtttttcagtgacaggaaaggagaaaattgaactcaaaagttttggggaccatcatcgatcacaagacaccggcaaggtacaaaagagtaggccttgttatttaactgtttttttttttatgttcgatgagccaagaatctgagggacctttgtttctgatgcggcaacaagtgagctaaacttggagcgaagtcagttcactctttcatcttgtaattaatgcttccgctttataggtttaggttttgttgtttacttcggaggtttagtgtgagttggatttgcatagagttggttgggtttttttaaagagtagagatctattaaattttataaaattttgtgtatttttacaagtgtagttataaaaatccaatggacatccatggttttctcaaagttttcctttataaaagaaaattaaggtt

SEQ ID NO: 2542 - protein, 1424 aa, Arabidopsis thaliana
  misc_feature: PFam Name: 2OG-FeII_Oxy; PFam Description: 2OG-Fe(II)
  misc_feature: GI Number: 50933567; NR Description: ethylene-forming-enzyme-like dioxygenase-like protein [Oryza sativa (japonica cultivar-group)] >gi|24413984|dbj|BAC22235.1| ethylene-forming-enzyme-like dioxygenase-like protein [Oryza sativa
  misc_feature: GI Number: 50252393; NR Description: putative iron/ascorbate-dependent oxidoreductase [Oryza sativa (japonica
  misc_feature: GI Number: 50933563; NR Description: ethylene-forming-enzyme-like dioxygenase-like protein [Oryza sativa (japonica cultivar-group)] >gi|52075651|dbj|BAD44821.1| putative iron/ascorbate-dependent oxidoreductase [Oryza sativa (japonica
  misc_feature: GI Number: 33115140; NR Description: iron/ascorbate-dependent
  misc_feature: GI Number: 34898470; NR Description: ESTs D47168(S12332),D46350(S10967) correspond to a region of the predicted gene.~Similar to Prunus armeniaca ethylene-forming-enzyme-like dioxygenase. (U97530) [Oryza sativa
ATGTCTATGGCAGAGATTTTCGAGAGAGTTGACAAAAATAAAGATGGAAAAATTTCATGGGACAAATTTGAGGAGGCCATTCGCGTTTTTTCTCCTAAAATAACATCTGAAGAAATTGATAAGATGTTCATAGTTCTTGTTGTTGATGGTGGCGGTCAAATTGATGATGTGGAGTTTCCTTCATGCTTGATGGTTAATGGTGGAGGAGAAAAAGATGATCAAGAAGAAGTTGTTATGAAAAAACCTCTATGCATTTCCAAATTCGAACCAAAGATACACGGCGAGACCAACACGAAACCGACGATAGGAACGCCGGTGAACGAAGCAATGCTTGGGCTTTCTTACGGTGAGCTCTTACTCATCGTCGGCGCCACAGCTGCTCTTGTAGGACCCAAGGATCTTCCGATTATTGCTAGAGCAGGAGGAAGATTATTCGGACGAGCCATTGGTTACATCAATATGGCTCGTGGTCACTTGGATGGTGTCATGAAACAACCTCAGATGCAAGAGATATCGAAAGAAGTTCAAGATTTACGAGCACAAGTAGATGCGATTAGCCATGGAGCAAGATTTTCTCTATTTGATTCTAGTCCTTTGACTCGAAGAGTGGATAACCAAAAAACTCAAGAACCTAGTCCAAGCACCACCAATGGGATTGTTACATCCGTTAATGTTGAAGAAAAACAGAAGCCTGTAGATCATTATACAAAGGCTCAAGAATTTAGTGGCTCGTCGTCAGCTTCTGTTAACCTGCACGCTCAAGCAACATCATTTGCACGATTATCTGAGACAGTCAATGGAAAAACTCACAGTCTAAACAGTGATTCACCTGTTCTTCCAGTATCAGCTGAGATGGCAAAGTTGCTTCCTCAACGCAAAGAGAGTGCAAGAGGATCTGATTTAATGTTAGAGGCGGTTCTTGAAGCGGAAGTAGCACACAAGGCGAAAAGCTTTTTCGCACAAGCCGAGAAAGAAACTCCAGCTTTGAAAGGGAAGTTTTTCAGTGACAGGAAAGGAGAAAATTGAACTCAAAAGTTTTGGGGACCATCATCGATCACAAGACACCGGCAAGGTACAAAAGAGTAGGCCTTGTTATTTAACTGTTTTTTTTTTTATGTTCGATGAGCCAAGAATCTGAGGGACCTTTGTTTCTGATGCGGCAACAAGTGAGCTAAACTTGGAGCGAAGTCAGTTCACTCTTTCATCTTGTAATTAATGCTTCCGCTTTATAGGTTTAGGTTTTGTTGTTTACTTCGGAGGTTTAGTGTGAGTTGGATTTGCATAGAGTTGGTTGGGTTTTTTTAAAGAGTAGAGATCTATTAAATTTTATAAAATTTTGTGTATTTTTACAAGTGTAGTTATAAAAATCCAATGGACATCCATGGTTTTCTCAAAGTTTTCCTTTATAAAAGAAAATTAAGGTT

SEQ ID NO: 2543 - DNA, 1828 bp, Arabidopsis thaliana
  misc_feature (1)..(1828): Ceres cDNA ID no. 13612923
  misc_feature (1)..(1828): Ceres CLONE  ID no. 18624
  misc_feature (1)..(1828): Also known as  Ceres CDNA ID no. 23533084
aggccattctcttttctcctctctctctctctcacacaacacaaacaactcttgagagagagaaacaaatctttcacttgacacttctctccaaatcctcatctcattcttcatcctaaacatttgctcattctcacgatgagccataaccaaaaccaacctcaccggccagtcccggtccatgtcacaaacgccgagccaaaccctaacccaaacaacctcccaaactttctattatccgtccgtctcaaatacgtaaaactcggttaccactacctaatctccaacgctctctacatcctcctccttcctctcctcgccgcaacaatcgctaacctctcttctttcaccatcaacgacctctctctcctctacaacacactccgtttccatttcctctccgccacactcgccaccgcactcttaatctctctctccaccgcttacttcaccacccgtccccgccgtgtcttcctcctcgacttctcgtgttacaaaccagacccttcactgatctgcactcgtgaaacattcatggacagatctcaacgtgtaggcatcttcacagaagacaacttagctttccaacaaaagatcctcgaaagatccggtctaggtcagaaaacttacttccctgaagctcttcttcgtgttcctcctaatccttgtatggaagaagcgagaaaagaggcagaaacagttatgttcggagctattgacgcggttcttgagaagaccggtgtgaaacctaaagatattggaatccttgtggtgaattgtagcttgtttaatccaacaccgtcactttctgctatgattgtgaataagtataagcttagaggcaacattttgagctataatcttggtggaatgggatgtagtgctggccttatctccattgatctcgctaaacagatgcttcaggtgcaaccaaactcatacgcactagtggtgagcacagagaacataaccctaaactggtacttaggcaacgaccgatcaatgcttctatctaactgtatcttccgtatgggcggagccgcggtacttctctcgaaccgctcctctgatcgcagccgttcaaaatatcagctcatccataccgtccgtacccacaaaggagctgatgacaacgcatttggctgtgtttaccaacgagaagacaacaacgcagaagaaaccggcaaaatcggagtgtccctctctaaaaacctaatggcgatagctggagaagctctcaagacaaacatcacaactctcggaccactagttctaccaatgtccgaacaacttctctttttcgcgactcttgtggcccgaaaagtcttcaaagtcaagaaaataaagccttacattcctgatttcaagctagctttcgagcatttctgtatccacgcgggaggtagagccgtgctcgacgagattgagaagaacttggatttatccgaatggcacatggagccatcgaggatgacgttgaaccggtttggtaacacttcgagtagctcactttggtatgagcttgcgtatagtgaagctaaaggaaggattaagagaggagataggacttggcagattgcttttggatcgggttttaagtgtaatagtgcagtttggaaagctttgagaacgattgatccaatggacgagaagactaatccatggattgatgagattgatgactttcctgttcaagttcctaggatcactcccattacatcgtcgtagtgttttaaattcttttggagaactaatttgttatgttttattaaatgtaataacttacgtgatttgatatttttttattatcttaatatatatgattgcc

SEQ ID NO: 2544 - protein, 1828 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
AGGCCATTCTCTTTTCTCCTCTCTCTCTCTCTCACACAACACAAACAACTCTTGAGAGAGAGAAACAAATCTTTCACTTGACACTTCTCTCCAAATCCTCATCTCATTCTTCATCCTAAACATTTGCTCATTCTCACGATGAGCCATAACCAAAACCAACCTCACCGGCCAGTCCCGGTCCATGTCACAAACGCCGAGCCAAACCCTAACCCAAACAACCTCCCAAACTTTCTATTATCCGTCCGTCTCAAATACGTAAAACTCGGTTACCACTACCTAATCTCCAACGCTCTCTACATCCTCCTCCTTCCTCTCCTCGCCGCAACAATCGCTAACCTCTCTTCTTTCACCATCAACGACCTCTCTCTCCTCTACAACACACTCCGTTTCCATTTCCTCTCCGCCACACTCGCCACCGCACTCTTAATCTCTCTCTCCACCGCTTACTTCACCACCCGTCCCCGCCGTGTCTTCCTCCTCGACTTCTCGTGTTACAAACCAGACCCTTCACTGATCTGCACTCGTGAAACATTCATGGACAGATCTCAACGTGTAGGCATCTTCACAGAAGACAACTTAGCTTTCCAACAAAAGATCCTCGAAAGATCCGGTCTAGGTCAGAAAACTTACTTCCCTGAAGCTCTTCTTCGTGTTCCTCCTAATCCTTGTATGGAAGAAGCGAGAAAAGAGGCAGAAACAGTTATGTTCGGAGCTATTGACGCGGTTCTTGAGAAGACCGGTGTGAAACCTAAAGATATTGGAATCCTTGTGGTGAATTGTAGCTTGTTTAATCCAACACCGTCACTTTCTGCTATGATTGTGAATAAGTATAAGCTTAGAGGCAACATTTTGAGCTATAATCTTGGTGGAATGGGATGTAGTGCTGGCCTTATCTCCATTGATCTCGCTAAACAGATGCTTCAGGTGCAACCAAACTCATACGCACTAGTGGTGAGCACAGAGAACATAACCCTAAACTGGTACTTAGGCAACGACCGATCAATGCTTCTATCTAACTGTATCTTCCGTATGGGCGGAGCCGCGGTACTTCTCTCGAACCGCTCCTCTGATCGCAGCCGTTCAAAATATCAGCTCATCCATACCGTCCGTACCCACAAAGGAGCTGATGACAACGCATTTGGCTGTGTTTACCAACGAGAAGACAACAACGCAGAAGAAACCGGCAAAATCGGAGTGTCCCTCTCTAAAAACCTAATGGCGATAGCTGGAGAAGCTCTCAAGACAAACATCACAACTCTCGGACCACTAGTTCTACCAATGTCCGAACAACTTCTCTTTTTCGCGACTCTTGTGGCCCGAAAAGTCTTCAAAGTCAAGAAAATAAAGCCTTACATTCCTGATTTCAAGCTAGCTTTCGAGCATTTCTGTATCCACGCGGGAGGTAGAGCCGTGCTCGACGAGATTGAGAAGAACTTGGATTTATCCGAATGGCACATGGAGCCATCGAGGATGACGTTGAACCGGTTTGGTAACACTTCGAGTAGCTCACTTTGGTATGAGCTTGCGTATAGTGAAGCTAAAGGAAGGATTAAGAGAGGAGATAGGACTTGGCAGATTGCTTTTGGATCGGGTTTTAAGTGTAATAGTGCAGTTTGGAAAGCTTTGAGAACGATTGATCCAATGGACGAGAAGACTAATCCATGGATTGATGAGATTGATGACTTTCCTGTTCAAGTTCCTAGGATCACTCCCATTACATCGTCGTAGTGTTTTAAATTCTTTTGGAGAACTAATTTGTTATGTTTTATTAAATGTAATAACTTACGTGATTTGATATTTTTTTATTATCTTAATATATATGATTGCC

SEQ ID NO: 2545 - DNA, 1568 bp, Arabidopsis thaliana
  misc_feature (1)..(1568): Ceres cDNA ID no. 13613191
  misc_feature (1)..(1568): Also known as  Ceres CDNA ID no. 23533084
ttatttgatttggaatcacaagaaagtggtggttctcctttatttatgtcaccagccccctccacggatccacaaccaatctccggcgaaaaaaacggcggcgatggtggtaggattccggtagaagagtggctgccgatcacagaatcaagaaaaggaaatgtttatacggcgacgtttcatcttctctgttcgggaattggtctccaagtgattcttcttcctgcagctttcgcagcactcggatgggtatggggaacgataatcttaacggtagggtttgtatggaagctctacacgacgtggcttcttgttcaactccacgaagcggttccgggaattcgtatcagcagatacgtgagactcgcaattgcttcttttggtgtgaagcttgggaaacttctcggaatattccctgtgatgtatctctcaggaggagcttgtacgattctggttataaccggagggaaatcaatacaacaactgttacaaattatgtctgacgacaatacagcgccacttacttcagtgcaatgcttcttggtttttagttgcattgcgatgatcatgtctcagtttccgaatctaaattctctctttggagtctcgttgatcggtgcttttatgggaattgcgtattgcaccgtgatatggattttacctgtagctagtgactcacaaaggactcaagtcagtgtctcgtacgctacaatggataaaagtttcgttcacattttcaacgctattggattgatagctctagtatatcgcgggaacaatctcgtccttgagatacagggtactcttccttccgattcaaagaacccttcatgtaagacaatgtggagagcagtgatgatctctcatgctctcgtcgcgatttgtatgtttccattaacgtttgctgtatattgggcatacggagacaagattccggcgacgggaggtcccgtgggcaactatctgaaactttacacacaagagcactcgaagcgagcagcctgtttcatacacctcacgtttatcttctcttgcttatgttcatatccgataaacttaatgccggcgtgtgacaacatagagatggtgtacataaccaagaagaaaaagcctgcatccatcattgtccggatgatgttgcgtgtgtttttgagcttggtttgtttcactatagccgttggattcccgttcttgccttatctagcggttcttattggagcaatagccttgcttgtgacgtttacgtatccatgtttcatgtggatctctatcaaaaagccccaaaggaaaagcccaatgtggttgtttaacgttttggtgggttgcctaggtgcttctctcagcgttttgcttctggttgcctcggctatgcgtttggctcaaaagggtttgcatgctaacttcttcagaccctaaagcatccttgcaatcgttagaatgtaattagaatttgtggcacacgtggtaaacttgggactactaacatgttcagttgaaatatttaaattttgtaattatgatattttaatgtatacttctctcaaaaaagagaaaatcgtcagttgatg

SEQ ID NO: 2546 - protein, 1568 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
TTATTTGATTTGGAATCACAAGAAAGTGGTGGTTCTCCTTTATTTATGTCACCAGCCCCCTCCACGGATCCACAACCAATCTCCGGCGAAAAAAACGGCGGCGATGGTGGTAGGATTCCGGTAGAAGAGTGGCTGCCGATCACAGAATCAAGAAAAGGAAATGTTTATACGGCGACGTTTCATCTTCTCTGTTCGGGAATTGGTCTCCAAGTGATTCTTCTTCCTGCAGCTTTCGCAGCACTCGGATGGGTATGGGGAACGATAATCTTAACGGTAGGGTTTGTATGGAAGCTCTACACGACGTGGCTTCTTGTTCAACTCCACGAAGCGGTTCCGGGAATTCGTATCAGCAGATACGTGAGACTCGCAATTGCTTCTTTTGGTGTGAAGCTTGGGAAACTTCTCGGAATATTCCCTGTGATGTATCTCTCAGGAGGAGCTTGTACGATTCTGGTTATAACCGGAGGGAAATCAATACAACAACTGTTACAAATTATGTCTGACGACAATACAGCGCCACTTACTTCAGTGCAATGCTTCTTGGTTTTTAGTTGCATTGCGATGATCATGTCTCAGTTTCCGAATCTAAATTCTCTCTTTGGAGTCTCGTTGATCGGTGCTTTTATGGGAATTGCGTATTGCACCGTGATATGGATTTTACCTGTAGCTAGTGACTCACAAAGGACTCAAGTCAGTGTCTCGTACGCTACAATGGATAAAAGTTTCGTTCACATTTTCAACGCTATTGGATTGATAGCTCTAGTATATCGCGGGAACAATCTCGTCCTTGAGATACAGGGTACTCTTCCTTCCGATTCAAAGAACCCTTCATGTAAGACAATGTGGAGAGCAGTGATGATCTCTCATGCTCTCGTCGCGATTTGTATGTTTCCATTAACGTTTGCTGTATATTGGGCATACGGAGACAAGATTCCGGCGACGGGAGGTCCCGTGGGCAACTATCTGAAACTTTACACACAAGAGCACTCGAAGCGAGCAGCCTGTTTCATACACCTCACGTTTATCTTCTCTTGCTTATGTTCATATCCGATAAACTTAATGCCGGCGTGTGACAACATAGAGATGGTGTACATAACCAAGAAGAAAAAGCCTGCATCCATCATTGTCCGGATGATGTTGCGTGTGTTTTTGAGCTTGGTTTGTTTCACTATAGCCGTTGGATTCCCGTTCTTGCCTTATCTAGCGGTTCTTATTGGAGCAATAGCCTTGCTTGTGACGTTTACGTATCCATGTTTCATGTGGATCTCTATCAAAAAGCCCCAAAGGAAAAGCCCAATGTGGTTGTTTAACGTTTTGGTGGGTTGCCTAGGTGCTTCTCTCAGCGTTTTGCTTCTGGTTGCCTCGGCTATGCGTTTGGCTCAAAAGGGTTTGCATGCTAACTTCTTCAGACCCTAAAGCATCCTTGCAATCGTTAGAATGTAATTAGAATTTGTGGCACACGTGGTAAACTTGGGACTACTAACATGTTCAGTTGAAATATTTAAATTTTGTAATTATGATATTTTAATGTATACTTCTCTCAAAAAAGAGAAAATCGTCAGTTGATG

SEQ ID NO: 2547 - DNA, 1134 bp, Arabidopsis thaliana
  misc_feature (1)..(1134): Ceres cDNA ID no. 13613221
  misc_feature (1)..(1134): Also known as  Ceres CDNA ID no. 23533084
ctatctttcgagcattgaaatgattaaaaaaaaattagtggtgttttcaacatagatcatgacaggcaaaccctagattttacttcacctacttgaggttaaaaaacttaattgcaagtaggccagacatcggatcttctctcttaagggctaagcaaaacccatctctcctctttcttctatcttctttctcttccttctctcttctcttgtataaactccactgagctctgtttttgtttttaccgtagatcgtttcgagtctctttaatctttggcgggttccgtaaaaaaaaaaatggcctcttctagattccaatctgggttttgtcctatctcttcgtgtccctctcttgagaatttcatcgaaaggattaaagacgcatgtcgtttcaccctctccgctgttctagggacaattctctcggcggtcttgactttcttcttcgctttagtgggcacattgcttggagcacttactggagctttgataggccaagaaaccgaaagtgggtttatccgaggagcggcggttggagccatttcgggagctgttttctctatcgaagtctttgagtcatctcttgttctttggaaatctaatgagtcacgttttggatgtctcctctacttgattgatgtcattgttagtctgataagtggtagacttgtgcgggaacgaataggtccagcaatgctaagtgcggttcaaagtcagatgggagctgtggattcaactttcgaagagctctcgagtattttcgataccggtggctcaaaggggttaacaggagatttggttgataaaatacctaaaatcaaaatcactggcaaaaacaacttagatgcttctggcaacaaagactcatgttctgtttgtcttcaggattttcaacttggtgaaacggtgagaagcttgccacattgtcatcacatgtttcacttgccttgcatagacaattggctcttcaggcacggatcttgtccaatgtgtagacgcgatctgtaatctcttttcttaccatttgcacagcctcttccctctctctccttcttcttgtatggtcgtaaattcgtaatcatgtggttagagtctctatatatgtacaaagaaatgaaaaaaaaaaagttttg

SEQ ID NO: 2548 - protein, 1134 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
CTATCTTTCGAGCATTGAAATGATTAAAAAAAAATTAGTGGTGTTTTCAACATAGATCATGACAGGCAAACCCTAGATTTTACTTCACCTACTTGAGGTTAAAAAACTTAATTGCAAGTAGGCCAGACATCGGATCTTCTCTCTTAAGGGCTAAGCAAAACCCATCTCTCCTCTTTCTTCTATCTTCTTTCTCTTCCTTCTCTCTTCTCTTGTATAAACTCCACTGAGCTCTGTTTTTGTTTTTACCGTAGATCGTTTCGAGTCTCTTTAATCTTTGGCGGGTTCCGTAAAAAAAAAAATGGCCTCTTCTAGATTCCAATCTGGGTTTTGTCCTATCTCTTCGTGTCCCTCTCTTGAGAATTTCATCGAAAGGATTAAAGACGCATGTCGTTTCACCCTCTCCGCTGTTCTAGGGACAATTCTCTCGGCGGTCTTGACTTTCTTCTTCGCTTTAGTGGGCACATTGCTTGGAGCACTTACTGGAGCTTTGATAGGCCAAGAAACCGAAAGTGGGTTTATCCGAGGAGCGGCGGTTGGAGCCATTTCGGGAGCTGTTTTCTCTATCGAAGTCTTTGAGTCATCTCTTGTTCTTTGGAAATCTAATGAGTCACGTTTTGGATGTCTCCTCTACTTGATTGATGTCATTGTTAGTCTGATAAGTGGTAGACTTGTGCGGGAACGAATAGGTCCAGCAATGCTAAGTGCGGTTCAAAGTCAGATGGGAGCTGTGGATTCAACTTTCGAAGAGCTCTCGAGTATTTTCGATACCGGTGGCTCAAAGGGGTTAACAGGAGATTTGGTTGATAAAATACCTAAAATCAAAATCACTGGCAAAAACAACTTAGATGCTTCTGGCAACAAAGACTCATGTTCTGTTTGTCTTCAGGATTTTCAACTTGGTGAAACGGTGAGAAGCTTGCCACATTGTCATCACATGTTTCACTTGCCTTGCATAGACAATTGGCTCTTCAGGCACGGATCTTGTCCAATGTGTAGACGCGATCTGTAATCTCTTTTCTTACCATTTGCACAGCCTCTTCCCTCTCTCTCCTTCTTCTTGTATGGTCGTAAATTCGTAATCATGTGGTTAGAGTCTCTATATATGTACAAAGAAATGAAAAAAAAAAAGTTTTG

SEQ ID NO: 2549 - DNA, 2143 bp, Arabidopsis thaliana
  misc_feature (1)..(2143): Ceres cDNA ID no. 13613301
  misc_feature (1)..(2143): Also known as  Ceres CDNA ID no. 23533084
atctctcttcacatgcccatttgaatcgtatctcctctcatttcttcttttgttttgttggagttagataaaatcaaaggtctaataaaagtgtcaaaacccttatcgctataacctccactaccatcttaaacttctccttataactcacgcttctctgctttcttctctcagagtctaactgctcaaataagaaaatggttcatgtgtcatcatctcatggagccaaagatggctctgaagaagcctatgattacagaggaaacccaccagataagtctaaaaccggtggatggttaggcgccggtttaattttagggagcgagctatcagagagaatatgcgtgatgggcatatcaatgaatctagtgacgtaccttgttggagatttacacatctcatcagctaaatcagcgaccatagtcaccaacttcatgggaactcttaaccttctagggcttctcggtggttttttggctgacgctaaactcggtcgctacaagatggttgcaatctcagcttctgtcacagctctgggagtgttgcttttgacggtggctacaactatctcaagcatgagaccaccaatatgtgacgatttcaggagacttcatcatcagtgcatagaagcaaacggacaccagttggctcttctctatgttgctctctataccatagctctaggcggaggaggaatcaaatccaacgtctctggttttgggtctgaccagttcgatactagtgatcctaaagaagagaaacagatgattttcttcttcaacagattctatttctccatcagcgtcggctctctcttcgccgtgattgctcttgtttacgttcaggacaacgtcgggagaggctggggttacgggatctctgccgcgactatggtggttgcagccattgttttactctgcggaacgaaacggtaccgtttcaagaaacctaaaggaagcccttttacaacaatatggagggttggtttcttggcttggaagaaaagaaaggagagttaccctgcgcatccaagtcttttgaacggttatgacaacaccacggttccacacacagagatgcttaagtgtttagacaaagccgcaatttccaagaacgagagctctcctagctcgaaggacttcgaagagaaggatccgtggatcgtttcgactgttacacaagtcgaagaagtgaaactcgtgatgaaattggtaccgatttgggcaacgaacattcttttctggacgatttactcccaaatgacgactttcacggtcgaacaagcgacgtttatggaccgaaaactcggatctttcactgttcctgcaggctcttactctgctttcctcatactcacaattctcctcttcacttcccttaacgagagagtctttgttcctttaacaagaaggctcacaaaaaagcctcaaggaatcacaagcctacagagaatcggagtagggctagtattctcaatggctgcaatggctgtagccgcggttatagagaacgctagacgcgaggcagcggttaacaacgataagaaaataagcgcgttttggttggttccacaatatttcttagtcggtgcgggtgaggcctttgcttacgttggacagcttgagttctttataagagaagcaccagagaggatgaaatcgatgagcaccggattgtttctaagcacgatatcgatgggattcttcgtgagtagcttgcttgtttcgcttgttgatagggttacagacaaaagctggcttagaagtaaccttaacaaagcgagattgaactacttctactggttacttgttgtcttgggagcattgaacttcttgatttttattgtgtttgccatgaaacatcagtataaagctgatgtgattactgttgttgtgactgatgatgattcagtggagaaggaagtgacgaagaaagagagctctgaatttgagcttaaggacattccttgaaaccagatttagaagaagaaaaaaaacctctggttttgttatttgctttgaagatttcattttgtctttgtatttttagtatattgtgtgtatgaaatagaaagattactatatggtttggattgtatttttttttgtaagatttttaaaaatttagttactatagttttttc

SEQ ID NO: 2550 - protein, 2143 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ATCTCTCTTCACATGCCCATTTGAATCGTATCTCCTCTCATTTCTTCTTTTGTTTTGTTGGAGTTAGATAAAATCAAAGGTCTAATAAAAGTGTCAAAACCCTTATCGCTATAACCTCCACTACCATCTTAAACTTCTCCTTATAACTCACGCTTCTCTGCTTTCTTCTCTCAGAGTCTAACTGCTCAAATAAGAAAATGGTTCATGTGTCATCATCTCATGGAGCCAAAGATGGCTCTGAAGAAGCCTATGATTACAGAGGAAACCCACCAGATAAGTCTAAAACCGGTGGATGGTTAGGCGCCGGTTTAATTTTAGGGAGCGAGCTATCAGAGAGAATATGCGTGATGGGCATATCAATGAATCTAGTGACGTACCTTGTTGGAGATTTACACATCTCATCAGCTAAATCAGCGACCATAGTCACCAACTTCATGGGAACTCTTAACCTTCTAGGGCTTCTCGGTGGTTTTTTGGCTGACGCTAAACTCGGTCGCTACAAGATGGTTGCAATCTCAGCTTCTGTCACAGCTCTGGGAGTGTTGCTTTTGACGGTGGCTACAACTATCTCAAGCATGAGACCACCAATATGTGACGATTTCAGGAGACTTCATCATCAGTGCATAGAAGCAAACGGACACCAGTTGGCTCTTCTCTATGTTGCTCTCTATACCATAGCTCTAGGCGGAGGAGGAATCAAATCCAACGTCTCTGGTTTTGGGTCTGACCAGTTCGATACTAGTGATCCTAAAGAAGAGAAACAGATGATTTTCTTCTTCAACAGATTCTATTTCTCCATCAGCGTCGGCTCTCTCTTCGCCGTGATTGCTCTTGTTTACGTTCAGGACAACGTCGGGAGAGGCTGGGGTTACGGGATCTCTGCCGCGACTATGGTGGTTGCAGCCATTGTTTTACTCTGCGGAACGAAACGGTACCGTTTCAAGAAACCTAAAGGAAGCCCTTTTACAACAATATGGAGGGTTGGTTTCTTGGCTTGGAAGAAAAGAAAGGAGAGTTACCCTGCGCATCCAAGTCTTTTGAACGGTTATGACAACACCACGGTTCCACACACAGAGATGCTTAAGTGTTTAGACAAAGCCGCAATTTCCAAGAACGAGAGCTCTCCTAGCTCGAAGGACTTCGAAGAGAAGGATCCGTGGATCGTTTCGACTGTTACACAAGTCGAAGAAGTGAAACTCGTGATGAAATTGGTACCGATTTGGGCAACGAACATTCTTTTCTGGACGATTTACTCCCAAATGACGACTTTCACGGTCGAACAAGCGACGTTTATGGACCGAAAACTCGGATCTTTCACTGTTCCTGCAGGCTCTTACTCTGCTTTCCTCATACTCACAATTCTCCTCTTCACTTCCCTTAACGAGAGAGTCTTTGTTCCTTTAACAAGAAGGCTCACAAAAAAGCCTCAAGGAATCACAAGCCTACAGAGAATCGGAGTAGGGCTAGTATTCTCAATGGCTGCAATGGCTGTAGCCGCGGTTATAGAGAACGCTAGACGCGAGGCAGCGGTTAACAACGATAAGAAAATAAGCGCGTTTTGGTTGGTTCCACAATATTTCTTAGTCGGTGCGGGTGAGGCCTTTGCTTACGTTGGACAGCTTGAGTTCTTTATAAGAGAAGCACCAGAGAGGATGAAATCGATGAGCACCGGATTGTTTCTAAGCACGATATCGATGGGATTCTTCGTGAGTAGCTTGCTTGTTTCGCTTGTTGATAGGGTTACAGACAAAAGCTGGCTTAGAAGTAACCTTAACAAAGCGAGATTGAACTACTTCTACTGGTTACTTGTTGTCTTGGGAGCATTGAACTTCTTGATTTTTATTGTGTTTGCCATGAAACATCAGTATAAAGCTGATGTGATTACTGTTGTTGTGACTGATGATGATTCAGTGGAGAAGGAAGTGACGAAGAAAGAGAGCTCTGAATTTGAGCTTAAGGACATTCCTTGAAACCAGATTTAGAAGAAGAAAAAAAACCTCTGGTTTTGTTATTTGCTTTGAAGATTTCATTTTGTCTTTGTATTTTTAGTATATTGTGTGTATGAAATAGAAAGATTACTATATGGTTTGGATTGTATTTTTTTTTGTAAGATTTTTAAAAATTTAGTTACTATAGTTTTTTC

SEQ ID NO: 2551 - DNA, 1611 bp, Arabidopsis thaliana
  misc_feature (1)..(1611): Ceres cDNA ID no. 13613323
  misc_feature (1)..(1611): Also known as  Ceres CDNA ID no. 23533084
aaattaaaagtcaatcatatcaaatcccaaatcctcccagatgtttttatcatcttcttcttcctgaagatttgatttcattttcctctctttcagatccctattctcatggcttctggatcttactggtgctatagttgtagccgattcgtttgggtttccgattcaatctcttgccctgattgcgacggtggtttcctcgaactcatccaagagcctctcgatttcacaccttccgattccttcaccaccaccaccaccactcaacatcgcagccccactcgcttccctcctccttcttcttcttcctccaccccatccgcttctatgcacgccgataacagtcccactcctaccatcgttactcgtacacgaagcaatcgatctcctaatccagttattgttctccgtggatctgctgctgctccttcttctgatgttgtttccgaaggtttagatcgatctgcttttcagatgtattacgatgatggtactgattctggtcttagacctttaccaccgagtatgactgagtttttgttaggttctggatttgatcgtttgttagatcagatttctcagatcgagcttaacaccaatcggaatcttcgttcttgtgaacatccaccggcttctaaatcggccattgaagctttgcctctgattgaaatcgatccgactcatctcttatcggattctcaatctcattgcgctgtttgcaaagagaatttcgttttgaaatcatctgctcgcgagatgccttgtaatcacatctatcatcctgattgtattcttccttggcttgcgattcgtaactcttgtccggtttgccgtcatgagctaccggcggaggatctcaccgacggaaccggtgctgctttgactgctgttaccgctactgcagaggaagaggaagactcagctgcggggttaacgatttggaggttaccaggtggaggattcgctgtagggagaatccctggtggttggagaggtggagatagaatgatgccggtggtttacacggaggttgatggtggtagactcggtgatgagagacttccgagaagagtagcttggggttcgagaagaggtggaagagatggtggaggtagtagagagagaggtggtggctttgcgggtcggatcatgaggcttttcggatgttttagtggatcatctggatccattgctgctgctgctgctgcatcatccgggtccgggtccagaattcgggttactcgtagaaccaggtcgttctctatgttcagtacggcgtcgtcttcgtcaaggagacgaaattggctagcgtgattactagaattaccaagctctcttctcaggtgaaaactaaacacgaaagaacacactcttcttctgtttaaatttttcctatgttccttattaagtttttgtctatttcagtgtaatgattatattcattcctaaaatttgaatctatgcgagtaaattgatacaaaattaggtgacatagtgtcttcagtggcaaatttaggaggatatgttactgtgagtctgtgactagataagtgagagtgtagatgaattgaagaatgtactctgaaggagattcatagttgttctatttgt

SEQ ID NO: 2552 - protein, 1611 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
AAATTAAAAGTCAATCATATCAAATCCCAAATCCTCCCAGATGTTTTTATCATCTTCTTCTTCCTGAAGATTTGATTTCATTTTCCTCTCTTTCAGATCCCTATTCTCATGGCTTCTGGATCTTACTGGTGCTATAGTTGTAGCCGATTCGTTTGGGTTTCCGATTCAATCTCTTGCCCTGATTGCGACGGTGGTTTCCTCGAACTCATCCAAGAGCCTCTCGATTTCACACCTTCCGATTCCTTCACCACCACCACCACCACTCAACATCGCAGCCCCACTCGCTTCCCTCCTCCTTCTTCTTCTTCCTCCACCCCATCCGCTTCTATGCACGCCGATAACAGTCCCACTCCTACCATCGTTACTCGTACACGAAGCAATCGATCTCCTAATCCAGTTATTGTTCTCCGTGGATCTGCTGCTGCTCCTTCTTCTGATGTTGTTTCCGAAGGTTTAGATCGATCTGCTTTTCAGATGTATTACGATGATGGTACTGATTCTGGTCTTAGACCTTTACCACCGAGTATGACTGAGTTTTTGTTAGGTTCTGGATTTGATCGTTTGTTAGATCAGATTTCTCAGATCGAGCTTAACACCAATCGGAATCTTCGTTCTTGTGAACATCCACCGGCTTCTAAATCGGCCATTGAAGCTTTGCCTCTGATTGAAATCGATCCGACTCATCTCTTATCGGATTCTCAATCTCATTGCGCTGTTTGCAAAGAGAATTTCGTTTTGAAATCATCTGCTCGCGAGATGCCTTGTAATCACATCTATCATCCTGATTGTATTCTTCCTTGGCTTGCGATTCGTAACTCTTGTCCGGTTTGCCGTCATGAGCTACCGGCGGAGGATCTCACCGACGGAACCGGTGCTGCTTTGACTGCTGTTACCGCTACTGCAGAGGAAGAGGAAGACTCAGCTGCGGGGTTAACGATTTGGAGGTTACCAGGTGGAGGATTCGCTGTAGGGAGAATCCCTGGTGGTTGGAGAGGTGGAGATAGAATGATGCCGGTGGTTTACACGGAGGTTGATGGTGGTAGACTCGGTGATGAGAGACTTCCGAGAAGAGTAGCTTGGGGTTCGAGAAGAGGTGGAAGAGATGGTGGAGGTAGTAGAGAGAGAGGTGGTGGCTTTGCGGGTCGGATCATGAGGCTTTTCGGATGTTTTAGTGGATCATCTGGATCCATTGCTGCTGCTGCTGCTGCATCATCCGGGTCCGGGTCCAGAATTCGGGTTACTCGTAGAACCAGGTCGTTCTCTATGTTCAGTACGGCGTCGTCTTCGTCAAGGAGACGAAATTGGCTAGCGTGATTACTAGAATTACCAAGCTCTCTTCTCAGGTGAAAACTAAACACGAAAGAACACACTCTTCTTCTGTTTAAATTTTTCCTATGTTCCTTATTAAGTTTTTGTCTATTTCAGTGTAATGATTATATTCATTCCTAAAATTTGAATCTATGCGAGTAAATTGATACAAAATTAGGTGACATAGTGTCTTCAGTGGCAAATTTAGGAGGATATGTTACTGTGAGTCTGTGACTAGATAAGTGAGAGTGTAGATGAATTGAAGAATGTACTCTGAAGGAGATTCATAGTTGTTCTATTTGT

SEQ ID NO: 2553 - DNA, 1776 bp, Arabidopsis thaliana
  misc_feature (1)..(1776): Ceres cDNA ID no. 13613493
  misc_feature (1)..(1776): Also known as  Ceres CDNA ID no. 23533084
atgtcaacgaatcttcttcgtcttattctcctattcatcactttatctatcacttcatctctgtcaactccgtcgccggctgattctcctccttatctatggccgttaccggcggagttttcgttcggaaacgaaacgctctcggtggatcccaccgtgactctaatcgtagctggaaatggcggtggatctctgattattagagctgcgtttgataggtatatgggtataatctttaaacacgcttctggtagaggttctctattgtcgaggattagatttctgaaaatggttgagtatgatatcacttctttgaagatcgttgttcattctgattctgaggagcttcaattgggtgtggatgagagttatacattgatggtgtcgaagaagaacgagcaatcgattgttggagcagccacgatcgaggctaatacagtttatggtgcacttagaggattggagacatttagccagttgtgtgcctttgattatataaccaaatctgtgcaaatatataaagcaccatggtatattcaagataaacctagatttggataccgcggtctgctgatagatacatcaagacattatttaccaattgatgttattaagcaaataatcgaatccatgtcctttgccaaacttaatgtcctgcattggcacattgtagacgagcaatcatttcctcttgaaactcctacatatcctaatttgtggaaaggagcttattcgagatgggaacgttatacagttgaggatgcctctgagattgtcaggtttgccaaaatgagaggtattaatgtcatggctgaagtagatgtccctggccatgcggaatcgtggggaactggataccctgatctttggccgtctctgtcttgccgagagccccttgatgttactaaaaactttacattcgatgtgatttctggcattttagcagatatgagaaagatattcccatttgagcttttccacttgggtggtgatgaagttaatacagattgctggaaaaacacaactcatgttaaagaatggcttcagggtcgcaacttcacgactaaggacgcatataaatactttgtactccgagcgcaacagatagctatatcgaaaaattggacacctgtcaactgggaagaaaccttcagttcctttggaaaagatcttgatccgcggactgtgattcaaaactggctagtgtctgatatatgtcaaaaagcagtagcaaaaggattcaggtgcattttcagtaaccaaggatattggtacctcgaccatttagatgttccgtgggaagaggtttataacaccgagcctctaaatggaatcgaggatccttctctccaaaagcttgtcatcggaggagaagtttgcatgtggggtgaaacagctgatacatccgttgtccttcagaccatttggcctcgtgctgcagcagctgcagaacggatgtggagcaccagagaggccgtgtcaaaggggaacataacgttaaccgcattgccacgtctacactacttcagatgtctactgaataaccgtggcgttccagcggctccagtggataacttttacgcacgaagaccccccttgggacctggctcttgctatgctcagtgatccaaaacgtttcttctcattgtactatatgtaatgtctcgtctgaaatctggttgtcacgttgctttttctgttctaaattgtgtgcttctcaatttactcaaatcatgacaacatctgaaattacgatctaaaacacacgacgctctt

SEQ ID NO: 2554 - protein, 1776 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ATGTCAACGAATCTTCTTCGTCTTATTCTCCTATTCATCACTTTATCTATCACTTCATCTCTGTCAACTCCGTCGCCGGCTGATTCTCCTCCTTATCTATGGCCGTTACCGGCGGAGTTTTCGTTCGGAAACGAAACGCTCTCGGTGGATCCCACCGTGACTCTAATCGTAGCTGGAAATGGCGGTGGATCTCTGATTATTAGAGCTGCGTTTGATAGGTATATGGGTATAATCTTTAAACACGCTTCTGGTAGAGGTTCTCTATTGTCGAGGATTAGATTTCTGAAAATGGTTGAGTATGATATCACTTCTTTGAAGATCGTTGTTCATTCTGATTCTGAGGAGCTTCAATTGGGTGTGGATGAGAGTTATACATTGATGGTGTCGAAGAAGAACGAGCAATCGATTGTTGGAGCAGCCACGATCGAGGCTAATACAGTTTATGGTGCACTTAGAGGATTGGAGACATTTAGCCAGTTGTGTGCCTTTGATTATATAACCAAATCTGTGCAAATATATAAAGCACCATGGTATATTCAAGATAAACCTAGATTTGGATACCGCGGTCTGCTGATAGATACATCAAGACATTATTTACCAATTGATGTTATTAAGCAAATAATCGAATCCATGTCCTTTGCCAAACTTAATGTCCTGCATTGGCACATTGTAGACGAGCAATCATTTCCTCTTGAAACTCCTACATATCCTAATTTGTGGAAAGGAGCTTATTCGAGATGGGAACGTTATACAGTTGAGGATGCCTCTGAGATTGTCAGGTTTGCCAAAATGAGAGGTATTAATGTCATGGCTGAAGTAGATGTCCCTGGCCATGCGGAATCGTGGGGAACTGGATACCCTGATCTTTGGCCGTCTCTGTCTTGCCGAGAGCCCCTTGATGTTACTAAAAACTTTACATTCGATGTGATTTCTGGCATTTTAGCAGATATGAGAAAGATATTCCCATTTGAGCTTTTCCACTTGGGTGGTGATGAAGTTAATACAGATTGCTGGAAAAACACAACTCATGTTAAAGAATGGCTTCAGGGTCGCAACTTCACGACTAAGGACGCATATAAATACTTTGTACTCCGAGCGCAACAGATAGCTATATCGAAAAATTGGACACCTGTCAACTGGGAAGAAACCTTCAGTTCCTTTGGAAAAGATCTTGATCCGCGGACTGTGATTCAAAACTGGCTAGTGTCTGATATATGTCAAAAAGCAGTAGCAAAAGGATTCAGGTGCATTTTCAGTAACCAAGGATATTGGTACCTCGACCATTTAGATGTTCCGTGGGAAGAGGTTTATAACACCGAGCCTCTAAATGGAATCGAGGATCCTTCTCTCCAAAAGCTTGTCATCGGAGGAGAAGTTTGCATGTGGGGTGAAACAGCTGATACATCCGTTGTCCTTCAGACCATTTGGCCTCGTGCTGCAGCAGCTGCAGAACGGATGTGGAGCACCAGAGAGGCCGTGTCAAAGGGGAACATAACGTTAACCGCATTGCCACGTCTACACTACTTCAGATGTCTACTGAATAACCGTGGCGTTCCAGCGGCTCCAGTGGATAACTTTTACGCACGAAGACCCCCCTTGGGACCTGGCTCTTGCTATGCTCAGTGATCCAAAACGTTTCTTCTCATTGTACTATATGTAATGTCTCGTCTGAAATCTGGTTGTCACGTTGCTTTTTCTGTTCTAAATTGTGTGCTTCTCAATTTACTCAAATCATGACAACATCTGAAATTACGATCTAAAACACACGACGCTCTT

SEQ ID NO: 2555 - DNA, 1392 bp, Arabidopsis thaliana
  misc_feature (1)..(1392): Ceres cDNA ID no. 13613511
  misc_feature (1)..(1392): Also known as  Ceres CDNA ID no. 23533084
agacgagaggcacacaaaaagagatacaaaaccaaaactttcaagcaaagcaattcaatttcaatcaaaaaccaaatcgaagatctttgaaagtttcctttttttccgaaatctgagcttgggtattgttggataagcttctcggagattgagattgaggattttgataggtgaggagattgaaagatttggatttttgggcggcaaaaatggtgatgcagacggaagctagggttggtgtgagctcaggacatggcgtagcttcgtcttctcatcgtttaacgcaggaccagagatcacatatcgaatcggcgtcgcagctcttagccggaggactcgctggtgcttttagcaagacttgtactgctcctctatctcgtctcaccattctcttccaggtgcaaggtatgcacacaaatgctgcagctttaagaaagccaagcatattacacgaggcttcacggatattgaatgaagaaggattgaaagctttttggaaagggaatctagttactattgctcaccggcttccatattcttctgttaatttctacgcatatgaacactacaagaagttcatgtatatggttactgggatggaaaatcacaaggagggtataagttcaaacctttttgtacattttgtagccggtggtttggctggaatcacagctgcttctgccacttatccacttgatcttgttagaactcgtcttgctgctcagacaaaagtaatctactactcgggtatctggcatactctgcgctctattacaaccgatgaaggtatcttgggcctctacaagggactaggaacaacgcttgtgggtgttgggcctagtattgccattagcttttctgtgtatgaatcattgagatcttattggaggtcaactaggccccatgattcccctatcatggtcagtctagcttgtggaagtctttcaggaatagcatcttcaacagctacgtttccattggatctggtgagaagaaggaagcagctggaaggaataggcgggcgagcggtagtgtacaagacaggtttgttaggcacattaaagcgtattgttcaaacggaaggagcgagaggcctgtacagaggaattcttccagagtactacaaagtggtacctggtgtagggatttgcttcatgacctacgagacactcaagctttacttcaaggatctttcttcgaatctataacggtttaaaaggttggtagatttgtttaggtctatttttggtgagaggaaaaaaactgtaaaaaccaaacagcggaaaatgataatgtatacgaaatgtagaattatatatgtagttgttggatgtagcttatacgagattaacatttgtattggtacaatccttttccattgttacatggctt

SEQ ID NO: 2556 - protein, 1392 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
AGACGAGAGGCACACAAAAAGAGATACAAAACCAAAACTTTCAAGCAAAGCAATTCAATTTCAATCAAAAACCAAATCGAAGATCTTTGAAAGTTTCCTTTTTTTCCGAAATCTGAGCTTGGGTATTGTTGGATAAGCTTCTCGGAGATTGAGATTGAGGATTTTGATAGGTGAGGAGATTGAAAGATTTGGATTTTTGGGCGGCAAAAATGGTGATGCAGACGGAAGCTAGGGTTGGTGTGAGCTCAGGACATGGCGTAGCTTCGTCTTCTCATCGTTTAACGCAGGACCAGAGATCACATATCGAATCGGCGTCGCAGCTCTTAGCCGGAGGACTCGCTGGTGCTTTTAGCAAGACTTGTACTGCTCCTCTATCTCGTCTCACCATTCTCTTCCAGGTGCAAGGTATGCACACAAATGCTGCAGCTTTAAGAAAGCCAAGCATATTACACGAGGCTTCACGGATATTGAATGAAGAAGGATTGAAAGCTTTTTGGAAAGGGAATCTAGTTACTATTGCTCACCGGCTTCCATATTCTTCTGTTAATTTCTACGCATATGAACACTACAAGAAGTTCATGTATATGGTTACTGGGATGGAAAATCACAAGGAGGGTATAAGTTCAAACCTTTTTGTACATTTTGTAGCCGGTGGTTTGGCTGGAATCACAGCTGCTTCTGCCACTTATCCACTTGATCTTGTTAGAACTCGTCTTGCTGCTCAGACAAAAGTAATCTACTACTCGGGTATCTGGCATACTCTGCGCTCTATTACAACCGATGAAGGTATCTTGGGCCTCTACAAGGGACTAGGAACAACGCTTGTGGGTGTTGGGCCTAGTATTGCCATTAGCTTTTCTGTGTATGAATCATTGAGATCTTATTGGAGGTCAACTAGGCCCCATGATTCCCCTATCATGGTCAGTCTAGCTTGTGGAAGTCTTTCAGGAATAGCATCTTCAACAGCTACGTTTCCATTGGATCTGGTGAGAAGAAGGAAGCAGCTGGAAGGAATAGGCGGGCGAGCGGTAGTGTACAAGACAGGTTTGTTAGGCACATTAAAGCGTATTGTTCAAACGGAAGGAGCGAGAGGCCTGTACAGAGGAATTCTTCCAGAGTACTACAAAGTGGTACCTGGTGTAGGGATTTGCTTCATGACCTACGAGACACTCAAGCTTTACTTCAAGGATCTTTCTTCGAATCTATAACGGTTTAAAAGGTTGGTAGATTTGTTTAGGTCTATTTTTGGTGAGAGGAAAAAAACTGTAAAAACCAAACAGCGGAAAATGATAATGTATACGAAATGTAGAATTATATATGTAGTTGTTGGATGTAGCTTATACGAGATTAACATTTGTATTGGTACAATCCTTTTCCATTGTTACATGGCTT

SEQ ID NO: 2557 - DNA, 1131 bp, Arabidopsis thaliana
  misc_feature (1)..(1131): Ceres cDNA ID no. 13613547
  misc_feature (1)..(1131): Also known as  Ceres CDNA ID no. 23533084
atgtcggggaaactttggatcccgagatttattctcatcactctactgtttattagctcacgagttaactctcaatgtgaattcagtttcactggacgcaacaaggtctttcatttcaacctagcatcttcgattcggaattatcctcacggtgtgctcagcgaagatgggttttataaagtggaagcgaacagttccgtgttatggtttcagctttgtgacgtgctgattttcaatcatgatccccctcgatgtgttggttgcgaagattgtggaggtccatctcactgcggaacgtcatgtagtgcacttgtgtcagaaaatgtaagagggtatgatgtatgcacttctctagggcatgcctcaagcacaaaagttgatattattgataaagaggatcctggcaaaggcgtcattgttcagatgtcaactggaaataggaaccaaaattgctcgctttcagtttctgttatttgccagaaaactaaagttgatggaccactcactttggcgaaatctggtacctgtcagtatgctactcagctgcgacatcctgccggttgtgcagcagctatatccggccatagtagtggatggggctggtttagtaccttactaatcattatcttgtgcctgtttggagcttatctggtgggtggtgcagtatatcggtatttctcccttggaattcgtggcatagatgtaatcccgaatatggattactgggccactgtacctcacagtatacagagctgttttggctcactattttcaagattcggggggtctattcgtggtcagcaaacctcatattctcaggtcaacttctgagcagtctcagcatcttctctgatccatggtctggagacacatccccaaactttccttgactggttcaaccaattgcaaacgccgctagattgttataccctgagtactcttttggccattatatgactgcaagttataaggtgcctctccttttcagcttgttatgtcatggatccctgtagaaacaaaagaatcttgttcattggatagaaacaatgtcaagccattgcaatctgcagcctttcccatttcgtgtgtttgctctttggagattgtttcagtttcttgatgctgattttg

SEQ ID NO: 2558 - protein, 1131 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ATGTCGGGGAAACTTTGGATCCCGAGATTTATTCTCATCACTCTACTGTTTATTAGCTCACGAGTTAACTCTCAATGTGAATTCAGTTTCACTGGACGCAACAAGGTCTTTCATTTCAACCTAGCATCTTCGATTCGGAATTATCCTCACGGTGTGCTCAGCGAAGATGGGTTTTATAAAGTGGAAGCGAACAGTTCCGTGTTATGGTTTCAGCTTTGTGACGTGCTGATTTTCAATCATGATCCCCCTCGATGTGTTGGTTGCGAAGATTGTGGAGGTCCATCTCACTGCGGAACGTCATGTAGTGCACTTGTGTCAGAAAATGTAAGAGGGTATGATGTATGCACTTCTCTAGGGCATGCCTCAAGCACAAAAGTTGATATTATTGATAAAGAGGATCCTGGCAAAGGCGTCATTGTTCAGATGTCAACTGGAAATAGGAACCAAAATTGCTCGCTTTCAGTTTCTGTTATTTGCCAGAAAACTAAAGTTGATGGACCACTCACTTTGGCGAAATCTGGTACCTGTCAGTATGCTACTCAGCTGCGACATCCTGCCGGTTGTGCAGCAGCTATATCCGGCCATAGTAGTGGATGGGGCTGGTTTAGTACCTTACTAATCATTATCTTGTGCCTGTTTGGAGCTTATCTGGTGGGTGGTGCAGTATATCGGTATTTCTCCCTTGGAATTCGTGGCATAGATGTAATCCCGAATATGGATTACTGGGCCACTGTACCTCACAGTATACAGAGCTGTTTTGGCTCACTATTTTCAAGATTCGGGGGGTCTATTCGTGGTCAGCAAACCTCATATTCTCAGGTCAACTTCTGAGCAGTCTCAGCATCTTCTCTGATCCATGGTCTGGAGACACATCCCCAAACTTTCCTTGACTGGTTCAACCAATTGCAAACGCCGCTAGATTGTTATACCCTGAGTACTCTTTTGGCCATTATATGACTGCAAGTTATAAGGTGCCTCTCCTTTTCAGCTTGTTATGTCATGGATCCCTGTAGAAACAAAAGAATCTTGTTCATTGGATAGAAACAATGTCAAGCCATTGCAATCTGCAGCCTTTCCCATTTCGTGTGTTTGCTCTTTGGAGATTGTTTCAGTTTCTTGATGCTGATTTTG

SEQ ID NO: 2559 - DNA, 1145 bp, Arabidopsis thaliana
  misc_feature (1)..(1145): Ceres cDNA ID no. 13613946
  misc_feature (1)..(1145): Also known as  Ceres CDNA ID no. 23533084
atatctctcccccttcttctctcttcctcacattcctcaccaaaccctctccaaaacacacccacacgtacgcacacacacaaagacaatgtctcctttcaaaatattcttcttcacgactcttctcgtggcggcgttttcagtgtcggctgctgatttcaacactgacgtcaacgtagcttggggaaatggccgtgggaagatactcaacaacggccagcttcttactctctccttagacaaatcctctggttccggttttcaatccaaaacagagtatttgtttggaaagattgatatgcagattaagcttgttcctggtaactctgcaggaacagtcacaactttttacctaaaatccgaaggatccacttgggatgagattgattttgagttcttgggtaatatgagtggagatccttatactttacacactaatgtttacactcaaggtaaaggtgacaaagagcaacaattccatctctggttcgacccaaccgccaatttccacacttactcaatcctctggaaccctcaaagaatcatattgaccgtcgatgacacacccattagagagtttaaaaactatgagtctctcggtgtcttgtttccaaagaacaagccgatgaggatgtacgcgagtttatggaacgcagacgattgggcaacaagaggcggtcttgttaaaactgattggtctaaagctccattcatggcttcttacagaaacattaagattgactcgaaaccaaactccaattggtacactcaagaaatggattcaacaagccaagctagactcaaatgggttcagaagaattacatgatctacaattattgtactgaccataggaggtttccacagggagctcctaaggaatgcacaacaagctcatagaatctcaaattatattctatttatttatctacacttcctctctttcttttatgtgaaaattgtgaatgctctgtttatagcttgtctattatgtccgagaatttctttttctgtttttgattcttttcgttgtatatctttgtccaataaaggaaatgatgtgtctttactcttatagatatgtataaaaagatgtccctgttttatttgttaaaaaaaattgtttatgataatgatagttctttct

SEQ ID NO: 2560 - protein, 1145 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ATATCTCTCCCCCTTCTTCTCTCTTCCTCACATTCCTCACCAAACCCTCTCCAAAACACACCCACACGTACGCACACACACAAAGACAATGTCTCCTTTCAAAATATTCTTCTTCACGACTCTTCTCGTGGCGGCGTTTTCAGTGTCGGCTGCTGATTTCAACACTGACGTCAACGTAGCTTGGGGAAATGGCCGTGGGAAGATACTCAACAACGGCCAGCTTCTTACTCTCTCCTTAGACAAATCCTCTGGTTCCGGTTTTCAATCCAAAACAGAGTATTTGTTTGGAAAGATTGATATGCAGATTAAGCTTGTTCCTGGTAACTCTGCAGGAACAGTCACAACTTTTTACCTAAAATCCGAAGGATCCACTTGGGATGAGATTGATTTTGAGTTCTTGGGTAATATGAGTGGAGATCCTTATACTTTACACACTAATGTTTACACTCAAGGTAAAGGTGACAAAGAGCAACAATTCCATCTCTGGTTCGACCCAACCGCCAATTTCCACACTTACTCAATCCTCTGGAACCCTCAAAGAATCATATTGACCGTCGATGACACACCCATTAGAGAGTTTAAAAACTATGAGTCTCTCGGTGTCTTGTTTCCAAAGAACAAGCCGATGAGGATGTACGCGAGTTTATGGAACGCAGACGATTGGGCAACAAGAGGCGGTCTTGTTAAAACTGATTGGTCTAAAGCTCCATTCATGGCTTCTTACAGAAACATTAAGATTGACTCGAAACCAAACTCCAATTGGTACACTCAAGAAATGGATTCAACAAGCCAAGCTAGACTCAAATGGGTTCAGAAGAATTACATGATCTACAATTATTGTACTGACCATAGGAGGTTTCCACAGGGAGCTCCTAAGGAATGCACAACAAGCTCATAGAATCTCAAATTATATTCTATTTATTTATCTACACTTCCTCTCTTTCTTTTATGTGAAAATTGTGAATGCTCTGTTTATAGCTTGTCTATTATGTCCGAGAATTTCTTTTTCTGTTTTTGATTCTTTTCGTTGTATATCTTTGTCCAATAAAGGAAATGATGTGTCTTTACTCTTATAGATATGTATAAAAAGATGTCCCTGTTTTATTTGTTAAAAAAAATTGTTTATGATAATGATAGTTCTTTCT

SEQ ID NO: 2561 - DNA, 1637 bp, Arabidopsis thaliana
  misc_feature (1)..(1637): Ceres cDNA ID no. 13613950
  misc_feature (1)..(1637): Also known as  Ceres CDNA ID no. 23533084
aaatcttgaaattaaaaaaacagagcaatctttctctctctgttctgagagcttccatgtctgaaaccaacaacaacaaagcttgagtcttcctgttccttttccttttctctctcaaactcatgaaattttctcgggaaaatatgaaatgggttttcccagaaatcaaaacaactcagaatttcctctctccttcatcacttccacaagaaccaccgttatctctccgctccagcgcaaacttcgatctaaacagcaaaatcagtccaagtattctcctcataatcataatcctctcaatcatcttcttcatctccggtctccttcatctcttagtcagattcctcctcacaccatcgagcagagacagagaagattacttcgacaacgtcactgctcttcaaggccagcttcaacagctttttcatctccatgattctggagttgaccaatccttcatcgacacgttacctgttttccattacaaatccataatcggtctcaagaactatccttttgattgtgcagtttgtctttgtgagttcgaaacagaggataagctcaggctcttacctaaatgcagccacgcctttcacatggattgtatcgatacttggcttctatctcactctacttgtcctttgtgtagatccagtctcctctctgatctctcttcgcaccaagatcctcgttcttctttcctccttgtgctcgagtctgcgagtgatcatagctcgagagagattggaggagatagagacagtgcagcttgtgtggctgcaaatgatgatattgatgtgtctagtgctcatcttggtttggtcggaaacaatgatcttggatcaaccaggatagattcgggtcacggagatcagtacctggatggtgaattgggtggttcggttggaaaggttgttcctttttcagttaagctagggaagtttaggaatatagatattggtgaaggaactagtagcaacaacaacattggtaatagtagtagtttagatgagaggaggtgtttctcaatgggatcatatgagtatataatggatgaagaaacgactcttaaggttcatgtttcaaccaagaaacaatcaagcaagaaccgtggcttgcccggtcataggacagcgatgtccgaatgcgggtttgatccaacagggagattgaaattcagtgggagtggatcgatgaggatagtggaagaagcggccgagaagaatgtagtggaaagagagagcttttcggtatcgaaaatatggctaagggggaagaaggagaagcatagtaaagttcaaggaaaagaggatagttcattggtttcttcgtcttcgggaagagcattctctttcaggttatcgaaccagcggaaccatcccgatgcgatgatcgaaagtggttgcgaagaagataatcaaaagtgcgaaaactcggagtctttggagactaaaacaccatcttttgctaggaggactatgctttggcttgcagggagacaaaacaaggttgttcattcttcttcttcaactaatgtctagttactataatttttccattttcaaatttagttttctgttcaattgtttctttgtgttagtcctcataagtgcaaaaagatatatgaatcattgtag

SEQ ID NO: 2562 - protein, 1637 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
AAATCTTGAAATTAAAAAAACAGAGCAATCTTTCTCTCTCTGTTCTGAGAGCTTCCATGTCTGAAACCAACAACAACAAAGCTTGAGTCTTCCTGTTCCTTTTCCTTTTCTCTCTCAAACTCATGAAATTTTCTCGGGAAAATATGAAATGGGTTTTCCCAGAAATCAAAACAACTCAGAATTTCCTCTCTCCTTCATCACTTCCACAAGAACCACCGTTATCTCTCCGCTCCAGCGCAAACTTCGATCTAAACAGCAAAATCAGTCCAAGTATTCTCCTCATAATCATAATCCTCTCAATCATCTTCTTCATCTCCGGTCTCCTTCATCTCTTAGTCAGATTCCTCCTCACACCATCGAGCAGAGACAGAGAAGATTACTTCGACAACGTCACTGCTCTTCAAGGCCAGCTTCAACAGCTTTTTCATCTCCATGATTCTGGAGTTGACCAATCCTTCATCGACACGTTACCTGTTTTCCATTACAAATCCATAATCGGTCTCAAGAACTATCCTTTTGATTGTGCAGTTTGTCTTTGTGAGTTCGAAACAGAGGATAAGCTCAGGCTCTTACCTAAATGCAGCCACGCCTTTCACATGGATTGTATCGATACTTGGCTTCTATCTCACTCTACTTGTCCTTTGTGTAGATCCAGTCTCCTCTCTGATCTCTCTTCGCACCAAGATCCTCGTTCTTCTTTCCTCCTTGTGCTCGAGTCTGCGAGTGATCATAGCTCGAGAGAGATTGGAGGAGATAGAGACAGTGCAGCTTGTGTGGCTGCAAATGATGATATTGATGTGTCTAGTGCTCATCTTGGTTTGGTCGGAAACAATGATCTTGGATCAACCAGGATAGATTCGGGTCACGGAGATCAGTACCTGGATGGTGAATTGGGTGGTTCGGTTGGAAAGGTTGTTCCTTTTTCAGTTAAGCTAGGGAAGTTTAGGAATATAGATATTGGTGAAGGAACTAGTAGCAACAACAACATTGGTAATAGTAGTAGTTTAGATGAGAGGAGGTGTTTCTCAATGGGATCATATGAGTATATAATGGATGAAGAAACGACTCTTAAGGTTCATGTTTCAACCAAGAAACAATCAAGCAAGAACCGTGGCTTGCCCGGTCATAGGACAGCGATGTCCGAATGCGGGTTTGATCCAACAGGGAGATTGAAATTCAGTGGGAGTGGATCGATGAGGATAGTGGAAGAAGCGGCCGAGAAGAATGTAGTGGAAAGAGAGAGCTTTTCGGTATCGAAAATATGGCTAAGGGGGAAGAAGGAGAAGCATAGTAAAGTTCAAGGAAAAGAGGATAGTTCATTGGTTTCTTCGTCTTCGGGAAGAGCATTCTCTTTCAGGTTATCGAACCAGCGGAACCATCCCGATGCGATGATCGAAAGTGGTTGCGAAGAAGATAATCAAAAGTGCGAAAACTCGGAGTCTTTGGAGACTAAAACACCATCTTTTGCTAGGAGGACTATGCTTTGGCTTGCAGGGAGACAAAACAAGGTTGTTCATTCTTCTTCTTCAACTAATGTCTAGTTACTATAATTTTTCCATTTTCAAATTTAGTTTTCTGTTCAATTGTTTCTTTGTGTTAGTCCTCATAAGTGCAAAAAGATATATGAATCATTGTAG

SEQ ID NO: 2563 - DNA, 1209 bp, Arabidopsis thaliana
  misc_feature (1)..(1209): Ceres cDNA ID no. 13614082
  misc_feature (1)..(1209): Also known as  Ceres CDNA ID no. 23533084
gttggccggaaatcaatttcgtcgtcttcatcgactctttctctccctgaattttctctggcatttcgaatttatagaggtacgcatggctgccaaggctttaaaagatttgaagaatcttcctgtctctgagaggaatatcgactataaaacaaagcttttggttggcaaaatgaatggaacagctgaagataaaccaccacaaaactctgtcccctttgatcacaatcatcctaaaggcgatgagattgagaaacctgaggcagagagagttatcgtagaaattgagtatatagaatccaaagacttgaacaatgtaacccaagttgatgcagttctcaagtcacttgtaaccgagctagactccaaggattgggttttggtctgtgatgctcttaataccattcgtcgtctttccatattccacaaggaagaaatgctgcatatgctggagaaagtgatcctgtttatcgtgaaatcactgaagaacccaagaagtgctgtaagtaaaaccgcatgtatgacatctgctgacatcttcagctcatataatgaccatacaatcgatcaattggatctcttgcttactcaactcctccttaaatcttcccaagacaagcgatttgtttgtgaagcagcagaaaaagcattagtagcaatgactgcacatgtttctcctgccttgctgttgccaaagcttcaaccttttctcaagaataggaatcctcggatccgcgcaaaagcatccacgtgcttctcccgatgtgttccccgactgggcattgaaggcattagagaatatggaattgagaaactagtccaagcagcatcgtctcagctcagtgaccaactcccagaatctcgggaggctgcacgggcagtcttactggaacttcagacagtgtacaagaaaactactaatgtcgaaccgaaggaggagcatccagagccagtcacttggcaaatcttctgccaatcaaacctctcacctcttagtgcacaggctgtgatacgtgtcaccaatgtcgcaggtgtggctcgagagggtcttgttgcgggttcatgacagtcacaagccctcagtttgatattgtaagcctctgtgagtaaacgttgtacgaccactgtttctctatctttggtttatgggtttgtttctttattttgtgtgtgaatatgtcgatgtggtaagataaatctcaacgactc

SEQ ID NO: 2564 - protein, 1209 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
GTTGGCCGGAAATCAATTTCGTCGTCTTCATCGACTCTTTCTCTCCCTGAATTTTCTCTGGCATTTCGAATTTATAGAGGTACGCATGGCTGCCAAGGCTTTAAAAGATTTGAAGAATCTTCCTGTCTCTGAGAGGAATATCGACTATAAAACAAAGCTTTTGGTTGGCAAAATGAATGGAACAGCTGAAGATAAACCACCACAAAACTCTGTCCCCTTTGATCACAATCATCCTAAAGGCGATGAGATTGAGAAACCTGAGGCAGAGAGAGTTATCGTAGAAATTGAGTATATAGAATCCAAAGACTTGAACAATGTAACCCAAGTTGATGCAGTTCTCAAGTCACTTGTAACCGAGCTAGACTCCAAGGATTGGGTTTTGGTCTGTGATGCTCTTAATACCATTCGTCGTCTTTCCATATTCCACAAGGAAGAAATGCTGCATATGCTGGAGAAAGTGATCCTGTTTATCGTGAAATCACTGAAGAACCCAAGAAGTGCTGTAAGTAAAACCGCATGTATGACATCTGCTGACATCTTCAGCTCATATAATGACCATACAATCGATCAATTGGATCTCTTGCTTACTCAACTCCTCCTTAAATCTTCCCAAGACAAGCGATTTGTTTGTGAAGCAGCAGAAAAAGCATTAGTAGCAATGACTGCACATGTTTCTCCTGCCTTGCTGTTGCCAAAGCTTCAACCTTTTCTCAAGAATAGGAATCCTCGGATCCGCGCAAAAGCATCCACGTGCTTCTCCCGATGTGTTCCCCGACTGGGCATTGAAGGCATTAGAGAATATGGAATTGAGAAACTAGTCCAAGCAGCATCGTCTCAGCTCAGTGACCAACTCCCAGAATCTCGGGAGGCTGCACGGGCAGTCTTACTGGAACTTCAGACAGTGTACAAGAAAACTACTAATGTCGAACCGAAGGAGGAGCATCCAGAGCCAGTCACTTGGCAAATCTTCTGCCAATCAAACCTCTCACCTCTTAGTGCACAGGCTGTGATACGTGTCACCAATGTCGCAGGTGTGGCTCGAGAGGGTCTTGTTGCGGGTTCATGACAGTCACAAGCCCTCAGTTTGATATTGTAAGCCTCTGTGAGTAAACGTTGTACGACCACTGTTTCTCTATCTTTGGTTTATGGGTTTGTTTCTTTATTTTGTGTGTGAATATGTCGATGTGGTAAGATAAATCTCAACGACTC

SEQ ID NO: 2565 - DNA, 1249 bp, Arabidopsis thaliana
  misc_feature (1)..(1249): Ceres cDNA ID no. 13614110
  misc_feature (1)..(1249): Also known as  Ceres CDNA ID no. 23533084
accctctgttttgtttctccccaatcaaaaatctcaatcccaatcacttcgcttctaatcttaaagcctttaatttagtcttcgagccctctaatggcggatcagagcaaaaacactccagagatcttcgagctcaacaatggcaccatgcaggtcaagatctcaaactacggcaccaccatcacctctttgtctgttcccgacaagaacgggaaactgggggatgtagttctcggattcgactcggtggatccatatgtgaaagggcttgcaccatactttgggtgcattgttggtcgtgtggcaaatcggatcaaggagggaaaattcagtctcaatggagttaactacactttgcctatcaacaagcctcctaatagtctccacggtggtaacaagggtttcgataagaagatatgggaagttgcagggcacaagagagacggcgaaaaacctttcatcactttcaaatatcacagtgccgatggagaagaaggttaccctggtgcggtttctgtcacggcgacatacactctcacgtcagccacgacaatgagacttgacatggaagctgttccagagaacaaagatactcccatcaacttagctcaacatacatactggaacttagcaggtcatgactcaggaaacattctagaccataagattcagatatgggggtctcatatcacgccggttgacgaatacacagttcctacaggagagatcttgcctgtaaagggaactcctttcgatttcactgaggagaagcggataggcgagtctattggagaggttggtatcggatacgatcataactacgtgttggactgtcctgatcaagagaaggaggggctgaaacacgcagcgaagctcagtgatgctgctagctcaagggtactgaacttgtggaccaatgtgccgggaatgcagttttataccgggaactatgtgaatggagtggttgggaaagggaatgcggtttacgggaaacatgcgggtgtgtgccttgagacgcagggattcccgaacgcgattaaccagtcgaatttcccgtctgttgtggttaaggctggtgagaagtacaatcacacgatgctgtttgagttttcagcttgagtttatagatggacgttttaggtgttagatgatgggaataaagggccggttcatttgattcactgggctggaaaaagagtgattttaattttatctctttgggggagaataataaaaccaaactgtttac

SEQ ID NO: 2566 - protein, 1249 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ACCCTCTGTTTTGTTTCTCCCCAATCAAAAATCTCAATCCCAATCACTTCGCTTCTAATCTTAAAGCCTTTAATTTAGTCTTCGAGCCCTCTAATGGCGGATCAGAGCAAAAACACTCCAGAGATCTTCGAGCTCAACAATGGCACCATGCAGGTCAAGATCTCAAACTACGGCACCACCATCACCTCTTTGTCTGTTCCCGACAAGAACGGGAAACTGGGGGATGTAGTTCTCGGATTCGACTCGGTGGATCCATATGTGAAAGGGCTTGCACCATACTTTGGGTGCATTGTTGGTCGTGTGGCAAATCGGATCAAGGAGGGAAAATTCAGTCTCAATGGAGTTAACTACACTTTGCCTATCAACAAGCCTCCTAATAGTCTCCACGGTGGTAACAAGGGTTTCGATAAGAAGATATGGGAAGTTGCAGGGCACAAGAGAGACGGCGAAAAACCTTTCATCACTTTCAAATATCACAGTGCCGATGGAGAAGAAGGTTACCCTGGTGCGGTTTCTGTCACGGCGACATACACTCTCACGTCAGCCACGACAATGAGACTTGACATGGAAGCTGTTCCAGAGAACAAAGATACTCCCATCAACTTAGCTCAACATACATACTGGAACTTAGCAGGTCATGACTCAGGAAACATTCTAGACCATAAGATTCAGATATGGGGGTCTCATATCACGCCGGTTGACGAATACACAGTTCCTACAGGAGAGATCTTGCCTGTAAAGGGAACTCCTTTCGATTTCACTGAGGAGAAGCGGATAGGCGAGTCTATTGGAGAGGTTGGTATCGGATACGATCATAACTACGTGTTGGACTGTCCTGATCAAGAGAAGGAGGGGCTGAAACACGCAGCGAAGCTCAGTGATGCTGCTAGCTCAAGGGTACTGAACTTGTGGACCAATGTGCCGGGAATGCAGTTTTATACCGGGAACTATGTGAATGGAGTGGTTGGGAAAGGGAATGCGGTTTACGGGAAACATGCGGGTGTGTGCCTTGAGACGCAGGGATTCCCGAACGCGATTAACCAGTCGAATTTCCCGTCTGTTGTGGTTAAGGCTGGTGAGAAGTACAATCACACGATGCTGTTTGAGTTTTCAGCTTGAGTTTATAGATGGACGTTTTAGGTGTTAGATGATGGGAATAAAGGGCCGGTTCATTTGATTCACTGGGCTGGAAAAAGAGTGATTTTAATTTTATCTCTTTGGGGGAGAATAATAAAACCAAACTGTTTAC

SEQ ID NO: 2567 - DNA, 1161 bp, Arabidopsis thaliana
  misc_feature (1)..(1161): Ceres cDNA ID no. 13614142
  misc_feature (1)..(1161): Also known as  Ceres CDNA ID no. 23533084
gttcatcatctcttttgattttgattgtgcttctgcaacctttgatactctctctgaagctctgaggaagacatgatttcgtctctctcagcttcttcttcattggtttcttctttcgtcgccgttaaagcgactccggtcaccggacctctgattccccgtcgcgatcttctttctattcgtatcagagctagctcgaatcagaatagttctggttattgttttccagaaaagtttaaatcttttgccaaatcagcgattctcatcggtgctgctgtttcaatgaccggaaagttttcaactttaccggttaaagccgagtctccggttacgactatcgaaaagacctacgaggaagtgaaagaagagaaactgtctgagatcacgccattatctgagcttttggattccactcctgaggccgtcgagacgctgagatcactcctgcagcagaagctagagaagggagaagatgaagaagctcttaagctattagagagactagtagctgcacaaccagaagaaacagagtggaagttcttaatggcgaggctgttaggcgaaatgggtcgtcccgaaaacgcacgccagatgttcgaggaaattctccaaagaaacccactttcgtttgaggctttattcgagaatgcattgctcatggacaggtccggggaaggaaatgcagtgctgcagaggctagaagatgctttagctgtagctgaggctgagtatttggtgaaggaagcgagagatgtgagactgatcattgcgcagatacatttcttgcagaagaatgtggatgaagcattgaagagctacgagcagctgacgaaagaggatcctaaggatttcagaccgtatttctgtcgaggtatgatctatagcttgcttgacaagaacgttgaagctaaggaacagtttgctaagtacagagagctctctccaaagaaatttgaagtagaagggtacttgaggactccattgtctaaaatgaagctttttggtggtagtgaggagaactaagttagtacgatagctttaaatcatatcagaagaataagacactggaagataatgttgtttccctgagaaattatgctgtgattttgctttgttgaattgaactttgaaactcaaccatttttggatcttgttttgttt

SEQ ID NO: 2568 - protein, 1161 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
GTTCATCATCTCTTTTGATTTTGATTGTGCTTCTGCAACCTTTGATACTCTCTCTGAAGCTCTGAGGAAGACATGATTTCGTCTCTCTCAGCTTCTTCTTCATTGGTTTCTTCTTTCGTCGCCGTTAAAGCGACTCCGGTCACCGGACCTCTGATTCCCCGTCGCGATCTTCTTTCTATTCGTATCAGAGCTAGCTCGAATCAGAATAGTTCTGGTTATTGTTTTCCAGAAAAGTTTAAATCTTTTGCCAAATCAGCGATTCTCATCGGTGCTGCTGTTTCAATGACCGGAAAGTTTTCAACTTTACCGGTTAAAGCCGAGTCTCCGGTTACGACTATCGAAAAGACCTACGAGGAAGTGAAAGAAGAGAAACTGTCTGAGATCACGCCATTATCTGAGCTTTTGGATTCCACTCCTGAGGCCGTCGAGACGCTGAGATCACTCCTGCAGCAGAAGCTAGAGAAGGGAGAAGATGAAGAAGCTCTTAAGCTATTAGAGAGACTAGTAGCTGCACAACCAGAAGAAACAGAGTGGAAGTTCTTAATGGCGAGGCTGTTAGGCGAAATGGGTCGTCCCGAAAACGCACGCCAGATGTTCGAGGAAATTCTCCAAAGAAACCCACTTTCGTTTGAGGCTTTATTCGAGAATGCATTGCTCATGGACAGGTCCGGGGAAGGAAATGCAGTGCTGCAGAGGCTAGAAGATGCTTTAGCTGTAGCTGAGGCTGAGTATTTGGTGAAGGAAGCGAGAGATGTGAGACTGATCATTGCGCAGATACATTTCTTGCAGAAGAATGTGGATGAAGCATTGAAGAGCTACGAGCAGCTGACGAAAGAGGATCCTAAGGATTTCAGACCGTATTTCTGTCGAGGTATGATCTATAGCTTGCTTGACAAGAACGTTGAAGCTAAGGAACAGTTTGCTAAGTACAGAGAGCTCTCTCCAAAGAAATTTGAAGTAGAAGGGTACTTGAGGACTCCATTGTCTAAAATGAAGCTTTTTGGTGGTAGTGAGGAGAACTAAGTTAGTACGATAGCTTTAAATCATATCAGAAGAATAAGACACTGGAAGATAATGTTGTTTCCCTGAGAAATTATGCTGTGATTTTGCTTTGTTGAATTGAACTTTGAAACTCAACCATTTTTGGATCTTGTTTTGTTT

SEQ ID NO: 2569 - DNA, 1991 bp, Arabidopsis thaliana
  misc_feature (1)..(1991): Ceres cDNA ID no. 13614150
  misc_feature (1)..(1991): Also known as  Ceres CDNA ID no. 23533084
gttgtcgccgtcgtcgtttctctcatttctgctctgttgtgctatcgtagcgtcgcgctcctttaaacgcgacggacgcagccttctctgttcatcgtttcgccggaagttttcttcagcggagatttattttcagctggttagtagttttgagtgactactgaggtaacaatggttgtagaaactatcgagaggtcttgtgagggttcaaagagaagacatgtgaacggtggagatatcgctgttccttgttcgggagaagagtgtagcaatggagatataaatgtagctcctggagtttcagcgaaaagagctagggtttctagagaaatgacgtttgaagatatttacggtgctgatgcattactcaatgatgacgatgatgaggatgatgattgtgattgggaacctgtgcaggcgcctatggagtttgtaaaatggtgttgtgtcaattgcactatgtcgaaccctggtgatatggtccactgttgtatatgcggtgagcacaaggaatctggcattttgaggcatggatatttagcgtctcccttttttaaagacactggtctcattgaagtcgaggagaaatatggaggaagctcatctgcaaccagctcgacagctgttgggttcgacgagagaatgttgctacactcagaatttgaagtgaaggcacaaccacatccagagagacctgatcgtcttcgagctatagctgctagtcttgccacagctggtgtttttcctggaagatgcttgcctatcaatgcaagggaaatcacgaaacaagaactccagatggtccacacttcagagcatgttgatgctgttgatactacaagccagcttctctatagctacttcacctctgacacatatgctaatgagtattcagcacgtgctgctagacttgcagcaggtttgtgcgctgatctagctacagatattttcactggccgtgtaaaaaatggttttgctttggttagacctcccggtcatcatgctggcgtcaggcatgctatggggttttgccttcacaataatgcagccgttgctgcattagtagcacaagcagcaggggcaaagaaggtgctgattgtggactgggatgtccatcatggcaacggaacccaagagatattcgaacaaaacaaatctgtattgtacatatccttgcacagacatgagggaggaaacttctatcccggtactggagctgctgatgaggttggttctaatggtggggaaggttattgtgtaaatgttccatggagttgcggtggagttggggataaagactatatctttgcgtttcaacatgtggttctccccatagcttctgcattttctccagattttgtcatcatatctgcgggatttgatgcggctagaggagacccactaggatgctgtgatgtgactccggctggctattctcgaatgacacagatgttgggtgatctgtgtggtgggaaaatgctagttattctcgagggcggctacaatcttcgctccatatctgcttctgcaacagcagtgatcaaggtgcttctgggtgaaaatccggagaacgagttgcccatcgccaccacgccttcagtagccggcctgcaaactgttcttgatgtactgaatatccaactggagttctggccatcacttgctatcagctactccaaattactctcagagttggaagcacgtctgatcgaaaacaaaaaaaatcagatgaaaaggaaggttgttcgggttccgacatggtggaaatggggacgaaagaagcttttgtacaactttctctcggctcgtatgatttcaagatcaaagtgattttagaaagcattcttcctaatccgtcgtaggaattgtctacacttacttgtaaccctaactgatctgggggaatttattgcaattagggagctctgaacaatctttatcacttacatttggtagggttttatagaaagaacccttttaacctgcttacc

SEQ ID NO: 2570 - protein, 1991 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
GTTGTCGCCGTCGTCGTTTCTCTCATTTCTGCTCTGTTGTGCTATCGTAGCGTCGCGCTCCTTTAAACGCGACGGACGCAGCCTTCTCTGTTCATCGTTTCGCCGGAAGTTTTCTTCAGCGGAGATTTATTTTCAGCTGGTTAGTAGTTTTGAGTGACTACTGAGGTAACAATGGTTGTAGAAACTATCGAGAGGTCTTGTGAGGGTTCAAAGAGAAGACATGTGAACGGTGGAGATATCGCTGTTCCTTGTTCGGGAGAAGAGTGTAGCAATGGAGATATAAATGTAGCTCCTGGAGTTTCAGCGAAAAGAGCTAGGGTTTCTAGAGAAATGACGTTTGAAGATATTTACGGTGCTGATGCATTACTCAATGATGACGATGATGAGGATGATGATTGTGATTGGGAACCTGTGCAGGCGCCTATGGAGTTTGTAAAATGGTGTTGTGTCAATTGCACTATGTCGAACCCTGGTGATATGGTCCACTGTTGTATATGCGGTGAGCACAAGGAATCTGGCATTTTGAGGCATGGATATTTAGCGTCTCCCTTTTTTAAAGACACTGGTCTCATTGAAGTCGAGGAGAAATATGGAGGAAGCTCATCTGCAACCAGCTCGACAGCTGTTGGGTTCGACGAGAGAATGTTGCTACACTCAGAATTTGAAGTGAAGGCACAACCACATCCAGAGAGACCTGATCGTCTTCGAGCTATAGCTGCTAGTCTTGCCACAGCTGGTGTTTTTCCTGGAAGATGCTTGCCTATCAATGCAAGGGAAATCACGAAACAAGAACTCCAGATGGTCCACACTTCAGAGCATGTTGATGCTGTTGATACTACAAGCCAGCTTCTCTATAGCTACTTCACCTCTGACACATATGCTAATGAGTATTCAGCACGTGCTGCTAGACTTGCAGCAGGTTTGTGCGCTGATCTAGCTACAGATATTTTCACTGGCCGTGTAAAAAATGGTTTTGCTTTGGTTAGACCTCCCGGTCATCATGCTGGCGTCAGGCATGCTATGGGGTTTTGCCTTCACAATAATGCAGCCGTTGCTGCATTAGTAGCACAAGCAGCAGGGGCAAAGAAGGTGCTGATTGTGGACTGGGATGTCCATCATGGCAACGGAACCCAAGAGATATTCGAACAAAACAAATCTGTATTGTACATATCCTTGCACAGACATGAGGGAGGAAACTTCTATCCCGGTACTGGAGCTGCTGATGAGGTTGGTTCTAATGGTGGGGAAGGTTATTGTGTAAATGTTCCATGGAGTTGCGGTGGAGTTGGGGATAAAGACTATATCTTTGCGTTTCAACATGTGGTTCTCCCCATAGCTTCTGCATTTTCTCCAGATTTTGTCATCATATCTGCGGGATTTGATGCGGCTAGAGGAGACCCACTAGGATGCTGTGATGTGACTCCGGCTGGCTATTCTCGAATGACACAGATGTTGGGTGATCTGTGTGGTGGGAAAATGCTAGTTATTCTCGAGGGCGGCTACAATCTTCGCTCCATATCTGCTTCTGCAACAGCAGTGATCAAGGTGCTTCTGGGTGAAAATCCGGAGAACGAGTTGCCCATCGCCACCACGCCTTCAGTAGCCGGCCTGCAAACTGTTCTTGATGTACTGAATATCCAACTGGAGTTCTGGCCATCACTTGCTATCAGCTACTCCAAATTACTCTCAGAGTTGGAAGCACGTCTGATCGAAAACAAAAAAAATCAGATGAAAAGGAAGGTTGTTCGGGTTCCGACATGGTGGAAATGGGGACGAAAGAAGCTTTTGTACAACTTTCTCTCGGCTCGTATGATTTCAAGATCAAAGTGATTTTAGAAAGCATTCTTCCTAATCCGTCGTAGGAATTGTCTACACTTACTTGTAACCCTAACTGATCTGGGGGAATTTATTGCAATTAGGGAGCTCTGAACAATCTTTATCACTTACATTTGGTAGGGTTTTATAGAAAGAACCCTTTTAACCTGCTTACC

SEQ ID NO: 2571 - DNA, 1345 bp, Arabidopsis thaliana
  misc_feature (1)..(1345): Ceres cDNA ID no. 13614158
  misc_feature (1)..(1345): Also known as  Ceres CDNA ID no. 23533084
aaaattgggatctcttcttcttcttcttcttcttcatagtgactgattcacttctgaaacggagatggcttcgtcgacacctaaaaccctaatggatttttttcaacctgccaaacgcctcaaagcttccccttcttcctcctctttccctgccgtctccgtcgccggtggttcccgtgatttgggttctgtagcaaactcgccgcctcgtgtaaccgttaccacttccgtcgccgatgattcgtctggccttacacctgaacagatcgctcgcgcagagttcaacaagttcgtcgccaagtccaagcgtaacctcgccgtctgctccgagagggtcacaaaagcaaaatctgaaggaaactgctacgtaccattgagtgagctcttagtagaagaatcatggcttaaagctcttcctggggaatttcataaaccctacgccaaatcactttctgatttccttgaacgtgagatcatcactgacagtaaaagccctctgatttatccaccgcagcacttgattttcaatgctcttaatacaactccttttgatcgagttaagactgtcattatcggacaggatccttatcatggacctggtcaagctatgggtttgtccttctctgtacctgaaggagaaaagcttccttctagtctgttgaacatctttaaggagcttcataaagatgttggctgttccatcccacgtcacggtaatctacagaaatgggctgtgcagggtgtgttactcctgaatgctgttcttacagtaaggagtaaacagcctaattcacatgcaaagaaaggatgggaacaattcactgatgctgttattcaaagtatctcacagcagaaggaaggtgttgtttttcttctctggggaagatacgctcaagagaaatccaagttgatagatgcgactaaacatcatatactcacagcagctcatccatctggtttgtcggcgaatagaggcttcttcgactgcaggcatttctctcgcgcaaaccagctactcgaggaaatggggattcctcccatagactggcaactttaacttgttaaccgtagtcttaaggccaaggcgaagtgtgattcatctcgggaagccttgtgttttttgcagtcctttttggtgaagagagtttgaagttcttaatagttctaatgtcccttttttgtgaaatatgttatcacggaaccctagcataagctgttgaagtagttggatctgagtatggctcagtagtggcaaactgtctttatgttgtagttttgaagagtggtggtgtattatattttgtatggaaagtgcatgaaagaaaaccagaagctttaagttctg

SEQ ID NO: 2572 - protein, 1345 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
AAAATTGGGATCTCTTCTTCTTCTTCTTCTTCTTCATAGTGACTGATTCACTTCTGAAACGGAGATGGCTTCGTCGACACCTAAAACCCTAATGGATTTTTTTCAACCTGCCAAACGCCTCAAAGCTTCCCCTTCTTCCTCCTCTTTCCCTGCCGTCTCCGTCGCCGGTGGTTCCCGTGATTTGGGTTCTGTAGCAAACTCGCCGCCTCGTGTAACCGTTACCACTTCCGTCGCCGATGATTCGTCTGGCCTTACACCTGAACAGATCGCTCGCGCAGAGTTCAACAAGTTCGTCGCCAAGTCCAAGCGTAACCTCGCCGTCTGCTCCGAGAGGGTCACAAAAGCAAAATCTGAAGGAAACTGCTACGTACCATTGAGTGAGCTCTTAGTAGAAGAATCATGGCTTAAAGCTCTTCCTGGGGAATTTCATAAACCCTACGCCAAATCACTTTCTGATTTCCTTGAACGTGAGATCATCACTGACAGTAAAAGCCCTCTGATTTATCCACCGCAGCACTTGATTTTCAATGCTCTTAATACAACTCCTTTTGATCGAGTTAAGACTGTCATTATCGGACAGGATCCTTATCATGGACCTGGTCAAGCTATGGGTTTGTCCTTCTCTGTACCTGAAGGAGAAAAGCTTCCTTCTAGTCTGTTGAACATCTTTAAGGAGCTTCATAAAGATGTTGGCTGTTCCATCCCACGTCACGGTAATCTACAGAAATGGGCTGTGCAGGGTGTGTTACTCCTGAATGCTGTTCTTACAGTAAGGAGTAAACAGCCTAATTCACATGCAAAGAAAGGATGGGAACAATTCACTGATGCTGTTATTCAAAGTATCTCACAGCAGAAGGAAGGTGTTGTTTTTCTTCTCTGGGGAAGATACGCTCAAGAGAAATCCAAGTTGATAGATGCGACTAAACATCATATACTCACAGCAGCTCATCCATCTGGTTTGTCGGCGAATAGAGGCTTCTTCGACTGCAGGCATTTCTCTCGCGCAAACCAGCTACTCGAGGAAATGGGGATTCCTCCCATAGACTGGCAACTTTAACTTGTTAACCGTAGTCTTAAGGCCAAGGCGAAGTGTGATTCATCTCGGGAAGCCTTGTGTTTTTTGCAGTCCTTTTTGGTGAAGAGAGTTTGAAGTTCTTAATAGTTCTAATGTCCCTTTTTTGTGAAATATGTTATCACGGAACCCTAGCATAAGCTGTTGAAGTAGTTGGATCTGAGTATGGCTCAGTAGTGGCAAACTGTCTTTATGTTGTAGTTTTGAAGAGTGGTGGTGTATTATATTTTGTATGGAAAGTGCATGAAAGAAAACCAGAAGCTTTAAGTTCTG

SEQ ID NO: 2573 - DNA, 1849 bp, Arabidopsis thaliana
  misc_feature (1)..(1849): Ceres cDNA ID no. 13614454
  misc_feature (1)..(1849): Also known as  Ceres CDNA ID no. 23533084
ggggtcatacaataaaaattgtgtttcttttttgccctaaaccaaaaatttcatctctcttttccctcttcccgtctctatctctctgagaagcgttttttcggtggagagaaagagagatttgactctgtcaagttattagtacattgaggtcgggctgtcaaaacttgacagcccgagtttgaagcttccaggactctttttctattaatgagattggtatgctagatttggagtgtattggattagattgtggcgatcatgggttctttgtctgggatcattcaacggccacttgttgctgctgctgctgtgattacagcttctgtgtctgcagatgtctctgagaggttctcatctcttagatcactagttcgaggttctgaatcagagcagattgctccttcagtgtctggtttagttcaggaagaaaggtccttgtgggtttctcaagtctcggcctccaagcttgcagatttatcttttgtgtcgaggatttgtgttcctgtaccaaatgttgatctcctagcttctaatcctagctgtagtctcgctacttctgttacttctctgtccgctcttcgtagtgtttatcagtctgcagagttggctaaagcatcgaaaccggttgcattcacaatcggtgcctcacttgtggttcctgatatttcctacagatggcatttacctgagcctagtgcagtcgatatgtctggttcttcgagttgtgtgtctgaaaagaatagaactgttgtggttttgcttggatggcttggatcaaagcagaagcatctgaagaaatatgctgattggtacacttcaaagggttaccatgtcattacatttactcttccgatgaatgagattatgagttatcaagttggagggaaagcagagaagaacatcgagtcgctggttaatcacttggctgattggttggatgaagagcaaaagaaaaatctcgtctttcacaccttcagcaacaccgggtggttaacatatggagccattttggaaaagtttcagaagcaagattcatcattgatgggaagagttaaaggttgcatagtggactcagctcctgttgctgctgcagatcctacggtatgggcatcaggtttctcagctgcgttcttgaagaaaagcagtgtagccactaaaggatctgcgagctcatcatatgagtcaaacggtataaacatctcccagcctaaacccgctgcaacagaaacagctttgcttttggttcttgaaaagttctttgcggtgattctaaatcttcccaaagtaaacaggagacttgccgatgttcttgacacattatcaacagcacaaccaagttgtccacagttatacatttacagctctgcagacagagttataccggtggaacaagttgaatcattcattgtagagcagaggaaagcaggacatgaggtccgtgcttgcaacttcatatcttcacctcatgtagaccatttccggagtaacccagaactgtatacagctgagctcaaccatttcatgaacaactttgtcctttcttgctgccaccattcttcatagcgacttccacaagtgttgttgttgctaaccatttttggggtccttttaactcttatacaagaaagagaaaaatagttactgattgatgattctttttggtttggattggtttatagattcaaattcattattcctttgtaaattgttggatattgtacatttaggagaatgaagattcaagaaagtgacgtccttgtcctttgtagtggagatttggatcttatggttgtcttttgttatttgttcaaagagggttgttaagaacccaatcataaagtttttg

SEQ ID NO: 2574 - protein, 1849 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
GGGGTCATACAATAAAAATTGTGTTTCTTTTTTGCCCTAAACCAAAAATTTCATCTCTCTTTTCCCTCTTCCCGTCTCTATCTCTCTGAGAAGCGTTTTTTCGGTGGAGAGAAAGAGAGATTTGACTCTGTCAAGTTATTAGTACATTGAGGTCGGGCTGTCAAAACTTGACAGCCCGAGTTTGAAGCTTCCAGGACTCTTTTTCTATTAATGAGATTGGTATGCTAGATTTGGAGTGTATTGGATTAGATTGTGGCGATCATGGGTTCTTTGTCTGGGATCATTCAACGGCCACTTGTTGCTGCTGCTGCTGTGATTACAGCTTCTGTGTCTGCAGATGTCTCTGAGAGGTTCTCATCTCTTAGATCACTAGTTCGAGGTTCTGAATCAGAGCAGATTGCTCCTTCAGTGTCTGGTTTAGTTCAGGAAGAAAGGTCCTTGTGGGTTTCTCAAGTCTCGGCCTCCAAGCTTGCAGATTTATCTTTTGTGTCGAGGATTTGTGTTCCTGTACCAAATGTTGATCTCCTAGCTTCTAATCCTAGCTGTAGTCTCGCTACTTCTGTTACTTCTCTGTCCGCTCTTCGTAGTGTTTATCAGTCTGCAGAGTTGGCTAAAGCATCGAAACCGGTTGCATTCACAATCGGTGCCTCACTTGTGGTTCCTGATATTTCCTACAGATGGCATTTACCTGAGCCTAGTGCAGTCGATATGTCTGGTTCTTCGAGTTGTGTGTCTGAAAAGAATAGAACTGTTGTGGTTTTGCTTGGATGGCTTGGATCAAAGCAGAAGCATCTGAAGAAATATGCTGATTGGTACACTTCAAAGGGTTACCATGTCATTACATTTACTCTTCCGATGAATGAGATTATGAGTTATCAAGTTGGAGGGAAAGCAGAGAAGAACATCGAGTCGCTGGTTAATCACTTGGCTGATTGGTTGGATGAAGAGCAAAAGAAAAATCTCGTCTTTCACACCTTCAGCAACACCGGGTGGTTAACATATGGAGCCATTTTGGAAAAGTTTCAGAAGCAAGATTCATCATTGATGGGAAGAGTTAAAGGTTGCATAGTGGACTCAGCTCCTGTTGCTGCTGCAGATCCTACGGTATGGGCATCAGGTTTCTCAGCTGCGTTCTTGAAGAAAAGCAGTGTAGCCACTAAAGGATCTGCGAGCTCATCATATGAGTCAAACGGTATAAACATCTCCCAGCCTAAACCCGCTGCAACAGAAACAGCTTTGCTTTTGGTTCTTGAAAAGTTCTTTGCGGTGATTCTAAATCTTCCCAAAGTAAACAGGAGACTTGCCGATGTTCTTGACACATTATCAACAGCACAACCAAGTTGTCCACAGTTATACATTTACAGCTCTGCAGACAGAGTTATACCGGTGGAACAAGTTGAATCATTCATTGTAGAGCAGAGGAAAGCAGGACATGAGGTCCGTGCTTGCAACTTCATATCTTCACCTCATGTAGACCATTTCCGGAGTAACCCAGAACTGTATACAGCTGAGCTCAACCATTTCATGAACAACTTTGTCCTTTCTTGCTGCCACCATTCTTCATAGCGACTTCCACAAGTGTTGTTGTTGCTAACCATTTTTGGGGTCCTTTTAACTCTTATACAAGAAAGAGAAAAATAGTTACTGATTGATGATTCTTTTTGGTTTGGATTGGTTTATAGATTCAAATTCATTATTCCTTTGTAAATTGTTGGATATTGTACATTTAGGAGAATGAAGATTCAAGAAAGTGACGTCCTTGTCCTTTGTAGTGGAGATTTGGATCTTATGGTTGTCTTTTGTTATTTGTTCAAAGAGGGTTGTTAAGAACCCAATCATAAAGTTTTTG

SEQ ID NO: 2575 - DNA, 1703 bp, Arabidopsis thaliana
  misc_feature (1)..(1703): Ceres cDNA ID no. 13614486
  misc_feature (1)..(1703): Also known as  Ceres CDNA ID no. 23533084
aagattcgttttctcttttatcactcccctcggcgatctctcttcttgctccggcagggtttttctgctgctccttgcttgtccggactctagcttgcctgtaactgttaagagattacaatgggggactccgataatgctataccattttccagaaagagaactgctctgaaagagctgtctcgtgacaatcctggtcttgatgatgatgatgaagacacttctgcactcgagagtggtaccttcaacactgctagtaaggaggtgttggcaagcagaagaattatcagagttaggcgcacagatcgatctgctactgcaccaccagcttctaatccatttactggaattcgtttggttccttttactgctcctgctccttctactgctgctgcagaaacgactaaacctctgtctgcgggaaaacaagagacactggctgatggaaggtctgatgctaccaaggaaactgatggtgacagtaaagaaaagagtgacgcaattgatgctgtaggaaaacaagagacacagggtgatgaaatatctgctaagaccaaggatattattgatggtggagagaaagagatgagtgaggcagttaattccgtagagggtggtggagctgtaaacaagaatgaagacgagattaagacaacgatggttactgaagttgctgctggggaagagactgtaaaagatgacaacaacaatagcaacactgttgagggaagtgactgtgttgtcaaggatacaggtggtaatcagactgagaaagaaggaaaagagggcgatggaaatgaagacacagagaaaaatggagatagtggagccttgagctccttccaccagcactcaagtagcaaaaacgcattcacaggacttgctagcacagggttctctgcttcttcgttctcgttcggtttggttccacaagaaggttcgactgggtctggttctgaacagtcatccttcagttttggccaagcaaacaatggaaactcttccctgtttggtgcatccgttgctacttccattaccacgaagagcacggaaactactactgccttcccatcaaagcaagatgtttcagtggaaacaggagaagagaacgaaaaagcagccttcacagctgactcagtaatgttcgaatatcttgagggaggatggaaagagcgtgggaaaggagaactcaaggtgaatatatcaacgactgaaaacagaaaagccaggttagtaatgagatcaaaaggaaactacaggttgaccttaaacgcaagtctttacccggaaatgaaactggctaaaatggacaagaaaggaatcacatttgcttgtgtgaatagtgtaagtgacgccaaggatggtctctctacattggcactgaagttcaaggacccaacagtggtggaagagttccgagcagttatcgaagaacataaagacagtaaaccttccgttgcagaagcagcagctcctttgaagacacctgagaactcaccgagtgctgaagatgcttgaaggttaaaaactttgaaacaactcgtcgtctagtatccttgtgttctatttgtctatgttgtttgaagttcaaatttggcagagagaatagagagactatatagatcacttgaactccttatgggtctcttatgaatgaatattcgaagttactgtttttaacataatctatcatataactcagc

SEQ ID NO: 2576 - protein, 1703 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
AAGATTCGTTTTCTCTTTTATCACTCCCCTCGGCGATCTCTCTTCTTGCTCCGGCAGGGTTTTTCTGCTGCTCCTTGCTTGTCCGGACTCTAGCTTGCCTGTAACTGTTAAGAGATTACAATGGGGGACTCCGATAATGCTATACCATTTTCCAGAAAGAGAACTGCTCTGAAAGAGCTGTCTCGTGACAATCCTGGTCTTGATGATGATGATGAAGACACTTCTGCACTCGAGAGTGGTACCTTCAACACTGCTAGTAAGGAGGTGTTGGCAAGCAGAAGAATTATCAGAGTTAGGCGCACAGATCGATCTGCTACTGCACCACCAGCTTCTAATCCATTTACTGGAATTCGTTTGGTTCCTTTTACTGCTCCTGCTCCTTCTACTGCTGCTGCAGAAACGACTAAACCTCTGTCTGCGGGAAAACAAGAGACACTGGCTGATGGAAGGTCTGATGCTACCAAGGAAACTGATGGTGACAGTAAAGAAAAGAGTGACGCAATTGATGCTGTAGGAAAACAAGAGACACAGGGTGATGAAATATCTGCTAAGACCAAGGATATTATTGATGGTGGAGAGAAAGAGATGAGTGAGGCAGTTAATTCCGTAGAGGGTGGTGGAGCTGTAAACAAGAATGAAGACGAGATTAAGACAACGATGGTTACTGAAGTTGCTGCTGGGGAAGAGACTGTAAAAGATGACAACAACAATAGCAACACTGTTGAGGGAAGTGACTGTGTTGTCAAGGATACAGGTGGTAATCAGACTGAGAAAGAAGGAAAAGAGGGCGATGGAAATGAAGACACAGAGAAAAATGGAGATAGTGGAGCCTTGAGCTCCTTCCACCAGCACTCAAGTAGCAAAAACGCATTCACAGGACTTGCTAGCACAGGGTTCTCTGCTTCTTCGTTCTCGTTCGGTTTGGTTCCACAAGAAGGTTCGACTGGGTCTGGTTCTGAACAGTCATCCTTCAGTTTTGGCCAAGCAAACAATGGAAACTCTTCCCTGTTTGGTGCATCCGTTGCTACTTCCATTACCACGAAGAGCACGGAAACTACTACTGCCTTCCCATCAAAGCAAGATGTTTCAGTGGAAACAGGAGAAGAGAACGAAAAAGCAGCCTTCACAGCTGACTCAGTAATGTTCGAATATCTTGAGGGAGGATGGAAAGAGCGTGGGAAAGGAGAACTCAAGGTGAATATATCAACGACTGAAAACAGAAAAGCCAGGTTAGTAATGAGATCAAAAGGAAACTACAGGTTGACCTTAAACGCAAGTCTTTACCCGGAAATGAAACTGGCTAAAATGGACAAGAAAGGAATCACATTTGCTTGTGTGAATAGTGTAAGTGACGCCAAGGATGGTCTCTCTACATTGGCACTGAAGTTCAAGGACCCAACAGTGGTGGAAGAGTTCCGAGCAGTTATCGAAGAACATAAAGACAGTAAACCTTCCGTTGCAGAAGCAGCAGCTCCTTTGAAGACACCTGAGAACTCACCGAGTGCTGAAGATGCTTGAAGGTTAAAAACTTTGAAACAACTCGTCGTCTAGTATCCTTGTGTTCTATTTGTCTATGTTGTTTGAAGTTCAAATTTGGCAGAGAGAATAGAGAGACTATATAGATCACTTGAACTCCTTATGGGTCTCTTATGAATGAATATTCGAAGTTACTGTTTTTAACATAATCTATCATATAACTCAGC

SEQ ID NO: 2577 - DNA, 1450 bp, Arabidopsis thaliana
  misc_feature (1)..(1450): Ceres cDNA ID no. 13614624
  misc_feature (1)..(1450): Also known as  Ceres CDNA ID no. 23533084
aaccactcatctcaatttctcccacggtctagattctctccgcttctatgtctttcccgagaaaattcgggacagcgattcacgccgctctatcttttatcgtcttctttttcttggacctcctcgacgcgattctctgtgtcgtttacgagttcgtcgatgagattttggaagaaaactcaacaggttgttactgcacggcggcggctcctcaaagtcaaaccaccgacgaaaatgagttgtcgtcggagactttattcgggaggagaaacattttccggggaatgtggtttctgggattcgcgagagaattcaaatccaagctttcccggaaactgagaaaatctaagattcatcaagagtcagtgaatcgatggtcagattgtggatgcaaatcttgcaagtcatggactaagaacgaagatgggaatcttcacgtcgtggtcaaagattctacttctcgagaaacagagtactctgttcaagaaccgtccgagaatgtaatattcatacacggttttatggggtcatcacatttttggacagaaactgtatttgaacacattcaaaaagatgattataggctcctcgcgatcgatcttttgggattcggggagagtcctaagccaagggatagtctctatacattgaaagatcatgtggatacgatagagagatctgtcattaagccataccaattagattcttttcatgtggttgcacattcaatgggttgcttaattgctcttgctttggctgctaaacattccaacattgttaaatccgttactcttgttgcaccgccttattttccttcatcggtagaaggatcggtcttgaaccgaatcgctagaaagcggttgtggccaccgcttgcgtttgggacagcggtgatgtcttggtatgaacatattggtagatgcgtatgtttcataatctgcaagcatcataagatatgggagtggctaatcaagctatgtataggtaaaagggagattcattggaagatcaaggacataacaaggcacacacatcactctgcatggcatagtatgcacaatgtgatatgtggtggctccaaagtcgctgatgaacatcttgaaaccctaataaagtctggcgttaagattcacttgatgcaaggcgactgtgaccaaatcgttccttcacattgctctggcaacatgaagaggacttttccggcggtggaagttgatatcattactggtgctgatcatgatagtatgataagcggaagaggagaagagtttgctgagaaattggagagcatttggtgttcatgttaaagagtctggttagttttttcaaactttataggtaggagccactgtagtcgatgtcgactgactacatgtttgagtccgattgtaagatcaagtctattgttaatgagccatctaatggacgcctatatggagtccacttatcg

SEQ ID NO: 2578 - protein, 1450 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
AACCACTCATCTCAATTTCTCCCACGGTCTAGATTCTCTCCGCTTCTATGTCTTTCCCGAGAAAATTCGGGACAGCGATTCACGCCGCTCTATCTTTTATCGTCTTCTTTTTCTTGGACCTCCTCGACGCGATTCTCTGTGTCGTTTACGAGTTCGTCGATGAGATTTTGGAAGAAAACTCAACAGGTTGTTACTGCACGGCGGCGGCTCCTCAAAGTCAAACCACCGACGAAAATGAGTTGTCGTCGGAGACTTTATTCGGGAGGAGAAACATTTTCCGGGGAATGTGGTTTCTGGGATTCGCGAGAGAATTCAAATCCAAGCTTTCCCGGAAACTGAGAAAATCTAAGATTCATCAAGAGTCAGTGAATCGATGGTCAGATTGTGGATGCAAATCTTGCAAGTCATGGACTAAGAACGAAGATGGGAATCTTCACGTCGTGGTCAAAGATTCTACTTCTCGAGAAACAGAGTACTCTGTTCAAGAACCGTCCGAGAATGTAATATTCATACACGGTTTTATGGGGTCATCACATTTTTGGACAGAAACTGTATTTGAACACATTCAAAAAGATGATTATAGGCTCCTCGCGATCGATCTTTTGGGATTCGGGGAGAGTCCTAAGCCAAGGGATAGTCTCTATACATTGAAAGATCATGTGGATACGATAGAGAGATCTGTCATTAAGCCATACCAATTAGATTCTTTTCATGTGGTTGCACATTCAATGGGTTGCTTAATTGCTCTTGCTTTGGCTGCTAAACATTCCAACATTGTTAAATCCGTTACTCTTGTTGCACCGCCTTATTTTCCTTCATCGGTAGAAGGATCGGTCTTGAACCGAATCGCTAGAAAGCGGTTGTGGCCACCGCTTGCGTTTGGGACAGCGGTGATGTCTTGGTATGAACATATTGGTAGATGCGTATGTTTCATAATCTGCAAGCATCATAAGATATGGGAGTGGCTAATCAAGCTATGTATAGGTAAAAGGGAGATTCATTGGAAGATCAAGGACATAACAAGGCACACACATCACTCTGCATGGCATAGTATGCACAATGTGATATGTGGTGGCTCCAAAGTCGCTGATGAACATCTTGAAACCCTAATAAAGTCTGGCGTTAAGATTCACTTGATGCAAGGCGACTGTGACCAAATCGTTCCTTCACATTGCTCTGGCAACATGAAGAGGACTTTTCCGGCGGTGGAAGTTGATATCATTACTGGTGCTGATCATGATAGTATGATAAGCGGAAGAGGAGAAGAGTTTGCTGAGAAATTGGAGAGCATTTGGTGTTCATGTTAAAGAGTCTGGTTAGTTTTTTCAAACTTTATAGGTAGGAGCCACTGTAGTCGATGTCGACTGACTACATGTTTGAGTCCGATTGTAAGATCAAGTCTATTGTTAATGAGCCATCTAATGGACGCCTATATGGAGTCCACTTATCG

SEQ ID NO: 2579 - DNA, 839 bp, Arabidopsis thaliana
  misc_feature (1)..(839): Ceres cDNA ID no. 13614802
  misc_feature (1)..(839): Also known as  Ceres CDNA ID no. 23533084
catcgctgtctggaacagcgatgactcgtgaaccttggacaagacaatcagtggagcctaggacggggatcgagttcccgatgttgttgaaggagaatgcttcgcgatcgaattctgaggtgcttgttgcaacgggatctcggacaatgaaaattatcagaattaaatctctaaaagtatatgcatttggtttttatgttcacccttcctcggtctgtcagaagcttggccgaaagtatgcctcggttccagcaagcaaacttgacaaatgcgatgacttatacaaagaccttcttagggaggatattgttatgagtgtgaggcttgtggttaactacaatggcttgaagatcaatactgtgagagatgttttcgagaaatctctgcgtgctcgcttggttaaggcaaatccaaaaactgatttcaattgtttgaatgattttggttcattctttagacaagacattccaatacccgcgggaacaataatagactttcggcgaacagaagatggacagctaatcacagagattggtggtaacctgattggagctgtccgaagcaaggatctttgcagagcattttttggtatgtacattggagatgttccggtgtcagagcagacaaaggaggagattggtagaaaagtggtgggaatcataaagagatgctgaaatcaattacttgttagatttccaattgcctctgagttttagaagaaggcaattgggttagatttacgcggtcatgtctagatattgtcaatcaaaatactttgtaagcagcttggaggaagttatgtcttaagttgtattagatagtcttgatttttatgttct

SEQ ID NO: 2580 - protein, 839 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
CATCGCTGTCTGGAACAGCGATGACTCGTGAACCTTGGACAAGACAATCAGTGGAGCCTAGGACGGGGATCGAGTTCCCGATGTTGTTGAAGGAGAATGCTTCGCGATCGAATTCTGAGGTGCTTGTTGCAACGGGATCTCGGACAATGAAAATTATCAGAATTAAATCTCTAAAAGTATATGCATTTGGTTTTTATGTTCACCCTTCCTCGGTCTGTCAGAAGCTTGGCCGAAAGTATGCCTCGGTTCCAGCAAGCAAACTTGACAAATGCGATGACTTATACAAAGACCTTCTTAGGGAGGATATTGTTATGAGTGTGAGGCTTGTGGTTAACTACAATGGCTTGAAGATCAATACTGTGAGAGATGTTTTCGAGAAATCTCTGCGTGCTCGCTTGGTTAAGGCAAATCCAAAAACTGATTTCAATTGTTTGAATGATTTTGGTTCATTCTTTAGACAAGACATTCCAATACCCGCGGGAACAATAATAGACTTTCGGCGAACAGAAGATGGACAGCTAATCACAGAGATTGGTGGTAACCTGATTGGAGCTGTCCGAAGCAAGGATCTTTGCAGAGCATTTTTTGGTATGTACATTGGAGATGTTCCGGTGTCAGAGCAGACAAAGGAGGAGATTGGTAGAAAAGTGGTGGGAATCATAAAGAGATGCTGAAATCAATTACTTGTTAGATTTCCAATTGCCTCTGAGTTTTAGAAGAAGGCAATTGGGTTAGATTTACGCGGTCATGTCTAGATATTGTCAATCAAAATACTTTGTAAGCAGCTTGGAGGAAGTTATGTCTTAAGTTGTATTAGATAGTCTTGATTTTTATGTTCT

SEQ ID NO: 2581 - DNA, 1125 bp, Arabidopsis thaliana
  misc_feature (1)..(1125): Ceres cDNA ID no. 13614826
  misc_feature (1)..(1125): Also known as  Ceres CDNA ID no. 23533084
gctaaaaccctctctccccttcttcttacttcacttcactcgtgctttctccaatggagtcactcctgcacgcgtcttcgtctctggtgtctctgagacccagaatcgacggtagagattcgttcatcaacccgtcacgcgtgtgccttaatcctagtctcggccgcagaggatctaaacctcttccgttggtcgcggcggcgaagaagaagaaaagcaagaaagatgacaatcataacttttcagctagacctgacgaagccactggtccttttcctgaatccattcttctcaaagagaagaagattgatgaagaaggtgatcttcttcccgagtttgctgatgctgaagaaaaggagctatatcagtttctggatcttcagcttcagagtgacttgaatgaagaaaggatgaggcactatgaggtggtttacttgattcatgaaaaacatgctgaggaggttgaaagcattaaccagaaagtacaagattacctgaaggagaagaaggggaaagtttggaggtttagtgattggggaatgcgtagactggcttacaaaatacagaaggcagagaatgcgcactatatactgatgaactttgagatagaggcaaaatacttgaacgaattcaagggattgttagatagtgatgagagggtgattaggcatcttgtgatgaaacgtgatgaggccataaccgaagactgtcctccacctcctgagtttcactctgtccgcgcaggtgatgaatattatgacgatgatgaagaggaagagattgaagaagatgaagatgaaggtgagggtgaagatgaagaagatgctgataatatagagtacgaagtagatgatgatggtaatgtcgttatggtgttgtacggagatgaagaagaaggagaagaagaagaagatggagctagtgaacaagaagaaggacaggacaagtcaactaatggtagaagagaaacccggagaacagttaacgtaggaggttaggactgtctgtaattcttttgtttttgggtcatgttttggataatagggtcacacatcaaatcgaagttgtttgttgtactcataatagcatcctaagaagtatatgagaaactaaactattcccttg

SEQ ID NO: 2582 - protein, 1125 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
GCTAAAACCCTCTCTCCCCTTCTTCTTACTTCACTTCACTCGTGCTTTCTCCAATGGAGTCACTCCTGCACGCGTCTTCGTCTCTGGTGTCTCTGAGACCCAGAATCGACGGTAGAGATTCGTTCATCAACCCGTCACGCGTGTGCCTTAATCCTAGTCTCGGCCGCAGAGGATCTAAACCTCTTCCGTTGGTCGCGGCGGCGAAGAAGAAGAAAAGCAAGAAAGATGACAATCATAACTTTTCAGCTAGACCTGACGAAGCCACTGGTCCTTTTCCTGAATCCATTCTTCTCAAAGAGAAGAAGATTGATGAAGAAGGTGATCTTCTTCCCGAGTTTGCTGATGCTGAAGAAAAGGAGCTATATCAGTTTCTGGATCTTCAGCTTCAGAGTGACTTGAATGAAGAAAGGATGAGGCACTATGAGGTGGTTTACTTGATTCATGAAAAACATGCTGAGGAGGTTGAAAGCATTAACCAGAAAGTACAAGATTACCTGAAGGAGAAGAAGGGGAAAGTTTGGAGGTTTAGTGATTGGGGAATGCGTAGACTGGCTTACAAAATACAGAAGGCAGAGAATGCGCACTATATACTGATGAACTTTGAGATAGAGGCAAAATACTTGAACGAATTCAAGGGATTGTTAGATAGTGATGAGAGGGTGATTAGGCATCTTGTGATGAAACGTGATGAGGCCATAACCGAAGACTGTCCTCCACCTCCTGAGTTTCACTCTGTCCGCGCAGGTGATGAATATTATGACGATGATGAAGAGGAAGAGATTGAAGAAGATGAAGATGAAGGTGAGGGTGAAGATGAAGAAGATGCTGATAATATAGAGTACGAAGTAGATGATGATGGTAATGTCGTTATGGTGTTGTACGGAGATGAAGAAGAAGGAGAAGAAGAAGAAGATGGAGCTAGTGAACAAGAAGAAGGACAGGACAAGTCAACTAATGGTAGAAGAGAAACCCGGAGAACAGTTAACGTAGGAGGTTAGGACTGTCTGTAATTCTTTTGTTTTTGGGTCATGTTTTGGATAATAGGGTCACACATCAAATCGAAGTTGTTTGTTGTACTCATAATAGCATCCTAAGAAGTATATGAGAAACTAAACTATTCCCTTG

SEQ ID NO: 2583 - DNA, 1600 bp, Arabidopsis thaliana
  misc_feature (1)..(1600): Ceres cDNA ID no. 13615008
  misc_feature (1)..(1600): Also known as  Ceres CDNA ID no. 23533084
atggcgagaagttctgttttgctatgtttaattctattggttacgttaggagttgtgataagtgtcacatttgccgacaacgttgaattgaaatcaaaagatctagagagcagtaagaaagataagaaggttgatcatgatagtacacacaaagagaagggaggtgaaaaggtagatggtgccggttctgatgatgaagacaacgataaaaaagaaaaaaagaaagagcatgatgtgcaaaaaaaggataaacaacatgaaaacaaagacaaggatgacgagaagaagcatgttgataagaagaagagcggtggtcatgataaagatgatgatgatgaaaagaagcacaaggataaaaagaaggatggacacaatgatgatgatgatagtgatgatgatacggatgatgacgatgacgatgatgatgatgatgatgatgatgatgaagttgatggagatgataatgagaaggagaaaattgggttatacgagctcaagaagggaaatctaactgtcaaattcacaaattggggtgcttcaatcatatctctccatttcccagacaaaaatggtaaaatggacgatattgttcttggctatgatagcgtcaaaacctacaagaccgacaaggtttatttcggagcaaccgttggccgagtagcaaatagaataggaaagggcaaattcaagttgaatggtaaagagtacaagacaagtgtcaacgatggaaaaaacacactccatggtggcaagaaagggtttggggatgttgtgtgggcagttgcaaaacaccagtacgatggcaagaaaccacacattgtcttcactcacacaagtcctgacggcgatcaagggtttccgggagaactcagtgtcacggtgacatataaacttgtcaaagacaatgaattgagtgtggtgatggaggcaaagcctaaggataaagcaactccggtgaacttagctcatcatagttattggaatcttggtggtcataattccggagatattttgtctgaagaaattcaaatcctcggctcgggttatacccccgtcgacggtgagctcattcccaccgggaaaatcaatccggtgaaaggaacagcatacgattttctccaactccgtcctattaaagataatatgaaggatcttaaaacaggatatgatataaattattgcttagatggtaaggcaaaaaagatgagaaaaatagttgaactcgtagataagaaatcagggaggaaaatggagttatccggaaaccaagcgggtttgcaattctataccggagggatgttaaaggatgtcaaagggaagaatggggcagtttaccaagctttcgggggattatgtttagaaacacaaagttatccagacgcattgaaccatcccaaatttccttcacagattgtcgagccagggaaaaaatacaaacacactatgctcttcaagttttctattgtttcatagattgttttagatgttgttacatgaacacccttggaaccatgtccaatgttcatgaacaagaaactaaatacattgtaatattttgtaacaatgcttaaattatcaaattatatgaacctaacgtgaa

SEQ ID NO: 2584 - protein, 1600 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ATGGCGAGAAGTTCTGTTTTGCTATGTTTAATTCTATTGGTTACGTTAGGAGTTGTGATAAGTGTCACATTTGCCGACAACGTTGAATTGAAATCAAAAGATCTAGAGAGCAGTAAGAAAGATAAGAAGGTTGATCATGATAGTACACACAAAGAGAAGGGAGGTGAAAAGGTAGATGGTGCCGGTTCTGATGATGAAGACAACGATAAAAAAGAAAAAAAGAAAGAGCATGATGTGCAAAAAAAGGATAAACAACATGAAAACAAAGACAAGGATGACGAGAAGAAGCATGTTGATAAGAAGAAGAGCGGTGGTCATGATAAAGATGATGATGATGAAAAGAAGCACAAGGATAAAAAGAAGGATGGACACAATGATGATGATGATAGTGATGATGATACGGATGATGACGATGACGATGATGATGATGATGATGATGATGATGAAGTTGATGGAGATGATAATGAGAAGGAGAAAATTGGGTTATACGAGCTCAAGAAGGGAAATCTAACTGTCAAATTCACAAATTGGGGTGCTTCAATCATATCTCTCCATTTCCCAGACAAAAATGGTAAAATGGACGATATTGTTCTTGGCTATGATAGCGTCAAAACCTACAAGACCGACAAGGTTTATTTCGGAGCAACCGTTGGCCGAGTAGCAAATAGAATAGGAAAGGGCAAATTCAAGTTGAATGGTAAAGAGTACAAGACAAGTGTCAACGATGGAAAAAACACACTCCATGGTGGCAAGAAAGGGTTTGGGGATGTTGTGTGGGCAGTTGCAAAACACCAGTACGATGGCAAGAAACCACACATTGTCTTCACTCACACAAGTCCTGACGGCGATCAAGGGTTTCCGGGAGAACTCAGTGTCACGGTGACATATAAACTTGTCAAAGACAATGAATTGAGTGTGGTGATGGAGGCAAAGCCTAAGGATAAAGCAACTCCGGTGAACTTAGCTCATCATAGTTATTGGAATCTTGGTGGTCATAATTCCGGAGATATTTTGTCTGAAGAAATTCAAATCCTCGGCTCGGGTTATACCCCCGTCGACGGTGAGCTCATTCCCACCGGGAAAATCAATCCGGTGAAAGGAACAGCATACGATTTTCTCCAACTCCGTCCTATTAAAGATAATATGAAGGATCTTAAAACAGGATATGATATAAATTATTGCTTAGATGGTAAGGCAAAAAAGATGAGAAAAATAGTTGAACTCGTAGATAAGAAATCAGGGAGGAAAATGGAGTTATCCGGAAACCAAGCGGGTTTGCAATTCTATACCGGAGGGATGTTAAAGGATGTCAAAGGGAAGAATGGGGCAGTTTACCAAGCTTTCGGGGGATTATGTTTAGAAACACAAAGTTATCCAGACGCATTGAACCATCCCAAATTTCCTTCACAGATTGTCGAGCCAGGGAAAAAATACAAACACACTATGCTCTTCAAGTTTTCTATTGTTTCATAGATTGTTTTAGATGTTGTTACATGAACACCCTTGGAACCATGTCCAATGTTCATGAACAAGAAACTAAATACATTGTAATATTTTGTAACAATGCTTAAATTATCAAATTATATGAACCTAACGTGAA

SEQ ID NO: 2585 - DNA, 1304 bp, Arabidopsis thaliana
  misc_feature (1)..(1304): Ceres cDNA ID no. 13615328
  misc_feature (1)..(1304): Also known as  Ceres CDNA ID no. 23533084
actcaatccaaactcaacccacaacgctacacattaaaaaataaaaaacctatggcaaccatttccttctctcacaaccaccaatcctccgacaaccgccgtggtggatcccatcaccaccgtcacggccccgtcgtggaagagatcgaaggactcatcaaagttttcaacgacggctgcgtcgaaagacctcccatagttcccatcgtctcaccaaccattcacccatcttctaaagccacagcctttgacatcaaactatccaacgacacatggacacgtgtctacatccccgatgccgcagcagcctcgccgtccgttactctccctctcctcgtttacttccacggcggtggtttctgcgttggctccgccgcttggagttgctaccatgacttcttgaccagccttgccgttaaagcccgttgcgtcatcgtttccgtaaactaccgtttagcccctgaacaccgtctcccggcggcgtacgacgacggcgttaatgtcgtctcgtggctagtcaagcaacaaatatctaccggtggtggatatccttcttggttgagtaaatgtaacctctcaaacgttttcttggccggagatagcgccggagccaacatagcttaccaagtcgccgtaagaatcatggccagtggcaaatacgcaaacactctacacctcaagggcattattctcatccaccctttcttcggcggcgaatcaagaacgtcttcggagaaacaacaacatcacaccaagtcatcggcgcttactctttcagcttccgacgcatattggcgtctagctctgccacgtggagcgagtagagaccatccatggtgtaaccctctgatgagctcggcgggagcgaagttaccgacgacgatggtgttcatggcggagtttgatatactaaaagaacgaaacttggagatgtgtaaagtgatgagaagccatgggaagagagttgaaggtatagttcatggaggtgttggtcacgcttttcatattctcgacaactcgtcggtgtcacgtgatcgaatccacgacatgatgtgtcgtcttcacaacttcatacatccatcataataattccctaaagacctttttctgaaacctttaattgatttaaaatgttgttcttgaaaaataataagagataaaaacttgaaatgttgtgtttttattgtggattaaagtaagctttgctttgtagtgttttttcagtgaaggtgaatagtataaattatgtaatacaatagatggacttgtacttttaagttaagttatgtatccaatgcttgaat

SEQ ID NO: 2586 - protein, 1304 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ACTCAATCCAAACTCAACCCACAACGCTACACATTAAAAAATAAAAAACCTATGGCAACCATTTCCTTCTCTCACAACCACCAATCCTCCGACAACCGCCGTGGTGGATCCCATCACCACCGTCACGGCCCCGTCGTGGAAGAGATCGAAGGACTCATCAAAGTTTTCAACGACGGCTGCGTCGAAAGACCTCCCATAGTTCCCATCGTCTCACCAACCATTCACCCATCTTCTAAAGCCACAGCCTTTGACATCAAACTATCCAACGACACATGGACACGTGTCTACATCCCCGATGCCGCAGCAGCCTCGCCGTCCGTTACTCTCCCTCTCCTCGTTTACTTCCACGGCGGTGGTTTCTGCGTTGGCTCCGCCGCTTGGAGTTGCTACCATGACTTCTTGACCAGCCTTGCCGTTAAAGCCCGTTGCGTCATCGTTTCCGTAAACTACCGTTTAGCCCCTGAACACCGTCTCCCGGCGGCGTACGACGACGGCGTTAATGTCGTCTCGTGGCTAGTCAAGCAACAAATATCTACCGGTGGTGGATATCCTTCTTGGTTGAGTAAATGTAACCTCTCAAACGTTTTCTTGGCCGGAGATAGCGCCGGAGCCAACATAGCTTACCAAGTCGCCGTAAGAATCATGGCCAGTGGCAAATACGCAAACACTCTACACCTCAAGGGCATTATTCTCATCCACCCTTTCTTCGGCGGCGAATCAAGAACGTCTTCGGAGAAACAACAACATCACACCAAGTCATCGGCGCTTACTCTTTCAGCTTCCGACGCATATTGGCGTCTAGCTCTGCCACGTGGAGCGAGTAGAGACCATCCATGGTGTAACCCTCTGATGAGCTCGGCGGGAGCGAAGTTACCGACGACGATGGTGTTCATGGCGGAGTTTGATATACTAAAAGAACGAAACTTGGAGATGTGTAAAGTGATGAGAAGCCATGGGAAGAGAGTTGAAGGTATAGTTCATGGAGGTGTTGGTCACGCTTTTCATATTCTCGACAACTCGTCGGTGTCACGTGATCGAATCCACGACATGATGTGTCGTCTTCACAACTTCATACATCCATCATAATAATTCCCTAAAGACCTTTTTCTGAAACCTTTAATTGATTTAAAATGTTGTTCTTGAAAAATAATAAGAGATAAAAACTTGAAATGTTGTGTTTTTATTGTGGATTAAAGTAAGCTTTGCTTTGTAGTGTTTTTTCAGTGAAGGTGAATAGTATAAATTATGTAATACAATAGATGGACTTGTACTTTTAAGTTAAGTTATGTATCCAATGCTTGAAT

SEQ ID NO: 2587 - DNA, 1884 bp, Arabidopsis thaliana
  misc_feature (1)..(1884): Ceres cDNA ID no. 13615437
  misc_feature (1)..(1884): Also known as  Ceres CDNA ID no. 23533084
atgaaatcatacaaacttaataaccctaatttactcatctccacgcacacacataataaactcttcttatcctcttctccattcaatctcttattctcttttccttccttcatataccttaaacagcaacgttctctgttcttcttcttctttttcttcctctgtttttctttcacaacttccatgttggactcggacacagacacggactcaggtcctgtggttgcaacaaccaaactcgtcactttcctccagcgtgtgcagcacacggcacttcgatcataccctaaaaaacaaacgcctgatcccaaatcctacattgatctatctctcaaacgtccctacagtctctccaccatcgaatcagccttcgatgatctcacgagcgagtcacatgaccagccagtgccagtggagacgcttgaaaagttcgtcaaggaatattttgacggtgcaggggaggatctgctgcaccacgaaccagtagatttcgtctcagatccctccggcttcctctccaacgtggagaacgaagaagtcagagaatgggcgcgtgaggtacacggtctttggagaaatctgagctgcagagtctctgactcagtaagagagtctgccgaccggcacacgcttctaccgttgccggaaccggttatcattcccggttcgagattcagagaagtctattactgggattcttattgggtcatcaaaggacttatgacgagtcaaatgttcactaccgccaaaggtttagtgacgaatctgatgtcacttgtggagacttatggttacgctttgaacggtgctagagcttattatactaacagaagccaaccacctttgttgagctccatggtctatgaaatttataatgtgacaaaagatgaagaacttgtgaggaaagcaatccctctgcttctcaaagagtacgagttttggaactcaggaaaacataaagtggttattcgagacgctaatggttatgatcacgttttgagccgttattatgctatgtggaacaagccaaggcctgaatcctctgttttcgatgaagaatctgcttcagggttctcgactatgttagagaaacaacggttccatcgagatatagccacggctgctgaatcaggatgcgatttcagcacgcgatggatgagggatcctcctaatttcacaacgatggctacaacatcagtggttcctgttgatctaaatgtttttcttctcaagatggaactcgatatagcgttcatgatgaaggtttctggagatcaaaatggttcagaccgttttgtgaaagcgtcaaaagcgagagagaaagcgtttcaaaccgtgttttggaacgagaaagcagggcaatggctggattactggctttcctccagtggtgaggaatctgagacatggaaggctgagaaccaaaacaccaacgtctttgcgtctaactttgcaccaatctggattaattccatcaattcaggtaatgaaaatcttgtcaagaaagttgtgacagctcttaagaactcagggctcattgctcccgctggaatcctaacttctttgacaaactcaggacaacaatgggattctccgaatggatgggcaccgcaacaagagatgatcgtcacagggctcggaagatcgagtgtaaaagaagctaaagagatggcagaggatattgcaaggagatggatcaaaagcaactatcttgtctacaagaaaagtgggactatacatgagaagctcaaagttacagagcttggtgaatatggtggtggaggagaatatatgccacagaccggattcggatggtcaaatggagttatcttagcattcttggaggaatatggatggccctctcatcttagcattgaagcctag

SEQ ID NO: 2588 - protein, 1884 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ATGAAATCATACAAACTTAATAACCCTAATTTACTCATCTCCACGCACACACATAATAAACTCTTCTTATCCTCTTCTCCATTCAATCTCTTATTCTCTTTTCCTTCCTTCATATACCTTAAACAGCAACGTTCTCTGTTCTTCTTCTTCTTTTTCTTCCTCTGTTTTTCTTTCACAACTTCCATGTTGGACTCGGACACAGACACGGACTCAGGTCCTGTGGTTGCAACAACCAAACTCGTCACTTTCCTCCAGCGTGTGCAGCACACGGCACTTCGATCATACCCTAAAAAACAAACGCCTGATCCCAAATCCTACATTGATCTATCTCTCAAACGTCCCTACAGTCTCTCCACCATCGAATCAGCCTTCGATGATCTCACGAGCGAGTCACATGACCAGCCAGTGCCAGTGGAGACGCTTGAAAAGTTCGTCAAGGAATATTTTGACGGTGCAGGGGAGGATCTGCTGCACCACGAACCAGTAGATTTCGTCTCAGATCCCTCCGGCTTCCTCTCCAACGTGGAGAACGAAGAAGTCAGAGAATGGGCGCGTGAGGTACACGGTCTTTGGAGAAATCTGAGCTGCAGAGTCTCTGACTCAGTAAGAGAGTCTGCCGACCGGCACACGCTTCTACCGTTGCCGGAACCGGTTATCATTCCCGGTTCGAGATTCAGAGAAGTCTATTACTGGGATTCTTATTGGGTCATCAAAGGACTTATGACGAGTCAAATGTTCACTACCGCCAAAGGTTTAGTGACGAATCTGATGTCACTTGTGGAGACTTATGGTTACGCTTTGAACGGTGCTAGAGCTTATTATACTAACAGAAGCCAACCACCTTTGTTGAGCTCCATGGTCTATGAAATTTATAATGTGACAAAAGATGAAGAACTTGTGAGGAAAGCAATCCCTCTGCTTCTCAAAGAGTACGAGTTTTGGAACTCAGGAAAACATAAAGTGGTTATTCGAGACGCTAATGGTTATGATCACGTTTTGAGCCGTTATTATGCTATGTGGAACAAGCCAAGGCCTGAATCCTCTGTTTTCGATGAAGAATCTGCTTCAGGGTTCTCGACTATGTTAGAGAAACAACGGTTCCATCGAGATATAGCCACGGCTGCTGAATCAGGATGCGATTTCAGCACGCGATGGATGAGGGATCCTCCTAATTTCACAACGATGGCTACAACATCAGTGGTTCCTGTTGATCTAAATGTTTTTCTTCTCAAGATGGAACTCGATATAGCGTTCATGATGAAGGTTTCTGGAGATCAAAATGGTTCAGACCGTTTTGTGAAAGCGTCAAAAGCGAGAGAGAAAGCGTTTCAAACCGTGTTTTGGAACGAGAAAGCAGGGCAATGGCTGGATTACTGGCTTTCCTCCAGTGGTGAGGAATCTGAGACATGGAAGGCTGAGAACCAAAACACCAACGTCTTTGCGTCTAACTTTGCACCAATCTGGATTAATTCCATCAATTCAGGTAATGAAAATCTTGTCAAGAAAGTTGTGACAGCTCTTAAGAACTCAGGGCTCATTGCTCCCGCTGGAATCCTAACTTCTTTGACAAACTCAGGACAACAATGGGATTCTCCGAATGGATGGGCACCGCAACAAGAGATGATCGTCACAGGGCTCGGAAGATCGAGTGTAAAAGAAGCTAAAGAGATGGCAGAGGATATTGCAAGGAGATGGATCAAAAGCAACTATCTTGTCTACAAGAAAAGTGGGACTATACATGAGAAGCTCAAAGTTACAGAGCTTGGTGAATATGGTGGTGGAGGAGAATATATGCCACAGACCGGATTCGGATGGTCAAATGGAGTTATCTTAGCATTCTTGGAGGAATATGGATGGCCCTCTCATCTTAGCATTGAAGCCTAG

SEQ ID NO: 2589 - DNA, 1253 bp, Arabidopsis thaliana
  misc_feature (1)..(1253): Ceres cDNA ID no. 13615549
  misc_feature (1)..(1253): Also known as  Ceres CDNA ID no. 23533084
ggatttgatttcttttcccaaactttaacattttatatctaaaaccatttcatcttatgaatatcaacaacaatggcagaacaagaaactacgtcaaacataaacaccattaatgatcaagcagaagaagaaacaagaacaaaatctcagccattgatttcaggtctaccaaatgatatagctgagctttgtcttcttcgtcttccttacccataccatgctctatatcgctctgtttcatcttcatggaacaaaaccatcacaaaccctagattcctcttctccaagcaatctctttctatctcttctccttacctatttgtcttcgctttcaacaaatcaacggctaggattcaatggcaatcccttgaccttgcatctggccgttggtttgttttacctcccatgccaaactctttcaccaaaatctcgtctcctcacgcactctcatgcgcgtcgatgccacgtcaggggaagctttttgtactcggcggcggagatgtaaaccgctccgccgtcgtttacactgctctaacgaatcgttggtcgtgtatatctccgatgatgagcccgagaacgtacttcgtctccgggaatgttaacggtaaaatcatggccgttggtgggagtgtgggcggaaacggagaagcaactacggaagttgaatcgtatgatccagataatgacacgtggacggttgtgaagaagttgccgatggtgttggcgaagtatgactcagccgtgatcgggaaagagatgtgtgtaacagaaggatgggcgtggccgttcatgtttccaccgatgggacaagtgtacgactccgacgaaggcacgtggcgagagatgagcggtgggatgaaagaagggtggacgggtgtgagcgtcgtgatccgcgacaggctgtttgtgatctcggagcacggtgattttccgatgaaggtttattgttcagatgatgacacgtggaggtacgtgagtggtgagaagctacagggggagaagatgcggcgtcctttcgccgtgacgggagctgatgatcgtgtgtttgtggtggccagtgggattaacgtagcggaagggagagtgagtgaagggcaaaatggggattttagtgttgagtggaggatggtttcgtctcctaaaagttctattcagttttcacctgctagttgtcatgtgctatatgtttgatgtgtaattgttgttagttttgaatttgtaaactcttttcactaaaacccttttcactggct

SEQ ID NO: 2590 - protein, 1253 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
GGATTTGATTTCTTTTCCCAAACTTTAACATTTTATATCTAAAACCATTTCATCTTATGAATATCAACAACAATGGCAGAACAAGAAACTACGTCAAACATAAACACCATTAATGATCAAGCAGAAGAAGAAACAAGAACAAAATCTCAGCCATTGATTTCAGGTCTACCAAATGATATAGCTGAGCTTTGTCTTCTTCGTCTTCCTTACCCATACCATGCTCTATATCGCTCTGTTTCATCTTCATGGAACAAAACCATCACAAACCCTAGATTCCTCTTCTCCAAGCAATCTCTTTCTATCTCTTCTCCTTACCTATTTGTCTTCGCTTTCAACAAATCAACGGCTAGGATTCAATGGCAATCCCTTGACCTTGCATCTGGCCGTTGGTTTGTTTTACCTCCCATGCCAAACTCTTTCACCAAAATCTCGTCTCCTCACGCACTCTCATGCGCGTCGATGCCACGTCAGGGGAAGCTTTTTGTACTCGGCGGCGGAGATGTAAACCGCTCCGCCGTCGTTTACACTGCTCTAACGAATCGTTGGTCGTGTATATCTCCGATGATGAGCCCGAGAACGTACTTCGTCTCCGGGAATGTTAACGGTAAAATCATGGCCGTTGGTGGGAGTGTGGGCGGAAACGGAGAAGCAACTACGGAAGTTGAATCGTATGATCCAGATAATGACACGTGGACGGTTGTGAAGAAGTTGCCGATGGTGTTGGCGAAGTATGACTCAGCCGTGATCGGGAAAGAGATGTGTGTAACAGAAGGATGGGCGTGGCCGTTCATGTTTCCACCGATGGGACAAGTGTACGACTCCGACGAAGGCACGTGGCGAGAGATGAGCGGTGGGATGAAAGAAGGGTGGACGGGTGTGAGCGTCGTGATCCGCGACAGGCTGTTTGTGATCTCGGAGCACGGTGATTTTCCGATGAAGGTTTATTGTTCAGATGATGACACGTGGAGGTACGTGAGTGGTGAGAAGCTACAGGGGGAGAAGATGCGGCGTCCTTTCGCCGTGACGGGAGCTGATGATCGTGTGTTTGTGGTGGCCAGTGGGATTAACGTAGCGGAAGGGAGAGTGAGTGAAGGGCAAAATGGGGATTTTAGTGTTGAGTGGAGGATGGTTTCGTCTCCTAAAAGTTCTATTCAGTTTTCACCTGCTAGTTGTCATGTGCTATATGTTTGATGTGTAATTGTTGTTAGTTTTGAATTTGTAAACTCTTTTCACTAAAACCCTTTTCACTGGCT

SEQ ID NO: 2591 - DNA, 1003 bp, Arabidopsis thaliana
  misc_feature (1)..(1003): Ceres cDNA ID no. 13616003
  misc_feature (1)..(1003): Also known as  Ceres CDNA ID no. 23533084
caccgtaaatcgtttctgggttcttaagaataacatggcctcgtcatcatcatcatcttatagattccaatctgggtcttaccctctttcgtcaagtccttctcttgggaatttcgtcgaacgcattaaagacgcttgtcatttccttgtctctgctgttttgggtaccattatctccgcgatcttgaccttcttcttcgcactagtgggcacattgctaggggcacttacaggagctttgataggtcaagaaactgagagtggtttcattagaggagcagcaattggagccatttcgggagctgttttctctatcgaggtctttgaatcatctctggatctctggaaatccgatgagtcgggtttcggatgttttctctacttgattgatgtcattgttagtcttctaagcgggagacttgtacgagagcgcattggtcctgcaatgctaagtgcagtgcaaagtcaaatgggagctgtggatacagcttttgatgatcacacaagcctttttgatacaggaggctcaaaaggattgacaggagaccttgttgagaaaatcccaaagatgacaatcactggcaacaataacactgatgcttctgagaacacagactcatgttctgtttgtcttcaggatttccagctcggtgaaacagttagaagcttgcctcattgtcatcacatgtttcacttaccttgcatagacaattggctccttagacacggttcttgcccgatgtgtagacgtgatatttaatctcttcatctctccatcgtccgtctctcataatgcagtttaacctcgcagttcagatatttctacagctcgtacatcaagagtctgctctgctcttcttccctcctccttgagtttcatgtaaattccagttcttttggctgtttacaattacgatacctctcttactctttcagagtcattgtaggactcctagttctctaatgtacaaagaaacacaaaaatagagtttttgttttatct

SEQ ID NO: 2592 - protein, 1003 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
CACCGTAAATCGTTTCTGGGTTCTTAAGAATAACATGGCCTCGTCATCATCATCATCTTATAGATTCCAATCTGGGTCTTACCCTCTTTCGTCAAGTCCTTCTCTTGGGAATTTCGTCGAACGCATTAAAGACGCTTGTCATTTCCTTGTCTCTGCTGTTTTGGGTACCATTATCTCCGCGATCTTGACCTTCTTCTTCGCACTAGTGGGCACATTGCTAGGGGCACTTACAGGAGCTTTGATAGGTCAAGAAACTGAGAGTGGTTTCATTAGAGGAGCAGCAATTGGAGCCATTTCGGGAGCTGTTTTCTCTATCGAGGTCTTTGAATCATCTCTGGATCTCTGGAAATCCGATGAGTCGGGTTTCGGATGTTTTCTCTACTTGATTGATGTCATTGTTAGTCTTCTAAGCGGGAGACTTGTACGAGAGCGCATTGGTCCTGCAATGCTAAGTGCAGTGCAAAGTCAAATGGGAGCTGTGGATACAGCTTTTGATGATCACACAAGCCTTTTTGATACAGGAGGCTCAAAAGGATTGACAGGAGACCTTGTTGAGAAAATCCCAAAGATGACAATCACTGGCAACAATAACACTGATGCTTCTGAGAACACAGACTCATGTTCTGTTTGTCTTCAGGATTTCCAGCTCGGTGAAACAGTTAGAAGCTTGCCTCATTGTCATCACATGTTTCACTTACCTTGCATAGACAATTGGCTCCTTAGACACGGTTCTTGCCCGATGTGTAGACGTGATATTTAATCTCTTCATCTCTCCATCGTCCGTCTCTCATAATGCAGTTTAACCTCGCAGTTCAGATATTTCTACAGCTCGTACATCAAGAGTCTGCTCTGCTCTTCTTCCCTCCTCCTTGAGTTTCATGTAAATTCCAGTTCTTTTGGCTGTTTACAATTACGATACCTCTCTTACTCTTTCAGAGTCATTGTAGGACTCCTAGTTCTCTAATGTACAAAGAAACACAAAAATAGAGTTTTTGTTTTATCT

SEQ ID NO: 2593 - DNA, 1484 bp, Arabidopsis thaliana
  misc_feature (1)..(1484): Ceres cDNA ID no. 13616045
  misc_feature (1)..(1484): Also known as  Ceres CDNA ID no. 23533084
atttattcatcacttatcagcgatttgacgagaagagctttttggtttctgcgaatcatccaaaatccgccatggaagcaactacaagaatcttgagtacttcttctgctctcaatcgtcttcttcttctcagtaagctcaatctaaaatcagatccccgtaatatcaattccacaaatcagctactacacaatgccgttacccgaaaatcctctatctccgccgctcgtatacggtgctcttcgctccctgcgaatgcgaatctcttcagatcactcttcttcctaacgtcaacgtttcgtctcgagaacaccgccgttcacgctaatccattccgatccgaacctaacgacggcgtcgccgtctggaacagagctccacggatcgtgaacggaggtggaaacgcggcgatattcggcgggaacgaggggaaagagacgacggtggttctccttggttggctaggagcgaaagctaaacatctaaggagatacgttgagtggtacaactccaggggaattaacgccgttactttcactgttgacgttagggatttgctccggttagatcttggtcggcggcttgaacgaaggatagctgaatttgggaatgaattggttaattgggtatcggagaaagaagatgatggtagagagaaatgcttggtgtttcacagtttcagtaacactggttggcttgtatatggtgccttgctagagagcttcattggtagacaagatttagtagaaaggattaagggttgtatcattgactcgggaggagcagatcctcttgatactaagatttgggcagcggggtttaccgcggctatactgaagaagcgtagctccaccataaccacagaaccaaacagtcccataaaagaagaggatgcttcaacaccacaaaagaaggaacctttaggaatcgaaaacataatgctatcatctctggagaaactcttccccatcttcttaaaccacccagacgtcaatacgaggctaacaaaaatcattcaaaaactatatgagaaccatcctccatgtcctcagctctatctttacagctccggggacaaagttgttccatctcattccgttgagctccgcatccgagaacaacagaagattggaagaaagatacattctttcaatttcaagtcctctcctcacgtggatcattaccggaactttcctgacttgtattcctcacagcttcaaaacttcttgcaagaatgcttcacaccaacaaaacaacaagctctgtgactttggaacatctttttttgcagaatatttgtagccttggtttgtttgtttgttttctcctcaaaagttgtttattattgatgatagaacaagataatccgaaggagacagaaactccaaactgtgtcgacgagctactgagcagagatagtttctgaaactcttagattgttgttgctagtttggcttcatatgtgaaacttgaccgatgctcgg

SEQ ID NO: 2594 - protein, 1484 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ATTTATTCATCACTTATCAGCGATTTGACGAGAAGAGCTTTTTGGTTTCTGCGAATCATCCAAAATCCGCCATGGAAGCAACTACAAGAATCTTGAGTACTTCTTCTGCTCTCAATCGTCTTCTTCTTCTCAGTAAGCTCAATCTAAAATCAGATCCCCGTAATATCAATTCCACAAATCAGCTACTACACAATGCCGTTACCCGAAAATCCTCTATCTCCGCCGCTCGTATACGGTGCTCTTCGCTCCCTGCGAATGCGAATCTCTTCAGATCACTCTTCTTCCTAACGTCAACGTTTCGTCTCGAGAACACCGCCGTTCACGCTAATCCATTCCGATCCGAACCTAACGACGGCGTCGCCGTCTGGAACAGAGCTCCACGGATCGTGAACGGAGGTGGAAACGCGGCGATATTCGGCGGGAACGAGGGGAAAGAGACGACGGTGGTTCTCCTTGGTTGGCTAGGAGCGAAAGCTAAACATCTAAGGAGATACGTTGAGTGGTACAACTCCAGGGGAATTAACGCCGTTACTTTCACTGTTGACGTTAGGGATTTGCTCCGGTTAGATCTTGGTCGGCGGCTTGAACGAAGGATAGCTGAATTTGGGAATGAATTGGTTAATTGGGTATCGGAGAAAGAAGATGATGGTAGAGAGAAATGCTTGGTGTTTCACAGTTTCAGTAACACTGGTTGGCTTGTATATGGTGCCTTGCTAGAGAGCTTCATTGGTAGACAAGATTTAGTAGAAAGGATTAAGGGTTGTATCATTGACTCGGGAGGAGCAGATCCTCTTGATACTAAGATTTGGGCAGCGGGGTTTACCGCGGCTATACTGAAGAAGCGTAGCTCCACCATAACCACAGAACCAAACAGTCCCATAAAAGAAGAGGATGCTTCAACACCACAAAAGAAGGAACCTTTAGGAATCGAAAACATAATGCTATCATCTCTGGAGAAACTCTTCCCCATCTTCTTAAACCACCCAGACGTCAATACGAGGCTAACAAAAATCATTCAAAAACTATATGAGAACCATCCTCCATGTCCTCAGCTCTATCTTTACAGCTCCGGGGACAAAGTTGTTCCATCTCATTCCGTTGAGCTCCGCATCCGAGAACAACAGAAGATTGGAAGAAAGATACATTCTTTCAATTTCAAGTCCTCTCCTCACGTGGATCATTACCGGAACTTTCCTGACTTGTATTCCTCACAGCTTCAAAACTTCTTGCAAGAATGCTTCACACCAACAAAACAACAAGCTCTGTGACTTTGGAACATCTTTTTTTGCAGAATATTTGTAGCCTTGGTTTGTTTGTTTGTTTTCTCCTCAAAAGTTGTTTATTATTGATGATAGAACAAGATAATCCGAAGGAGACAGAAACTCCAAACTGTGTCGACGAGCTACTGAGCAGAGATAGTTTCTGAAACTCTTAGATTGTTGTTGCTAGTTTGGCTTCATATGTGAAACTTGACCGATGCTCGG

SEQ ID NO: 2595 - DNA, 1063 bp, Arabidopsis thaliana
  misc_feature (1)..(1063): Ceres cDNA ID no. 13616056
  misc_feature (1)..(1063): Also known as  Ceres CDNA ID no. 23533084
atcatcttcattttctctataggtttatgagaagctaaagctatgatgatttctttaatcaaaatagcttagggttttggagagagattactaagaaagttttaatgtttgtttaagagaaaagttatatattagggttttctttattcagaagcttcaagatcagaaaagatggaagttagagagaagaaagatgagaaaatggagatgacaagaagaaaatcatcagctctagatcatcatcgtcttcctccgtacacttactcccaaaccgccaacaaagagaaacccaccaccaaaagaaacgggtcggacccggatccggatccggatcttgatactaacccaatttctatatctcatgctccaagatcatacgctaggcctcaaactacttctccggggaaggcaaggtatagagaatgccaaaagaatcacgcggcgagctccggtggacacgttgtcgacggttgcggcgagtttatgtcttccggggaagaaggcacggtggagtctcttctttgtgcagcttgtgattgccaccggagcttccatagaaaagagatcgatggtttgtttgttgtcaatttcaatagctttggccattcacagagaccactcggaagccgccacgtgtctccgataatgatgagttttggtggtggtggtggttgtgcggcggagtcatcgacggaggatctaaacaagtttcatcaatcttttagtggttatggagtggatcagtttcatcattatcaacccaagaaacggtttaggacaaagtttaatgaagaacagaaggagaagatgatggagtttgctgagaagattggttggagaatgacaaaactagaagatgatgaagtgaatcggttttgtcgtgagattaaagttaaaagacaagtgtttaaagtttggatgcacaacaataaacaagcagcaaagaagaaggatttgtaagagatttctatatatatatatatactatttttacttctctttgttcaacattgctttaacttaaagactttgtgtttattgtataacaaattgattttagagc

SEQ ID NO: 2596 - protein, 1063 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ATCATCTTCATTTTCTCTATAGGTTTATGAGAAGCTAAAGCTATGATGATTTCTTTAATCAAAATAGCTTAGGGTTTTGGAGAGAGATTACTAAGAAAGTTTTAATGTTTGTTTAAGAGAAAAGTTATATATTAGGGTTTTCTTTATTCAGAAGCTTCAAGATCAGAAAAGATGGAAGTTAGAGAGAAGAAAGATGAGAAAATGGAGATGACAAGAAGAAAATCATCAGCTCTAGATCATCATCGTCTTCCTCCGTACACTTACTCCCAAACCGCCAACAAAGAGAAACCCACCACCAAAAGAAACGGGTCGGACCCGGATCCGGATCCGGATCTTGATACTAACCCAATTTCTATATCTCATGCTCCAAGATCATACGCTAGGCCTCAAACTACTTCTCCGGGGAAGGCAAGGTATAGAGAATGCCAAAAGAATCACGCGGCGAGCTCCGGTGGACACGTTGTCGACGGTTGCGGCGAGTTTATGTCTTCCGGGGAAGAAGGCACGGTGGAGTCTCTTCTTTGTGCAGCTTGTGATTGCCACCGGAGCTTCCATAGAAAAGAGATCGATGGTTTGTTTGTTGTCAATTTCAATAGCTTTGGCCATTCACAGAGACCACTCGGAAGCCGCCACGTGTCTCCGATAATGATGAGTTTTGGTGGTGGTGGTGGTTGTGCGGCGGAGTCATCGACGGAGGATCTAAACAAGTTTCATCAATCTTTTAGTGGTTATGGAGTGGATCAGTTTCATCATTATCAACCCAAGAAACGGTTTAGGACAAAGTTTAATGAAGAACAGAAGGAGAAGATGATGGAGTTTGCTGAGAAGATTGGTTGGAGAATGACAAAACTAGAAGATGATGAAGTGAATCGGTTTTGTCGTGAGATTAAAGTTAAAAGACAAGTGTTTAAAGTTTGGATGCACAACAATAAACAAGCAGCAAAGAAGAAGGATTTGTAAGAGATTTCTATATATATATATATACTATTTTTACTTCTCTTTGTTCAACATTGCTTTAACTTAAAGACTTTGTGTTTATTGTATAACAAATTGATTTTAGAGC

SEQ ID NO: 2597 - DNA, 823 bp, Arabidopsis thaliana
  misc_feature (1)..(823): Ceres cDNA ID no. 13616101
  misc_feature (1)..(823): Also known as  Ceres CDNA ID no. 23533084
gtatcgagatcgaatcggcaatggctgcttcaagctccgttttcacagtatccccgtcgcgaaatcttgcagctattcctcttcatcagtccctatctccaccgttgcttagatccagctccgtcgcgtttcgtcccaaacgaagatccagctcactcgtcttatgctcaactgatgaatcaaagagcaccgcagagaaagagatcccaatcgaactaaggtatgaggcgtttccgacagtgatggacatcaataagatacaagagattttgcctcacagattcccatttctgttagttgatagagtgatagagtacacagctggtgtatctgcggtagctattaaaaacgttaccattaatgacaatttctttcctgggcatttccctgagagacctataatgcctggagttctcatggttgaggcaatggctcaagtgggaggtatagtgatgctacaaccagaagttggcggatctagaagcaacttcttctttgctggaatcgacaaagtcagattcaggaagccagtgattgcaggtgatacgctggtgatgaggatgacacttgtgaagttgcagaagcggtttgggatagcgaaaatggaagggaaagcatatgtagggaactctgtggtatgtgaaggagagttcttgatggctatgggaaaagaagagtgatcacgcctttgtttctttcttcttcatatgggccttgtggctgctaattagttgtcacatcctaagttgagtctcatttctatcttcaatttatgatgtttgtttgcacattatgattatattaaaaaagcaacttcagtttt

SEQ ID NO: 2598 - protein, 823 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
GTATCGAGATCGAATCGGCAATGGCTGCTTCAAGCTCCGTTTTCACAGTATCCCCGTCGCGAAATCTTGCAGCTATTCCTCTTCATCAGTCCCTATCTCCACCGTTGCTTAGATCCAGCTCCGTCGCGTTTCGTCCCAAACGAAGATCCAGCTCACTCGTCTTATGCTCAACTGATGAATCAAAGAGCACCGCAGAGAAAGAGATCCCAATCGAACTAAGGTATGAGGCGTTTCCGACAGTGATGGACATCAATAAGATACAAGAGATTTTGCCTCACAGATTCCCATTTCTGTTAGTTGATAGAGTGATAGAGTACACAGCTGGTGTATCTGCGGTAGCTATTAAAAACGTTACCATTAATGACAATTTCTTTCCTGGGCATTTCCCTGAGAGACCTATAATGCCTGGAGTTCTCATGGTTGAGGCAATGGCTCAAGTGGGAGGTATAGTGATGCTACAACCAGAAGTTGGCGGATCTAGAAGCAACTTCTTCTTTGCTGGAATCGACAAAGTCAGATTCAGGAAGCCAGTGATTGCAGGTGATACGCTGGTGATGAGGATGACACTTGTGAAGTTGCAGAAGCGGTTTGGGATAGCGAAAATGGAAGGGAAAGCATATGTAGGGAACTCTGTGGTATGTGAAGGAGAGTTCTTGATGGCTATGGGAAAAGAAGAGTGATCACGCCTTTGTTTCTTTCTTCTTCATATGGGCCTTGTGGCTGCTAATTAGTTGTCACATCCTAAGTTGAGTCTCATTTCTATCTTCAATTTATGATGTTTGTTTGCACATTATGATTATATTAAAAAAGCAACTTCAGTTTT

SEQ ID NO: 2599 - DNA, 1754 bp, Arabidopsis thaliana
  misc_feature (1)..(1754): Ceres cDNA ID no. 13616122
  misc_feature (1)..(1754): Also known as  Ceres CDNA ID no. 23533084
aaagcttaacaacctccactagagactttcttgagcaaaaaagattggttataaaggaccaaccattgtcatgttattgagtgtcatttttgtgagggagagaattaagagagcaaaatgagcataaataggaatctgttgaatatcataataatcctttgtatatgtctcaatttgggttgtaacgatggagctcaagaaagagagactgattctcatactatccaagtcagctctctcctcccttcatcatcatcatcttgtgttctttctcccagagcgtctactacaaagtcttcactgcacgtgacgcatagacacggcacgtgttcgcgtctaaacaatggcaaggccacgagtccagaccatgtcgagatcctaagactcgaccaggctcgcgtaaactcaatccactcaaaactatcgaagaaactcgcaacagatcacgtcagtgaaagcaagtcaacggatctaccggctaaagacggaagcacactcggttcaggtaactacatcgtgacggtcggcctcgggacaccaaagaacgatctatcactaatcttcgacactggaagcgatttaacgtggactcagtgtcagccatgtgttcgaacttgctatgaccagaaggaaccaatctttaacccttctaagtctacttcttactacaacgtatcctgctcatcggctgcgtgtggttctctctcttctgctacaggaaacgccggaagctgttcggcttcgaattgcatctacggtattcaatacggcgatcaatcgttctccgtcggatttctcgccaaggagaagtttacactaacgaactccgacgtatttgacggcgtttatttcggttgcggcgagaacaaccaaggacttttcaccggtgtcgccggacttctcggtcttggtcgtgacaagctttcgtttccgtcgcagacggcaacggcttacaataagatcttctcttactgcctcccttcctccgctagctacaccggacatctcacattcggatccgccggaatctccagatccgttaaattcacaccaatttcaaccatcactgatggaacttccttctacggccttaatatcgtcgcaatcaccgtcggcggtcagaaattgccgattccttcaactgtattctctactccgggagctttaatcgattccggcaccgttatcactcgtctcccgccgaaagcctacgcggcgttaagaagctcgttcaaggcgaagatgtcaaagtatccgaccacgtcgggcgtctcgatcttggacacgtgtttcgatctcagcgggtttaagacggtgactatcccgaaagtggcgttctctttcagcggtggcgccgtcgtggagcttggttcgaaagggatattttacgtgtttaagatatctcaggtttgtctggcgtttgcagggaatagcgatgacagtaacgctgccatctttggaaacgttcagcagcaaacgctagaagttgtgtatgatggtgcgggtgggcgggtcgggtttgctccaaacgggtgtagttaagttagttaatgaaaaacagaacggggtaaattttaaatttatggatttggcacaaattagctttatccttaatcaagtgtgtaatttgggtaaagatcggaattcgtgatggtctttgaagtaattgtatagtaataagtgtgcatgatacaacaattacaagaacaaactgtttattgtaaaattttattccaatacaactatacaagatg

SEQ ID NO: 2600 - protein, 1754 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
AAAGCTTAACAACCTCCACTAGAGACTTTCTTGAGCAAAAAAGATTGGTTATAAAGGACCAACCATTGTCATGTTATTGAGTGTCATTTTTGTGAGGGAGAGAATTAAGAGAGCAAAATGAGCATAAATAGGAATCTGTTGAATATCATAATAATCCTTTGTATATGTCTCAATTTGGGTTGTAACGATGGAGCTCAAGAAAGAGAGACTGATTCTCATACTATCCAAGTCAGCTCTCTCCTCCCTTCATCATCATCATCTTGTGTTCTTTCTCCCAGAGCGTCTACTACAAAGTCTTCACTGCACGTGACGCATAGACACGGCACGTGTTCGCGTCTAAACAATGGCAAGGCCACGAGTCCAGACCATGTCGAGATCCTAAGACTCGACCAGGCTCGCGTAAACTCAATCCACTCAAAACTATCGAAGAAACTCGCAACAGATCACGTCAGTGAAAGCAAGTCAACGGATCTACCGGCTAAAGACGGAAGCACACTCGGTTCAGGTAACTACATCGTGACGGTCGGCCTCGGGACACCAAAGAACGATCTATCACTAATCTTCGACACTGGAAGCGATTTAACGTGGACTCAGTGTCAGCCATGTGTTCGAACTTGCTATGACCAGAAGGAACCAATCTTTAACCCTTCTAAGTCTACTTCTTACTACAACGTATCCTGCTCATCGGCTGCGTGTGGTTCTCTCTCTTCTGCTACAGGAAACGCCGGAAGCTGTTCGGCTTCGAATTGCATCTACGGTATTCAATACGGCGATCAATCGTTCTCCGTCGGATTTCTCGCCAAGGAGAAGTTTACACTAACGAACTCCGACGTATTTGACGGCGTTTATTTCGGTTGCGGCGAGAACAACCAAGGACTTTTCACCGGTGTCGCCGGACTTCTCGGTCTTGGTCGTGACAAGCTTTCGTTTCCGTCGCAGACGGCAACGGCTTACAATAAGATCTTCTCTTACTGCCTCCCTTCCTCCGCTAGCTACACCGGACATCTCACATTCGGATCCGCCGGAATCTCCAGATCCGTTAAATTCACACCAATTTCAACCATCACTGATGGAACTTCCTTCTACGGCCTTAATATCGTCGCAATCACCGTCGGCGGTCAGAAATTGCCGATTCCTTCAACTGTATTCTCTACTCCGGGAGCTTTAATCGATTCCGGCACCGTTATCACTCGTCTCCCGCCGAAAGCCTACGCGGCGTTAAGAAGCTCGTTCAAGGCGAAGATGTCAAAGTATCCGACCACGTCGGGCGTCTCGATCTTGGACACGTGTTTCGATCTCAGCGGGTTTAAGACGGTGACTATCCCGAAAGTGGCGTTCTCTTTCAGCGGTGGCGCCGTCGTGGAGCTTGGTTCGAAAGGGATATTTTACGTGTTTAAGATATCTCAGGTTTGTCTGGCGTTTGCAGGGAATAGCGATGACAGTAACGCTGCCATCTTTGGAAACGTTCAGCAGCAAACGCTAGAAGTTGTGTATGATGGTGCGGGTGGGCGGGTCGGGTTTGCTCCAAACGGGTGTAGTTAAGTTAGTTAATGAAAAACAGAACGGGGTAAATTTTAAATTTATGGATTTGGCACAAATTAGCTTTATCCTTAATCAAGTGTGTAATTTGGGTAAAGATCGGAATTCGTGATGGTCTTTGAAGTAATTGTATAGTAATAAGTGTGCATGATACAACAATTACAAGAACAAACTGTTTATTGTAAAATTTTATTCCAATACAACTATACAAGATG

SEQ ID NO: 2601 - DNA, 1057 bp, Arabidopsis thaliana
  misc_feature (1)..(1057): Ceres cDNA ID no. 13616542
  misc_feature (1)..(1057): Also known as  Ceres CDNA ID no. 23533084
atcatcactctctgagatcgaagagaaagcaaaatcaaagttgtgatgaaatctctattgatgagaaccggttcgatgccggttcttcaaaaccggttaatttcaggtggttcatcgcggaagatgacgcctatctccaggaccaactccgtcgaatcattatccagctacggcgagagattcgccggcgggaagatttcgatcgaggttaaggctaatgtagggatgcggagggtgttatcggaaagtgatgtgattagatctgagagaatgttgaaaagagttggatctaagccttcgccggcgagaatcccggaggatgatgaagcgggggaggaagaaattaggtttgcagatggttgggggtctatgatctccggtggtttacctgtggaggagaaatgtttcacgggtggcggtgttggtggtggatctggttatagcggcggttatggaaacggaggaggaggcggttatgaagataagagcaagatcggtgattattatcgagagatgttgagatctaatcctaataattcgcttcttctgatgaattacggcaagtttttgtatgaggtggagaaagatgcagagggagctgaagagtactatggaagagcaatactggagaatccaggagatggagaagctttatccatgtatggaagattgatatgggaaacgaagagagatgagaagagagctcaaggttactttgatcaagctgttaatgcttctcctaatgattgtatggttttgggatcatatgcacgtttcatgtgggaggcagaggatgatgatgatgatgatgaagaagaagaagaagaagaatggatggctgcatcaccactcatggtttctgcagtttagagactaacacgacgaagatgaagaagaagtaatggagactaagattatgtatcaagtatcaaccttttttttgtctatttcactgtctttttactaacttttgttgtaataacctgaagagtaatgaaaacatgtatgtgaaagaaaacgaatgtaaccttattataagagaataaaagtgcttttg

SEQ ID NO: 2602 - protein, 1057 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ATCATCACTCTCTGAGATCGAAGAGAAAGCAAAATCAAAGTTGTGATGAAATCTCTATTGATGAGAACCGGTTCGATGCCGGTTCTTCAAAACCGGTTAATTTCAGGTGGTTCATCGCGGAAGATGACGCCTATCTCCAGGACCAACTCCGTCGAATCATTATCCAGCTACGGCGAGAGATTCGCCGGCGGGAAGATTTCGATCGAGGTTAAGGCTAATGTAGGGATGCGGAGGGTGTTATCGGAAAGTGATGTGATTAGATCTGAGAGAATGTTGAAAAGAGTTGGATCTAAGCCTTCGCCGGCGAGAATCCCGGAGGATGATGAAGCGGGGGAGGAAGAAATTAGGTTTGCAGATGGTTGGGGGTCTATGATCTCCGGTGGTTTACCTGTGGAGGAGAAATGTTTCACGGGTGGCGGTGTTGGTGGTGGATCTGGTTATAGCGGCGGTTATGGAAACGGAGGAGGAGGCGGTTATGAAGATAAGAGCAAGATCGGTGATTATTATCGAGAGATGTTGAGATCTAATCCTAATAATTCGCTTCTTCTGATGAATTACGGCAAGTTTTTGTATGAGGTGGAGAAAGATGCAGAGGGAGCTGAAGAGTACTATGGAAGAGCAATACTGGAGAATCCAGGAGATGGAGAAGCTTTATCCATGTATGGAAGATTGATATGGGAAACGAAGAGAGATGAGAAGAGAGCTCAAGGTTACTTTGATCAAGCTGTTAATGCTTCTCCTAATGATTGTATGGTTTTGGGATCATATGCACGTTTCATGTGGGAGGCAGAGGATGATGATGATGATGATGAAGAAGAAGAAGAAGAAGAATGGATGGCTGCATCACCACTCATGGTTTCTGCAGTTTAGAGACTAACACGACGAAGATGAAGAAGAAGTAATGGAGACTAAGATTATGTATCAAGTATCAACCTTTTTTTTGTCTATTTCACTGTCTTTTTACTAACTTTTGTTGTAATAACCTGAAGAGTAATGAAAACATGTATGTGAAAGAAAACGAATGTAACCTTATTATAAGAGAATAAAAGTGCTTTTG

SEQ ID NO: 2603 - DNA, 1867 bp, Arabidopsis thaliana
  misc_feature (1)..(1867): Ceres cDNA ID no. 13616635
  misc_feature (1)..(1867): Also known as  Ceres CDNA ID no. 23533084
acaaccttcgtcttctcttgaaactctcctcatctctctcaagaaagattcaagttcgagtcttagctatgtctggaaactcagaaggactgttagagagctcaggcggcggcgtgggaggttccgtcgaggaggaaaaagatatgaagatggaggaaaccggtgaaggagccggcagcggaggaaaccggtggccaagaccagagactttagctctattgagaatacgttcagagatggataaagcttttcgtgactctactctcaaagctcccttatgggaagaaatttccaggaaaatgatggagcttggttacaagagaagttcaaagaaatgcaaggagaagttcgagaacgtgtacaagtaccacaaacgtaccaaagaaggtcgtaccgggaaatccgaaggcaaaacttaccggtttttcgaagagttagaagctttcgagactctcagttcctatcaacctgaacctgagtcgcaacccgcgaaatcttctgcagtgatcacgaacgcgcccgcaacctcttccttgataccatggattagctctagcaatccatcaaccgaaaaaagttcttcaccgttgaaacatcatcatcaggttagtgtacaacccatcaccacaaaccctaccttcctcgccaagcaaccatcttccacgacgccttttcctttttatagcagcaacaatactactactgttagccagccgccaatttcaaatgacttgatgaacaatgtttcatcgctgaatcttttctcgagctcaacttcttcatctactgcatctgacgaggaagaagatcatcatcaggttaagagctcgagaaagaagaggaagtattggaaagggttgtttacgaagttgacaaaagagttaatggagaaacaagagaagatgcaaaaaaggttcttggaaacactggagtatcgtgagaaagagagaatctcaagagaagaagcttggagggtccaagagatagggagaatcaacagagaacacgaaacattaatccatgagaggtccaatgctgcagctaaagacgctgcaatcatatccttcttacacaaaatctcaggaggacaaccacaacaaccgcaacaacataatcataaaccatcacaaaggaaacaatatcaaagcgatcattcaataacgtttgagagtaaagagccgagggcggttctattggatacaacaataaagatggggaattacgataacaatcattcggtgtctcctagttcttcaagatggcctaaaaccgaggtcgaggccttgataaggataagaaagaatcttgaagctaactatcaagaaaacggtactaagggaccattatgggaagagatctctgcagggatgagaagattgggatacaatagaagcgcgaaacgctgcaaagagaagtgggaaaacatcaacaagtactttaagaaagtcaaagaaagcaacaagaaacgtccccttgattccaagacttgcccttattttcaccagctcgaagctttgtacaacgagaggaacaaaagtggggcaatgccattgccattgcctctaatggtgactccacagagacagttgcttctctcgcaagaaacccagaccgagtttgagactgatcagagggaaaaagttggtgataaagaagatgaagaagaaggagagagtgaagaagatgaatacgatgaagaagaagagggagaaggagacaatgagacaagtgagttcgagattgtgttgaacaaaacatcttcacctatggacattaacaataatcttttcacctaagtggttttataatcattttattatatacactttcctgtaaaatggggttgaaggaaaaaaaaaaagcatat

SEQ ID NO: 2604 - protein, 1867 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ACAACCTTCGTCTTCTCTTGAAACTCTCCTCATCTCTCTCAAGAAAGATTCAAGTTCGAGTCTTAGCTATGTCTGGAAACTCAGAAGGACTGTTAGAGAGCTCAGGCGGCGGCGTGGGAGGTTCCGTCGAGGAGGAAAAAGATATGAAGATGGAGGAAACCGGTGAAGGAGCCGGCAGCGGAGGAAACCGGTGGCCAAGACCAGAGACTTTAGCTCTATTGAGAATACGTTCAGAGATGGATAAAGCTTTTCGTGACTCTACTCTCAAAGCTCCCTTATGGGAAGAAATTTCCAGGAAAATGATGGAGCTTGGTTACAAGAGAAGTTCAAAGAAATGCAAGGAGAAGTTCGAGAACGTGTACAAGTACCACAAACGTACCAAAGAAGGTCGTACCGGGAAATCCGAAGGCAAAACTTACCGGTTTTTCGAAGAGTTAGAAGCTTTCGAGACTCTCAGTTCCTATCAACCTGAACCTGAGTCGCAACCCGCGAAATCTTCTGCAGTGATCACGAACGCGCCCGCAACCTCTTCCTTGATACCATGGATTAGCTCTAGCAATCCATCAACCGAAAAAAGTTCTTCACCGTTGAAACATCATCATCAGGTTAGTGTACAACCCATCACCACAAACCCTACCTTCCTCGCCAAGCAACCATCTTCCACGACGCCTTTTCCTTTTTATAGCAGCAACAATACTACTACTGTTAGCCAGCCGCCAATTTCAAATGACTTGATGAACAATGTTTCATCGCTGAATCTTTTCTCGAGCTCAACTTCTTCATCTACTGCATCTGACGAGGAAGAAGATCATCATCAGGTTAAGAGCTCGAGAAAGAAGAGGAAGTATTGGAAAGGGTTGTTTACGAAGTTGACAAAAGAGTTAATGGAGAAACAAGAGAAGATGCAAAAAAGGTTCTTGGAAACACTGGAGTATCGTGAGAAAGAGAGAATCTCAAGAGAAGAAGCTTGGAGGGTCCAAGAGATAGGGAGAATCAACAGAGAACACGAAACATTAATCCATGAGAGGTCCAATGCTGCAGCTAAAGACGCTGCAATCATATCCTTCTTACACAAAATCTCAGGAGGACAACCACAACAACCGCAACAACATAATCATAAACCATCACAAAGGAAACAATATCAAAGCGATCATTCAATAACGTTTGAGAGTAAAGAGCCGAGGGCGGTTCTATTGGATACAACAATAAAGATGGGGAATTACGATAACAATCATTCGGTGTCTCCTAGTTCTTCAAGATGGCCTAAAACCGAGGTCGAGGCCTTGATAAGGATAAGAAAGAATCTTGAAGCTAACTATCAAGAAAACGGTACTAAGGGACCATTATGGGAAGAGATCTCTGCAGGGATGAGAAGATTGGGATACAATAGAAGCGCGAAACGCTGCAAAGAGAAGTGGGAAAACATCAACAAGTACTTTAAGAAAGTCAAAGAAAGCAACAAGAAACGTCCCCTTGATTCCAAGACTTGCCCTTATTTTCACCAGCTCGAAGCTTTGTACAACGAGAGGAACAAAAGTGGGGCAATGCCATTGCCATTGCCTCTAATGGTGACTCCACAGAGACAGTTGCTTCTCTCGCAAGAAACCCAGACCGAGTTTGAGACTGATCAGAGGGAAAAAGTTGGTGATAAAGAAGATGAAGAAGAAGGAGAGAGTGAAGAAGATGAATACGATGAAGAAGAAGAGGGAGAAGGAGACAATGAGACAAGTGAGTTCGAGATTGTGTTGAACAAAACATCTTCACCTATGGACATTAACAATAATCTTTTCACCTAAGTGGTTTTATAATCATTTTATTATATACACTTTCCTGTAAAATGGGGTTGAAGGAAAAAAAAAAAGCATAT

SEQ ID NO: 2605 - DNA, 1116 bp, Arabidopsis thaliana
  misc_feature (1)..(1116): Ceres cDNA ID no. 13616795
  misc_feature (1)..(1116): Also known as  Ceres CDNA ID no. 23533084
attattcccctaacgaatttcaaatcaaaatctctctctttctcttatctctaatggcgttgaggaacattgaaaacgctcttccgatctcacaggaacgacctaagaagctggccaaactctcaaagcaaccggagattggtctaaatgacgaaaacaaccctgtcgctgtggctgaatcgaccgtcgaatacgttgcttctgagaatctcaaaccattttcagatcctgaatcttctgtccagagattacttgaagaattagcatcaaaggattggattaaagtatgtgactcattgaacaacacaaggagatttgcaattcatcactcttctctgttgctaccaattctagaaaagcttatagttgtgatggtgaaggcgatgaagaatcctagaagtgcattgtgcaagacttcgattatgacttgttctgatatcttcactgcttatggagaaaagttgctggaaggacctcatttgaaatctatggacgatctgctgttgcagttgctgatgaaagcttcacaagacaagaagtttgtgtgtgaagaagcagagaaagcgctgaacacgatggttaactcggtggctcgcttgccgcttctgcgtaagcttcagagttatgtccgtcacagtaaccctcgtgtcagggccaaagctgctgtgtctacttccaactgcgtttctaaaatggaggtaaatgaaatggaagaatttgggatgattctgctcgcacaaatggctgcggatcagttgagtgacaagttgccagaggcaagggaagctgcaaggagtatggtgaactcgcttttcgagaaatttacatggaatgaagaagaagacgaagaaggaagcaagcaagaagcttggaagaagttttgtgagaagaatgtaacagggcttaatgcacaagccatgatcaagatcgttgcatctcaataaaattctgaagatgaaaatgttgttctctctgattcatgtaaaatacgtttttacatgatataaacaatcttttttatttctagtggatctgtcctctcaattccaatgctactaccataatacaacagaagctcagtggttctttaagcttcatgaaaaattgttgttgtgg

SEQ ID NO: 2606 - protein, 1116 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ATTATTCCCCTAACGAATTTCAAATCAAAATCTCTCTCTTTCTCTTATCTCTAATGGCGTTGAGGAACATTGAAAACGCTCTTCCGATCTCACAGGAACGACCTAAGAAGCTGGCCAAACTCTCAAAGCAACCGGAGATTGGTCTAAATGACGAAAACAACCCTGTCGCTGTGGCTGAATCGACCGTCGAATACGTTGCTTCTGAGAATCTCAAACCATTTTCAGATCCTGAATCTTCTGTCCAGAGATTACTTGAAGAATTAGCATCAAAGGATTGGATTAAAGTATGTGACTCATTGAACAACACAAGGAGATTTGCAATTCATCACTCTTCTCTGTTGCTACCAATTCTAGAAAAGCTTATAGTTGTGATGGTGAAGGCGATGAAGAATCCTAGAAGTGCATTGTGCAAGACTTCGATTATGACTTGTTCTGATATCTTCACTGCTTATGGAGAAAAGTTGCTGGAAGGACCTCATTTGAAATCTATGGACGATCTGCTGTTGCAGTTGCTGATGAAAGCTTCACAAGACAAGAAGTTTGTGTGTGAAGAAGCAGAGAAAGCGCTGAACACGATGGTTAACTCGGTGGCTCGCTTGCCGCTTCTGCGTAAGCTTCAGAGTTATGTCCGTCACAGTAACCCTCGTGTCAGGGCCAAAGCTGCTGTGTCTACTTCCAACTGCGTTTCTAAAATGGAGGTAAATGAAATGGAAGAATTTGGGATGATTCTGCTCGCACAAATGGCTGCGGATCAGTTGAGTGACAAGTTGCCAGAGGCAAGGGAAGCTGCAAGGAGTATGGTGAACTCGCTTTTCGAGAAATTTACATGGAATGAAGAAGAAGACGAAGAAGGAAGCAAGCAAGAAGCTTGGAAGAAGTTTTGTGAGAAGAATGTAACAGGGCTTAATGCACAAGCCATGATCAAGATCGTTGCATCTCAATAAAATTCTGAAGATGAAAATGTTGTTCTCTCTGATTCATGTAAAATACGTTTTTACATGATATAAACAATCTTTTTTATTTCTAGTGGATCTGTCCTCTCAATTCCAATGCTACTACCATAATACAACAGAAGCTCAGTGGTTCTTTAAGCTTCATGAAAAATTGTTGTTGTGG

SEQ ID NO: 2607 - DNA, 1294 bp, Arabidopsis thaliana
  misc_feature (1)..(1294): Ceres cDNA ID no. 13616941
  misc_feature (1)..(1294): Also known as  Ceres CDNA ID no. 23533084
atgatcagtcaagaaatacgcgtttaatcgactttttctctctatatatacaattctttcaaaatgatcaaacatagtcataagttccgcaccaatcagtggaaataactaatcaaaactctgtatcatcgttttcaaaacctaattaatggctgtaacaaatcttcctacttgtgatggtttgttcattatcagtcttattgtcatcgtttcttcaatatttgggacatcatctgcgcaactaaacgcaacattttactctgggacttgtcccaacgcctctgccatcgtacgcagcactattcagcaagctcttcaatccgatacaagaatcggagccagcctcatccgccttcattttcatgactgttttgttaatggatgtgatgcatcgatcttgcttgacgacactggaagcatccagagcgagaagaacgctggtccgaatgtaaactcagctagaggattcaacgttgttgataatatcaagactgccctcgaaaacgcttgccctggtgttgtctcttgctctgacgttttagcccttgcctctgaggcttctgtgtctttggcaggagggccatcatggactgtattattaggaagaagagatagtctcacggccaacctcgccggtgcaaattcgtccattccttctcccatcgaaagcctaagcaacatcacatttaaattttcggctgtcgggcttaatacaaacgatctggtagccttatctggtgcgcatacgttcgggcgtgctcgatgtggagtattcaacaacagactatttaacttcagcgggacaggaaatcccgatccaactctaaactcaacgcttctgagcactcttcaacagctatgtcctcaaaacggtagcgcatcaacgatcaccaatcttgatttgagcacaccagatgcgttcgataacaattacttcgccaaccttcagagcaacgatggacttcttcagtcagaccaagagctgttctctaccaccggttcatccaccatcgcgattgttacttcgttcgcaagtaaccagactctgttttttcaggcctttgcacagtccatgatcaatatggggaatattagtcccttgactgggagtaatggagagattaggttagactgtaagaaggttaatggaagttgatttccttaaagctcattttctttgaaaaaacattggcaagctttggttgaataatttttgttatcataatcacatcaaatctgtattgcacttaaatcattctaagcaaatttatgataaatgaaattaaatcaaaac

SEQ ID NO: 2608 - protein, 1294 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ATGATCAGTCAAGAAATACGCGTTTAATCGACTTTTTCTCTCTATATATACAATTCTTTCAAAATGATCAAACATAGTCATAAGTTCCGCACCAATCAGTGGAAATAACTAATCAAAACTCTGTATCATCGTTTTCAAAACCTAATTAATGGCTGTAACAAATCTTCCTACTTGTGATGGTTTGTTCATTATCAGTCTTATTGTCATCGTTTCTTCAATATTTGGGACATCATCTGCGCAACTAAACGCAACATTTTACTCTGGGACTTGTCCCAACGCCTCTGCCATCGTACGCAGCACTATTCAGCAAGCTCTTCAATCCGATACAAGAATCGGAGCCAGCCTCATCCGCCTTCATTTTCATGACTGTTTTGTTAATGGATGTGATGCATCGATCTTGCTTGACGACACTGGAAGCATCCAGAGCGAGAAGAACGCTGGTCCGAATGTAAACTCAGCTAGAGGATTCAACGTTGTTGATAATATCAAGACTGCCCTCGAAAACGCTTGCCCTGGTGTTGTCTCTTGCTCTGACGTTTTAGCCCTTGCCTCTGAGGCTTCTGTGTCTTTGGCAGGAGGGCCATCATGGACTGTATTATTAGGAAGAAGAGATAGTCTCACGGCCAACCTCGCCGGTGCAAATTCGTCCATTCCTTCTCCCATCGAAAGCCTAAGCAACATCACATTTAAATTTTCGGCTGTCGGGCTTAATACAAACGATCTGGTAGCCTTATCTGGTGCGCATACGTTCGGGCGTGCTCGATGTGGAGTATTCAACAACAGACTATTTAACTTCAGCGGGACAGGAAATCCCGATCCAACTCTAAACTCAACGCTTCTGAGCACTCTTCAACAGCTATGTCCTCAAAACGGTAGCGCATCAACGATCACCAATCTTGATTTGAGCACACCAGATGCGTTCGATAACAATTACTTCGCCAACCTTCAGAGCAACGATGGACTTCTTCAGTCAGACCAAGAGCTGTTCTCTACCACCGGTTCATCCACCATCGCGATTGTTACTTCGTTCGCAAGTAACCAGACTCTGTTTTTTCAGGCCTTTGCACAGTCCATGATCAATATGGGGAATATTAGTCCCTTGACTGGGAGTAATGGAGAGATTAGGTTAGACTGTAAGAAGGTTAATGGAAGTTGATTTCCTTAAAGCTCATTTTCTTTGAAAAAACATTGGCAAGCTTTGGTTGAATAATTTTTGTTATCATAATCACATCAAATCTGTATTGCACTTAAATCATTCTAAGCAAATTTATGATAAATGAAATTAAATCAAAAC

SEQ ID NO: 2609 - DNA, 906 bp, Arabidopsis thaliana
  misc_feature (1)..(906): Ceres cDNA ID no. 13617092
  misc_feature (1)..(906): Also known as  Ceres CDNA ID no. 23533084
aatggcgtcgtcgaagcacgaagactatggcatcccttacacacctcttccatcatcacaaccatctcaatccgtaatccttctaactccttatcgccgtcaccgtcgtccttcacttctccgtaacctccgttgttctctcctcttcaccgccgtaatcctcctcctctccgccgccgtttacttactctacccttcagatccagacatcactgtctcacgaatcaatctcaaccacataagcgtcgttgattctcataaaatcgctttagatctctcgttttcgctcacaatcaaagttcgaaaccgagatttcttctcacttgattacgattcgcttgttgtttcgattgggtatagaggaagagagttaggtcttgttaagtctaaaggtggacatcttaaagctcgtgatagctcttatattgatgctacgcttgagcttgatggtcttgaggttgttcatgatgttatttatttgattggtgatttggctaaaggtgttattccttttgatactattgctcaagttcaaggtgatcttggtgttctcttgttcaatatcccaattcagggtaaagtgtcgtgtgaggtgtatgttaatgttaacaaccagaaaatttcacaccaagattgtcatcgtaagtgaagtgcaatcctgagctggatgagagatgaagaaaccagataacatacgttgacatgttttgagttctggagaaatgatttgtgagtttttgtatagataaaatactcttaatgttaaaactgaaagatagaatgagaaagatgaaccactactttctgtaattaaagttctttcttaattcctcagatgtgtacaagtgtttgcttttatgttgtagacatgaataaaccactcaataaaccatgtaattcgaagtc

SEQ ID NO: 2610 - protein, 906 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
AATGGCGTCGTCGAAGCACGAAGACTATGGCATCCCTTACACACCTCTTCCATCATCACAACCATCTCAATCCGTAATCCTTCTAACTCCTTATCGCCGTCACCGTCGTCCTTCACTTCTCCGTAACCTCCGTTGTTCTCTCCTCTTCACCGCCGTAATCCTCCTCCTCTCCGCCGCCGTTTACTTACTCTACCCTTCAGATCCAGACATCACTGTCTCACGAATCAATCTCAACCACATAAGCGTCGTTGATTCTCATAAAATCGCTTTAGATCTCTCGTTTTCGCTCACAATCAAAGTTCGAAACCGAGATTTCTTCTCACTTGATTACGATTCGCTTGTTGTTTCGATTGGGTATAGAGGAAGAGAGTTAGGTCTTGTTAAGTCTAAAGGTGGACATCTTAAAGCTCGTGATAGCTCTTATATTGATGCTACGCTTGAGCTTGATGGTCTTGAGGTTGTTCATGATGTTATTTATTTGATTGGTGATTTGGCTAAAGGTGTTATTCCTTTTGATACTATTGCTCAAGTTCAAGGTGATCTTGGTGTTCTCTTGTTCAATATCCCAATTCAGGGTAAAGTGTCGTGTGAGGTGTATGTTAATGTTAACAACCAGAAAATTTCACACCAAGATTGTCATCGTAAGTGAAGTGCAATCCTGAGCTGGATGAGAGATGAAGAAACCAGATAACATACGTTGACATGTTTTGAGTTCTGGAGAAATGATTTGTGAGTTTTTGTATAGATAAAATACTCTTAATGTTAAAACTGAAAGATAGAATGAGAAAGATGAACCACTACTTTCTGTAATTAAAGTTCTTTCTTAATTCCTCAGATGTGTACAAGTGTTTGCTTTTATGTTGTAGACATGAATAAACCACTCAATAAACCATGTAATTCGAAGTC

SEQ ID NO: 2611 - DNA, 1217 bp, Arabidopsis thaliana
  misc_feature (1)..(1217): Ceres cDNA ID no. 13617263
  misc_feature (1)..(1217): Also known as  Ceres CDNA ID no. 23533084
acttatttcaattcccaaaatcctctgcctcatcatcttcaaactgttaccacgtccatagggttgtcgaagagctaggaagagccttaccaagagcttcttcttcccctaacatttaggttggtaggagaagcaaaggaagagatcatttataatggctcctgcattcggaaaatgtttcatgttctgctgcgctaaaacctccccggaaaaagacgaaatggcaacggaatcgtacgaagccgccattaaaggactcaatgatcttctcagtacgaaagcggatctcggaaacgtcgccgccgcgaagatcaaagcgttgacggcggagctaaaggagcttgactcaagcaattcagacgcaattgaacgaatcaagaccggttttactcaattcaaaaccgagaaatatttgaagaatagtactttgttcaatcatcttgccaagactcagaccccaaagtttctggtgtttgcttgctctgattctcgagtttgtccatctcacatcttgaatttccaacctggtgaggcttttgttgtcagaaacatagccaatatggttccaccttttgaccagaagagacactctggagttggcgccgccgttgaatacgcagttgtacatctcaaggtggagaacattttggtgataggccatagctgctgtggtggtattaagggactcatgtccattgaagatgatgctgccccaactcaaagtgacttcattgaaaattgggtgaagataggcgcatcagcgaggaacaagatcaaggaggaacataaagacttgagctacgatgatcaatgcaacaagtgtgagaaggaagctgtgaacgtatcgcttggaaacttgctttcgtacccattcgtgagagctgaggtggtgaagaacacacttgcaataagaggaggtcactacaatttcgtcaaaggaacgtttgatctctgggagctcgatttcaagaccactcctgcttttgccttctcttaagaaagaaagctaccggaacatataaaactcttttgagataaaaaaagacactttgactcatctttcttcattctctcatgttgatgattcctctccaacttctttgatttctttttgttaattcaaaacttcaactttgctgcttctatttcaaaagctcaaacaataaagctgtaaccaacgtttgaaacttctatatttgtctaattgatgtttgaac

SEQ ID NO: 2612 - protein, 1217 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ACTTATTTCAATTCCCAAAATCCTCTGCCTCATCATCTTCAAACTGTTACCACGTCCATAGGGTTGTCGAAGAGCTAGGAAGAGCCTTACCAAGAGCTTCTTCTTCCCCTAACATTTAGGTTGGTAGGAGAAGCAAAGGAAGAGATCATTTATAATGGCTCCTGCATTCGGAAAATGTTTCATGTTCTGCTGCGCTAAAACCTCCCCGGAAAAAGACGAAATGGCAACGGAATCGTACGAAGCCGCCATTAAAGGACTCAATGATCTTCTCAGTACGAAAGCGGATCTCGGAAACGTCGCCGCCGCGAAGATCAAAGCGTTGACGGCGGAGCTAAAGGAGCTTGACTCAAGCAATTCAGACGCAATTGAACGAATCAAGACCGGTTTTACTCAATTCAAAACCGAGAAATATTTGAAGAATAGTACTTTGTTCAATCATCTTGCCAAGACTCAGACCCCAAAGTTTCTGGTGTTTGCTTGCTCTGATTCTCGAGTTTGTCCATCTCACATCTTGAATTTCCAACCTGGTGAGGCTTTTGTTGTCAGAAACATAGCCAATATGGTTCCACCTTTTGACCAGAAGAGACACTCTGGAGTTGGCGCCGCCGTTGAATACGCAGTTGTACATCTCAAGGTGGAGAACATTTTGGTGATAGGCCATAGCTGCTGTGGTGGTATTAAGGGACTCATGTCCATTGAAGATGATGCTGCCCCAACTCAAAGTGACTTCATTGAAAATTGGGTGAAGATAGGCGCATCAGCGAGGAACAAGATCAAGGAGGAACATAAAGACTTGAGCTACGATGATCAATGCAACAAGTGTGAGAAGGAAGCTGTGAACGTATCGCTTGGAAACTTGCTTTCGTACCCATTCGTGAGAGCTGAGGTGGTGAAGAACACACTTGCAATAAGAGGAGGTCACTACAATTTCGTCAAAGGAACGTTTGATCTCTGGGAGCTCGATTTCAAGACCACTCCTGCTTTTGCCTTCTCTTAAGAAAGAAAGCTACCGGAACATATAAAACTCTTTTGAGATAAAAAAAGACACTTTGACTCATCTTTCTTCATTCTCTCATGTTGATGATTCCTCTCCAACTTCTTTGATTTCTTTTTGTTAATTCAAAACTTCAACTTTGCTGCTTCTATTTCAAAAGCTCAAACAATAAAGCTGTAACCAACGTTTGAAACTTCTATATTTGTCTAATTGATGTTTGAAC

SEQ ID NO: 2613 - DNA, 1766 bp, Arabidopsis thaliana
  misc_feature (1)..(1766): Ceres cDNA ID no. 13617387
  misc_feature (1)..(1766): Also known as  Ceres CDNA ID no. 23533084
aatcaattaaatcaccaaactcaattaaataaaaagaaaaaaattattattatcccttcttcttcttcttcgtcttcgtctttgattctcctgattcatgtcgcttaaatttttagcgatcttcgaatcccattttccttcgggaatctgacattttttctcgggaaatttttttatccaaatcggagtaaagtatcgaatctagagaatccgctatggatgagacctattttgatctattgaatttctttaagaatccctcttttacagagacatttgtcgacatcttactatgcgcagttccgatttggctcgccgttatgatcgggttattaatcggatggtcttggcgtccaagatggaccggtttgatctatttagggtttcgttctaagcttcggtttttatggaccgcaccgcctgggtttggtgctcgtcggctttggcttgctttcaccgctctctctgctttctccgtttgccgaaccatctggtcaaggaatgacaccagagctaataaatcggcgaccggttcagcttcgtcgcagacgcctgttgaggataatgatgaatcaggattggcctcaagaggtagcgataacgggacggtgacagaggatattgtgacagagaatgatttagagcatctgcttcagctgcttgaagttggaaatgcagctttggaatggcaatctatgatggataagactactccaaatatgagctaccaggcttggcgtcatgagcctgagacaggtcctgttatttatcgcagccggactgtgtttgaggatgcaactccagatattgttagggatttcttctgggatgatgagtttcgacctaaatgggatttcatgcttgccaacttcaaaacgttggaggaggacactcagacaggaacaatgattgttcagtggagaaaaaagtttccttttttctgtagtgaccgagagtatatcattggccggagaatatgggagtctgggaagaagtattattgtgtcacaaagggagttccttatccagctctaccaaagcgtgataagccaaggcgtgttgagctttatttctcaagttgggttatcagagcggttgaatcccgaaaaggagatggacagcaaacggcttgtgaagtttcccttgtccactacgaagacatgggcatcccaaaagacgtagcaaagttaggtgtccgtcatggcatgtggggagctgtcaagaagctaaactctggtttacgagcgtaccaatccgccagaaaatcagactcatctctatctcggatcgcccaaatggcaagaatcactacaaaactgaacatggattctgcagaatcatcttcaagagatgaagacagaagcagagcaatggaatatgcgagacaacgggaccatttgagaatggactggaaatgggttgttgtaggaggtgtcgcattggcttgtggccttcactctgggatcattggcaaggctttactggctggagctggccagagactggctcgtaggtgagaaaccttgtcgtattcttattatatcttcccttgacagaaaagagaaacatatgcatataattaagggaaatgtattatttttgcaactcctctgagaagggcatgtggttttggtggtgaaccatgtagagtagtagctttaaactatggagtcataagttatttgagttctatcttgtaccacaggatagtgagatatgtattttataaactatatgaatctacatagcttctaaaagcttaaatt

SEQ ID NO: 2614 - protein, 1766 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
AATCAATTAAATCACCAAACTCAATTAAATAAAAAGAAAAAAATTATTATTATCCCTTCTTCTTCTTCTTCGTCTTCGTCTTTGATTCTCCTGATTCATGTCGCTTAAATTTTTAGCGATCTTCGAATCCCATTTTCCTTCGGGAATCTGACATTTTTTCTCGGGAAATTTTTTTATCCAAATCGGAGTAAAGTATCGAATCTAGAGAATCCGCTATGGATGAGACCTATTTTGATCTATTGAATTTCTTTAAGAATCCCTCTTTTACAGAGACATTTGTCGACATCTTACTATGCGCAGTTCCGATTTGGCTCGCCGTTATGATCGGGTTATTAATCGGATGGTCTTGGCGTCCAAGATGGACCGGTTTGATCTATTTAGGGTTTCGTTCTAAGCTTCGGTTTTTATGGACCGCACCGCCTGGGTTTGGTGCTCGTCGGCTTTGGCTTGCTTTCACCGCTCTCTCTGCTTTCTCCGTTTGCCGAACCATCTGGTCAAGGAATGACACCAGAGCTAATAAATCGGCGACCGGTTCAGCTTCGTCGCAGACGCCTGTTGAGGATAATGATGAATCAGGATTGGCCTCAAGAGGTAGCGATAACGGGACGGTGACAGAGGATATTGTGACAGAGAATGATTTAGAGCATCTGCTTCAGCTGCTTGAAGTTGGAAATGCAGCTTTGGAATGGCAATCTATGATGGATAAGACTACTCCAAATATGAGCTACCAGGCTTGGCGTCATGAGCCTGAGACAGGTCCTGTTATTTATCGCAGCCGGACTGTGTTTGAGGATGCAACTCCAGATATTGTTAGGGATTTCTTCTGGGATGATGAGTTTCGACCTAAATGGGATTTCATGCTTGCCAACTTCAAAACGTTGGAGGAGGACACTCAGACAGGAACAATGATTGTTCAGTGGAGAAAAAAGTTTCCTTTTTTCTGTAGTGACCGAGAGTATATCATTGGCCGGAGAATATGGGAGTCTGGGAAGAAGTATTATTGTGTCACAAAGGGAGTTCCTTATCCAGCTCTACCAAAGCGTGATAAGCCAAGGCGTGTTGAGCTTTATTTCTCAAGTTGGGTTATCAGAGCGGTTGAATCCCGAAAAGGAGATGGACAGCAAACGGCTTGTGAAGTTTCCCTTGTCCACTACGAAGACATGGGCATCCCAAAAGACGTAGCAAAGTTAGGTGTCCGTCATGGCATGTGGGGAGCTGTCAAGAAGCTAAACTCTGGTTTACGAGCGTACCAATCCGCCAGAAAATCAGACTCATCTCTATCTCGGATCGCCCAAATGGCAAGAATCACTACAAAACTGAACATGGATTCTGCAGAATCATCTTCAAGAGATGAAGACAGAAGCAGAGCAATGGAATATGCGAGACAACGGGACCATTTGAGAATGGACTGGAAATGGGTTGTTGTAGGAGGTGTCGCATTGGCTTGTGGCCTTCACTCTGGGATCATTGGCAAGGCTTTACTGGCTGGAGCTGGCCAGAGACTGGCTCGTAGGTGAGAAACCTTGTCGTATTCTTATTATATCTTCCCTTGACAGAAAAGAGAAACATATGCATATAATTAAGGGAAATGTATTATTTTTGCAACTCCTCTGAGAAGGGCATGTGGTTTTGGTGGTGAACCATGTAGAGTAGTAGCTTTAAACTATGGAGTCATAAGTTATTTGAGTTCTATCTTGTACCACAGGATAGTGAGATATGTATTTTATAAACTATATGAATCTACATAGCTTCTAAAAGCTTAAATT

SEQ ID NO: 2615 - DNA, 904 bp, Arabidopsis thaliana
  misc_feature (1)..(904): Ceres cDNA ID no. 13617428
  misc_feature (1)..(904): Also known as  Ceres CDNA ID no. 23533084
cacacatacataaaagtagtagaactaaaaaatggcaaacctcttggtctctactttcatattttccgcacttttgctcatctccaccgcaacagccgccacattcgaaatcctaaaccaatgtagttacaccgtgtgggctgccgcaagccctggaggtggccgacgtctagatgctggccaatcatggaggctagatgtcgcggcgggcactaaaatggcacggatttggggtaggaccaattgtaactttgactcctcaggtcgtggccgatgccaaactggtgactgcagtggtggactccaatgtactggctggggacagccaccaaacacgttggctgagtacgctttgaaccaattcaacaacttagacttctacgatatctcacttgtcgatggatttaacatacctatggagtttagcccaactagttcgaactgccatcggatactatgtaccgcagacataaacggacaatgtccaaacgtgttgagagccccaggtggatgcaacaacccgtgtactgtatttcagacgaaccaatactgttgtacgaacggtcagggatcatgtagcgatactgagtactcaagattctttaagcagagatgccctgacgcttacagctatccacaagatgacccgactagcactttcacttgcaccaacactaactacagggtcgtgttttgtccaaggtctaggctcggtgctactggatcccaccagctcccgatcaagatggtcaccgaggagaattaatagactcgtatctactgtatgtgtgtgtgtgtgagggtgtacgtagatatgcgtacgtgtgacgtgatcatatatacgttaccataaacacttaatggattataataaggcatgcaataataattacgttagtcgacc

SEQ ID NO: 2616 - protein, 904 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
CACACATACATAAAAGTAGTAGAACTAAAAAATGGCAAACCTCTTGGTCTCTACTTTCATATTTTCCGCACTTTTGCTCATCTCCACCGCAACAGCCGCCACATTCGAAATCCTAAACCAATGTAGTTACACCGTGTGGGCTGCCGCAAGCCCTGGAGGTGGCCGACGTCTAGATGCTGGCCAATCATGGAGGCTAGATGTCGCGGCGGGCACTAAAATGGCACGGATTTGGGGTAGGACCAATTGTAACTTTGACTCCTCAGGTCGTGGCCGATGCCAAACTGGTGACTGCAGTGGTGGACTCCAATGTACTGGCTGGGGACAGCCACCAAACACGTTGGCTGAGTACGCTTTGAACCAATTCAACAACTTAGACTTCTACGATATCTCACTTGTCGATGGATTTAACATACCTATGGAGTTTAGCCCAACTAGTTCGAACTGCCATCGGATACTATGTACCGCAGACATAAACGGACAATGTCCAAACGTGTTGAGAGCCCCAGGTGGATGCAACAACCCGTGTACTGTATTTCAGACGAACCAATACTGTTGTACGAACGGTCAGGGATCATGTAGCGATACTGAGTACTCAAGATTCTTTAAGCAGAGATGCCCTGACGCTTACAGCTATCCACAAGATGACCCGACTAGCACTTTCACTTGCACCAACACTAACTACAGGGTCGTGTTTTGTCCAAGGTCTAGGCTCGGTGCTACTGGATCCCACCAGCTCCCGATCAAGATGGTCACCGAGGAGAATTAATAGACTCGTATCTACTGTATGTGTGTGTGTGTGAGGGTGTACGTAGATATGCGTACGTGTGACGTGATCATATATACGTTACCATAAACACTTAATGGATTATAATAAGGCATGCAATAATAATTACGTTAGTCGACC

SEQ ID NO: 2617 - DNA, 1271 bp, Arabidopsis thaliana
  misc_feature (1)..(1271): Ceres cDNA ID no. 13617475
  misc_feature (1)..(1271): Also known as  Ceres CDNA ID no. 23533084
actactctcttaagccctttcataaccttgtaaaccattaagaggctttgctcaattacaagaagaagaaaaaatgcttgtcgacgggaaactcgtctgcgtcaccggagccggcggctacattgcttcttggatcgttaagttactcttagagagaggctacaccgttagaggaaccgtaaggaacccaactgatcccaagaacaaccatctcagagagcttcaaggagccaaggaaagactcactcttcacagtgcagatcttctcgactacgaagctctctgtgccacaatcgacggttgcgatggcgttttccacactgcctctccgatgaccgacgatcccgagacaatgttggagccggcggtgaacggagccaagttcgtgattgacgcagcggctaaagccaaggtcaagcgcgtggttttcacgtcatcaattggtgcagtttacatgaaccctaaccgtgacactcaagccattgttgacgaaaactgctggagtgatcttgatttctgcaaaaacactaagaattggtattgctacgggaagatgttggcggaacaatcggcatgggagacggccaaagcaaaaggtgtggacttagtggtgctaaatccggttttggttctcggaccaccgctccagtcagcgatcaacgctagtctagtccatattctcaagtacctcaccggctcagccaagacctacgctaacttgactcaggtctacgtggacgtccgtgacgtggcactaggccatgttctggtctacgaagcaccctccgcctcaggccgttacatcctcgccgagaccgcacttcaccgcggagaggttgttgagattctggccaaattcttcccggagtatccacttcccaccaagtgttcggacgagaagaatccgagggctaagccatacaagtttactacccaaaagataaaagacttaggcttggaatttaaacccatcaagcaatctctttacgaatctgtcaagagcttgcaagagaaaggccatcttcctctacctcaagattcgaaccaaaacgaagtcatcatcgaatcttaggacacgatccacgaccctagaatctgatcatacctacatgaaaagctttattcttaagtaatacatacgttttgattttgactaaagtattgttaaatcttaaatcattatatatagctgattgttctttctttctttggttgtaattgagaatatgttacgcatatgtattatacgataatggaagcaatggttttat

SEQ ID NO: 2618 - protein, 1271 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ACTACTCTCTTAAGCCCTTTCATAACCTTGTAAACCATTAAGAGGCTTTGCTCAATTACAAGAAGAAGAAAAAATGCTTGTCGACGGGAAACTCGTCTGCGTCACCGGAGCCGGCGGCTACATTGCTTCTTGGATCGTTAAGTTACTCTTAGAGAGAGGCTACACCGTTAGAGGAACCGTAAGGAACCCAACTGATCCCAAGAACAACCATCTCAGAGAGCTTCAAGGAGCCAAGGAAAGACTCACTCTTCACAGTGCAGATCTTCTCGACTACGAAGCTCTCTGTGCCACAATCGACGGTTGCGATGGCGTTTTCCACACTGCCTCTCCGATGACCGACGATCCCGAGACAATGTTGGAGCCGGCGGTGAACGGAGCCAAGTTCGTGATTGACGCAGCGGCTAAAGCCAAGGTCAAGCGCGTGGTTTTCACGTCATCAATTGGTGCAGTTTACATGAACCCTAACCGTGACACTCAAGCCATTGTTGACGAAAACTGCTGGAGTGATCTTGATTTCTGCAAAAACACTAAGAATTGGTATTGCTACGGGAAGATGTTGGCGGAACAATCGGCATGGGAGACGGCCAAAGCAAAAGGTGTGGACTTAGTGGTGCTAAATCCGGTTTTGGTTCTCGGACCACCGCTCCAGTCAGCGATCAACGCTAGTCTAGTCCATATTCTCAAGTACCTCACCGGCTCAGCCAAGACCTACGCTAACTTGACTCAGGTCTACGTGGACGTCCGTGACGTGGCACTAGGCCATGTTCTGGTCTACGAAGCACCCTCCGCCTCAGGCCGTTACATCCTCGCCGAGACCGCACTTCACCGCGGAGAGGTTGTTGAGATTCTGGCCAAATTCTTCCCGGAGTATCCACTTCCCACCAAGTGTTCGGACGAGAAGAATCCGAGGGCTAAGCCATACAAGTTTACTACCCAAAAGATAAAAGACTTAGGCTTGGAATTTAAACCCATCAAGCAATCTCTTTACGAATCTGTCAAGAGCTTGCAAGAGAAAGGCCATCTTCCTCTACCTCAAGATTCGAACCAAAACGAAGTCATCATCGAATCTTAGGACACGATCCACGACCCTAGAATCTGATCATACCTACATGAAAAGCTTTATTCTTAAGTAATACATACGTTTTGATTTTGACTAAAGTATTGTTAAATCTTAAATCATTATATATAGCTGATTGTTCTTTCTTTCTTTGGTTGTAATTGAGAATATGTTACGCATATGTATTATACGATAATGGAAGCAATGGTTTTAT

SEQ ID NO: 2619 - DNA, 1405 bp, Arabidopsis thaliana
  misc_feature (1)..(1405): Ceres cDNA ID no. 13617796
  misc_feature (1)..(1405): Also known as  Ceres CDNA ID no. 23533084
attttcctattcttgaaaacacacaacacatctcatttctccgctgtttcgtcggcaaattttcccatttttgattccgaagataatagatattatcaacagaggataaggataaaacccagaacaatcattataatttagtggtgaagttgaccaaatttataaactgatccaattttaaaatctaagagatatggagaacatggacgatttctcaccggagaatgttttagcaccaccaccaccacctcctccaatgaagaagtcaacggatctgtttatgcaaagaagcaatagctttgtttctaaagctacgagagattcatgggatcgtatgttcgacgaagctcatggagctgatgttttgattcatactgatgataatggtttgatttacgcacattctaatgtcatcggaatggcttcagatgtaatcagaggaatgatgaagcaacataagagaaaatctcatcgtaaatcgatttcaatcctcggtgttcctcaccacgctcttcgagttttcattcgattcttatactcttcttgctatgagaaacaagatatggaggattttgcaatacatctacttgtgttatcacatgtctacgttgtaccgcatttgaagcgagtctgcgaatcagaattcgaaagtagtttgctcaacaaagagaatgtgattgatgtgtttcagctagctcttctatgtgatgctcctcgtctcggtcttctctgtcatagaatgattctaaacaactttgaagaagtttctacttctgaaggatggcaagcaatgaaagagagccatcctagacttcaaaaagagcttttacgctctgtcgcttacgagcttaatagcttgaagcaaagaaacaggaaacagaaggagatacagacttatacacagctctatgaagcaatggaggcttttgttcatatatgtagagatggatgcagagaaataggtccaacaaagaccgaaaccccgcatatgtcatgcggatttcaagcgtgtaatggtttagagcagctattgaaacatttggcgggatgcaaactaagatcaatccctggtggttgtagccgttgcaagagaatgtggcagcttcttgagcttcattcgcgcatttgcgtagactcggaacaatgcaaagtccctctttgcagtagtttgaaagagaggatgaagacacagagcaggaaagatgagaaaagatggaaacttttggtgaggaatgttttgagcaccaagagaattggaggatctccattctttttgcaagcaattgatgttactttatgagttatgacattattatttgattgcttttagatgtagaaattacatatttatacatgtacataggttgcagattctttgtaaagatagattcaaaattttcaaacc

SEQ ID NO: 2620 - protein, 1405 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ATTTTCCTATTCTTGAAAACACACAACACATCTCATTTCTCCGCTGTTTCGTCGGCAAATTTTCCCATTTTTGATTCCGAAGATAATAGATATTATCAACAGAGGATAAGGATAAAACCCAGAACAATCATTATAATTTAGTGGTGAAGTTGACCAAATTTATAAACTGATCCAATTTTAAAATCTAAGAGATATGGAGAACATGGACGATTTCTCACCGGAGAATGTTTTAGCACCACCACCACCACCTCCTCCAATGAAGAAGTCAACGGATCTGTTTATGCAAAGAAGCAATAGCTTTGTTTCTAAAGCTACGAGAGATTCATGGGATCGTATGTTCGACGAAGCTCATGGAGCTGATGTTTTGATTCATACTGATGATAATGGTTTGATTTACGCACATTCTAATGTCATCGGAATGGCTTCAGATGTAATCAGAGGAATGATGAAGCAACATAAGAGAAAATCTCATCGTAAATCGATTTCAATCCTCGGTGTTCCTCACCACGCTCTTCGAGTTTTCATTCGATTCTTATACTCTTCTTGCTATGAGAAACAAGATATGGAGGATTTTGCAATACATCTACTTGTGTTATCACATGTCTACGTTGTACCGCATTTGAAGCGAGTCTGCGAATCAGAATTCGAAAGTAGTTTGCTCAACAAAGAGAATGTGATTGATGTGTTTCAGCTAGCTCTTCTATGTGATGCTCCTCGTCTCGGTCTTCTCTGTCATAGAATGATTCTAAACAACTTTGAAGAAGTTTCTACTTCTGAAGGATGGCAAGCAATGAAAGAGAGCCATCCTAGACTTCAAAAAGAGCTTTTACGCTCTGTCGCTTACGAGCTTAATAGCTTGAAGCAAAGAAACAGGAAACAGAAGGAGATACAGACTTATACACAGCTCTATGAAGCAATGGAGGCTTTTGTTCATATATGTAGAGATGGATGCAGAGAAATAGGTCCAACAAAGACCGAAACCCCGCATATGTCATGCGGATTTCAAGCGTGTAATGGTTTAGAGCAGCTATTGAAACATTTGGCGGGATGCAAACTAAGATCAATCCCTGGTGGTTGTAGCCGTTGCAAGAGAATGTGGCAGCTTCTTGAGCTTCATTCGCGCATTTGCGTAGACTCGGAACAATGCAAAGTCCCTCTTTGCAGTAGTTTGAAAGAGAGGATGAAGACACAGAGCAGGAAAGATGAGAAAAGATGGAAACTTTTGGTGAGGAATGTTTTGAGCACCAAGAGAATTGGAGGATCTCCATTCTTTTTGCAAGCAATTGATGTTACTTTATGAGTTATGACATTATTATTTGATTGCTTTTAGATGTAGAAATTACATATTTATACATGTACATAGGTTGCAGATTCTTTGTAAAGATAGATTCAAAATTTTCAAACC

SEQ ID NO: 2621 - DNA, 3259 bp, Arabidopsis thaliana
  misc_feature (1)..(3259): Ceres cDNA ID no. 13618075
  misc_feature (1)..(3259): Also known as  Ceres CDNA ID no. 23533084
agaagtagatagagagaaaaataaagaagaagacagatgatacagagagagagagagagagatagttggcccagcggatcgacgtcgacgatgatgatgatgatgatcatttgattcttaagctaaaagctttcttcttcttctctctcccatcccatggagttcgtgatttagtctctcctcttagatttttctctctttccgctccttatttttagtattattatctcagcagaaaaacaaaaacacttttcatttctttatttttctttctcatttcgcataaatctttgtcgccgagacgatttgtgtctgagaaactgagaagaggaatgggagaaacagttcattgtggaagcttcttgtcctcaatgagggatctaagtgaagatatttccaatacttgtagctattcaatgtattgtggaggtgataaaactttgccttatgggcagtatcagaatggtttctcggcgagacctccaacggattcttacgagagagattttttgaaacaaacaatgcttgaacatgaagctgtatttaagaatcaggtttatgagcttcaccgtttgtatagaacacagaagagtttgatggctgaagttaagggaaagaactttgttgatcacttgaacaacaatgagcctacaccgggaagtgggattaaacgaggatttcttttcggaaactcgatatgtggcgaaggaagcacctctcaagattgcaatgttggcaaggacaacaaggtgttagaggttagacctgtcaaggttaggagaacaatgattgatcttcaacttcccgcagatgagtatctccatacagagggtgataatacgacttgtcctccttatgagcagtcaaaagaagttggtgaaaacatcttctttgaatctcatcggaacgattcttctggatcttctttgcttatgaagaactcaaatggatttactgacttgaacgagccagtccaatgccaagattcagtacctgtttcttcttcttccagggacttatattctctttatggagcaaacatttcacacgtgcaaggccagtgggtggaaaaaaatactagtcaaaatggatggatggttctagaagcagggaacggaaaaagcactccaagagacaagttatgcctgccttcccattcggtacaagttctttctaacagtgcatttcaacctctgggatacccttcaactgaccacagcaagttatcgggcgaaagagcatctttcaaatgtgaagttcgtcaaaggaatcctgaggtttcgtatgatagctatgtggaatcaagtgtggcatcaaatgttccaagcttgaatcatggatatcgcccggaatctgtcagaccttggagccattggatttcatcatgggagaaccgaagtagcagctcagttcagaaacctttgccacttcaagcgaatccattcttgacttttaatactcaagtacgagcagactcaagtgcagagatgagaagccgtgattctaacgggcttaaccaaggattctcttcattctcggaggaaagtgcctttaattttccatcagtaaactttaaccatcttaacaatggcccaaaaggggcagttactaatggttctttgtgtgagagtgtgatgcatcagagtcttaaaaaccttcaaggaccaaaaaagcaggagtgctcttctggtttgccctggataaaacctaagccccttaacaaaaatggaaaaaccaatggtggtttggatttgaatgcttctgcaaatcatcaattcatggatgaacgtgatatgggtgacagctcaaattatgtacatcctcagaatggtttgaggtctgttacatgttctaatgacgccaacttgagacatgttgaaatggccaattcacagagtcgtagaaagattcttggttttcctatctctcagaagctttctatttgcgaggagcacccttcccttataacttcttctgtgtgtatctctaatgaacccaagaaagtaaacaacttggtgaagataaacctcgatatcaacctgccatgtgaagcctcggtttctgaaggagttgttgtggacaaggaagaaggtaataaagctgccactcacaggcagcacattgacttgaatttctgtgctagcgaggatgaagattccggcttctgttctaatccaagagtggaaacaaaagcaactactttgataaatgtggaagctcccttgacgcttgagagtgaagaagaaggagggaaatttccagagaagagagatgaagctggagactctgtggatgaactcatcgaggcagcagcagaagctatagtcactatctcactgtcttatcattgccgcaatactgatgaagctgcttcctcttcgactgatgcagttgacaaggagccgctctcttggtttgtgaacacaatagcttcttgtggcaatgatttagagagcaaaattgatgcttgtttggaagccagagactgtgaaggctgccgtgaagaatgttcttcaggtgagtttgattattttgaggcaatgaccctgaacttaacacagaccaaagaagaagactacatgccaaagcctttaatccctgaatatctgaaatttgatgggacgggttctatgggtatcacaagtaataggccaagaagaggacaagcgagacgaggaagaccaaagcgggatttccaaagggatattctccctgggctagcttctctgtctaggctcgaagtaaccgaagatcttcagatgtttgggggacttatgaaagccacaggctacaactggaactcaggaatggcccgaaggagctcaaaccgaggaagaaaacgactggtcagcaacattgacagagctccggtttgctcctctttggcacagccaatgaataacagtagtgtacaaatggtgggactggaagataggagccttacagggtggggaaatgcaaccagaagaccaaggcgacataggtgccctgcaggtactcccccaacagtgctattaacataaagcttttcgaaataaatccgatttcacaatttgaggaacattatagagggaaaagaaccagagcaagtaacaatggacaaaaactgattttcagcgatcgatgttttattattgtcaatcaaccccatgtttgtgggtgttggttgctctttgtatatcttgtcctctcttataagggccaaagaaaagaaaacacatgattggttatcattacaaaatctgcatctctgttttct

SEQ ID NO: 2622 - protein, 3259 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
AGAAGTAGATAGAGAGAAAAATAAAGAAGAAGACAGATGATACAGAGAGAGAGAGAGAGAGATAGTTGGCCCAGCGGATCGACGTCGACGATGATGATGATGATGATCATTTGATTCTTAAGCTAAAAGCTTTCTTCTTCTTCTCTCTCCCATCCCATGGAGTTCGTGATTTAGTCTCTCCTCTTAGATTTTTCTCTCTTTCCGCTCCTTATTTTTAGTATTATTATCTCAGCAGAAAAACAAAAACACTTTTCATTTCTTTATTTTTCTTTCTCATTTCGCATAAATCTTTGTCGCCGAGACGATTTGTGTCTGAGAAACTGAGAAGAGGAATGGGAGAAACAGTTCATTGTGGAAGCTTCTTGTCCTCAATGAGGGATCTAAGTGAAGATATTTCCAATACTTGTAGCTATTCAATGTATTGTGGAGGTGATAAAACTTTGCCTTATGGGCAGTATCAGAATGGTTTCTCGGCGAGACCTCCAACGGATTCTTACGAGAGAGATTTTTTGAAACAAACAATGCTTGAACATGAAGCTGTATTTAAGAATCAGGTTTATGAGCTTCACCGTTTGTATAGAACACAGAAGAGTTTGATGGCTGAAGTTAAGGGAAAGAACTTTGTTGATCACTTGAACAACAATGAGCCTACACCGGGAAGTGGGATTAAACGAGGATTTCTTTTCGGAAACTCGATATGTGGCGAAGGAAGCACCTCTCAAGATTGCAATGTTGGCAAGGACAACAAGGTGTTAGAGGTTAGACCTGTCAAGGTTAGGAGAACAATGATTGATCTTCAACTTCCCGCAGATGAGTATCTCCATACAGAGGGTGATAATACGACTTGTCCTCCTTATGAGCAGTCAAAAGAAGTTGGTGAAAACATCTTCTTTGAATCTCATCGGAACGATTCTTCTGGATCTTCTTTGCTTATGAAGAACTCAAATGGATTTACTGACTTGAACGAGCCAGTCCAATGCCAAGATTCAGTACCTGTTTCTTCTTCTTCCAGGGACTTATATTCTCTTTATGGAGCAAACATTTCACACGTGCAAGGCCAGTGGGTGGAAAAAAATACTAGTCAAAATGGATGGATGGTTCTAGAAGCAGGGAACGGAAAAAGCACTCCAAGAGACAAGTTATGCCTGCCTTCCCATTCGGTACAAGTTCTTTCTAACAGTGCATTTCAACCTCTGGGATACCCTTCAACTGACCACAGCAAGTTATCGGGCGAAAGAGCATCTTTCAAATGTGAAGTTCGTCAAAGGAATCCTGAGGTTTCGTATGATAGCTATGTGGAATCAAGTGTGGCATCAAATGTTCCAAGCTTGAATCATGGATATCGCCCGGAATCTGTCAGACCTTGGAGCCATTGGATTTCATCATGGGAGAACCGAAGTAGCAGCTCAGTTCAGAAACCTTTGCCACTTCAAGCGAATCCATTCTTGACTTTTAATACTCAAGTACGAGCAGACTCAAGTGCAGAGATGAGAAGCCGTGATTCTAACGGGCTTAACCAAGGATTCTCTTCATTCTCGGAGGAAAGTGCCTTTAATTTTCCATCAGTAAACTTTAACCATCTTAACAATGGCCCAAAAGGGGCAGTTACTAATGGTTCTTTGTGTGAGAGTGTGATGCATCAGAGTCTTAAAAACCTTCAAGGACCAAAAAAGCAGGAGTGCTCTTCTGGTTTGCCCTGGATAAAACCTAAGCCCCTTAACAAAAATGGAAAAACCAATGGTGGTTTGGATTTGAATGCTTCTGCAAATCATCAATTCATGGATGAACGTGATATGGGTGACAGCTCAAATTATGTACATCCTCAGAATGGTTTGAGGTCTGTTACATGTTCTAATGACGCCAACTTGAGACATGTTGAAATGGCCAATTCACAGAGTCGTAGAAAGATTCTTGGTTTTCCTATCTCTCAGAAGCTTTCTATTTGCGAGGAGCACCCTTCCCTTATAACTTCTTCTGTGTGTATCTCTAATGAACCCAAGAAAGTAAACAACTTGGTGAAGATAAACCTCGATATCAACCTGCCATGTGAAGCCTCGGTTTCTGAAGGAGTTGTTGTGGACAAGGAAGAAGGTAATAAAGCTGCCACTCACAGGCAGCACATTGACTTGAATTTCTGTGCTAGCGAGGATGAAGATTCCGGCTTCTGTTCTAATCCAAGAGTGGAAACAAAAGCAACTACTTTGATAAATGTGGAAGCTCCCTTGACGCTTGAGAGTGAAGAAGAAGGAGGGAAATTTCCAGAGAAGAGAGATGAAGCTGGAGACTCTGTGGATGAACTCATCGAGGCAGCAGCAGAAGCTATAGTCACTATCTCACTGTCTTATCATTGCCGCAATACTGATGAAGCTGCTTCCTCTTCGACTGATGCAGTTGACAAGGAGCCGCTCTCTTGGTTTGTGAACACAATAGCTTCTTGTGGCAATGATTTAGAGAGCAAAATTGATGCTTGTTTGGAAGCCAGAGACTGTGAAGGCTGCCGTGAAGAATGTTCTTCAGGTGAGTTTGATTATTTTGAGGCAATGACCCTGAACTTAACACAGACCAAAGAAGAAGACTACATGCCAAAGCCTTTAATCCCTGAATATCTGAAATTTGATGGGACGGGTTCTATGGGTATCACAAGTAATAGGCCAAGAAGAGGACAAGCGAGACGAGGAAGACCAAAGCGGGATTTCCAAAGGGATATTCTCCCTGGGCTAGCTTCTCTGTCTAGGCTCGAAGTAACCGAAGATCTTCAGATGTTTGGGGGACTTATGAAAGCCACAGGCTACAACTGGAACTCAGGAATGGCCCGAAGGAGCTCAAACCGAGGAAGAAAACGACTGGTCAGCAACATTGACAGAGCTCCGGTTTGCTCCTCTTTGGCACAGCCAATGAATAACAGTAGTGTACAAATGGTGGGACTGGAAGATAGGAGCCTTACAGGGTGGGGAAATGCAACCAGAAGACCAAGGCGACATAGGTGCCCTGCAGGTACTCCCCCAACAGTGCTATTAACATAAAGCTTTTCGAAATAAATCCGATTTCACAATTTGAGGAACATTATAGAGGGAAAAGAACCAGAGCAAGTAACAATGGACAAAAACTGATTTTCAGCGATCGATGTTTTATTATTGTCAATCAACCCCATGTTTGTGGGTGTTGGTTGCTCTTTGTATATCTTGTCCTCTCTTATAAGGGCCAAAGAAAAGAAAACACATGATTGGTTATCATTACAAAATCTGCATCTCTGTTTTCT

SEQ ID NO: 2623 - DNA, 1395 bp, Arabidopsis thaliana
  misc_feature (1)..(1395): Ceres cDNA ID no. 13618158
  misc_feature (1)..(1395): Also known as  Ceres CDNA ID no. 23533084
tttcaactcaaatagcttcacagttttactaatctctctcatcttcttcccaacatcaaagaagacctttacttctggttagaatagaccaagaacactgagtacgacaaagaaccatgatgaatctttcttctcgtcgcgcctcttccactctcacattgagcttcactgttctccttttagcttccacaggttcgtatggctcaacattcacattcgctaatcggtgcggctacaccgtatggcctggaatcctatcgaatgctggctcacctactctctccaccaccggatttgagctccctaaaggcacctctcgctctctccaagctcccaccggttggtccggtcgattctgggctcgtaccggttgcaagttcgacagttctggctccggtacatgcaaaaccggtgactgcggctccaacgctgtcgaatgcgccgggcttggtgccgcaccgcctgtaactctcgcggagttcactctaggcactggcggcgatgatttctacgacgttagtctcgtcgacggttacaacattccgatgatagttgaagtcgccggtggatctgggcagtgcgcttctaccggatgcactacggatcttaacattcagtgccctgctgagctgcgtttcggcgacggagacgcttgcaaaagcgcgtgtttagcgtttcggagtcctgaatactgttgcagcggcgcgtatgctacaccttctagttgtcggccttccgtgtattcggagatgtttaaagccgcgtgtcctcgctcctatagctacgcttacgacgatgctacgagcactttcacttgcgccggtggagattatacggtgacgttttgcccttcttcccctagtcaaaaatcgactagctactcccctccagtgacagactcgtcgtcgacctcacaaggttccgatcctgtgcctggttctgatactggttacgctggtcagggtcaacagactccaggtcaaggtaatgtgtacgggtcacaggggactgggtcggagatgggtacgggtgagaccatgttacaagacggatcatggatggctggtttggccatgggagaggcaagcagaccagccggcgtttcattgacagtgctgcttgctgcatttacttttccgtttattttctcgtagcatcatcgtctttagatttggtagtcgttttgttagcattgcctttgtttagtttttgttgatactcgatgattatcgcttaagactgcgacaatttgggttttaggcttttagggttttgcattgtagctttgtcgtgtacgcgcgtgtttgcttgtatcatctgtcattgaagattgtttatcatgttcgaaattgtgagatatgctttgtgatttaaagaaagatcttttgtggcttt

SEQ ID NO: 2624 - protein, 1395 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
TTTCAACTCAAATAGCTTCACAGTTTTACTAATCTCTCTCATCTTCTTCCCAACATCAAAGAAGACCTTTACTTCTGGTTAGAATAGACCAAGAACACTGAGTACGACAAAGAACCATGATGAATCTTTCTTCTCGTCGCGCCTCTTCCACTCTCACATTGAGCTTCACTGTTCTCCTTTTAGCTTCCACAGGTTCGTATGGCTCAACATTCACATTCGCTAATCGGTGCGGCTACACCGTATGGCCTGGAATCCTATCGAATGCTGGCTCACCTACTCTCTCCACCACCGGATTTGAGCTCCCTAAAGGCACCTCTCGCTCTCTCCAAGCTCCCACCGGTTGGTCCGGTCGATTCTGGGCTCGTACCGGTTGCAAGTTCGACAGTTCTGGCTCCGGTACATGCAAAACCGGTGACTGCGGCTCCAACGCTGTCGAATGCGCCGGGCTTGGTGCCGCACCGCCTGTAACTCTCGCGGAGTTCACTCTAGGCACTGGCGGCGATGATTTCTACGACGTTAGTCTCGTCGACGGTTACAACATTCCGATGATAGTTGAAGTCGCCGGTGGATCTGGGCAGTGCGCTTCTACCGGATGCACTACGGATCTTAACATTCAGTGCCCTGCTGAGCTGCGTTTCGGCGACGGAGACGCTTGCAAAAGCGCGTGTTTAGCGTTTCGGAGTCCTGAATACTGTTGCAGCGGCGCGTATGCTACACCTTCTAGTTGTCGGCCTTCCGTGTATTCGGAGATGTTTAAAGCCGCGTGTCCTCGCTCCTATAGCTACGCTTACGACGATGCTACGAGCACTTTCACTTGCGCCGGTGGAGATTATACGGTGACGTTTTGCCCTTCTTCCCCTAGTCAAAAATCGACTAGCTACTCCCCTCCAGTGACAGACTCGTCGTCGACCTCACAAGGTTCCGATCCTGTGCCTGGTTCTGATACTGGTTACGCTGGTCAGGGTCAACAGACTCCAGGTCAAGGTAATGTGTACGGGTCACAGGGGACTGGGTCGGAGATGGGTACGGGTGAGACCATGTTACAAGACGGATCATGGATGGCTGGTTTGGCCATGGGAGAGGCAAGCAGACCAGCCGGCGTTTCATTGACAGTGCTGCTTGCTGCATTTACTTTTCCGTTTATTTTCTCGTAGCATCATCGTCTTTAGATTTGGTAGTCGTTTTGTTAGCATTGCCTTTGTTTAGTTTTTGTTGATACTCGATGATTATCGCTTAAGACTGCGACAATTTGGGTTTTAGGCTTTTAGGGTTTTGCATTGTAGCTTTGTCGTGTACGCGCGTGTTTGCTTGTATCATCTGTCATTGAAGATTGTTTATCATGTTCGAAATTGTGAGATATGCTTTGTGATTTAAAGAAAGATCTTTTGTGGCTTT

SEQ ID NO: 2625 - DNA, 1444 bp, Arabidopsis thaliana
  misc_feature (1)..(1444): Ceres cDNA ID no. 13618166
  misc_feature (1)..(1444): Also known as  Ceres CDNA ID no. 23533084
aagggtggtgtcataagcgtttactgtgagtctctcaaagaaaccaaaggcagagaaaagagataacacacacaaaaaaaaatggcatcaacctcactcctcaaggcttctccggtgttggacaaatccgaatgggtcaagggacaaagcgttctcttccgtcagccttcttccgcttctgtcgtcctccgcaaccgtgccacctccctcaccgtccgtgccgcttcctcctacgccgatgagcttgttaagacagcgaaaactattgcgtctcccggacgtggaatcttggcgatggacgagtcaaacgcgacttgcgggaaacgtttggattcgatagggctagagaacactgaggcaaatcgtcaagctttccggactttgctggtctctgcaccgggactcggacagtacgtctccggcgcaattctatttgaggagactctgtaccagtctaccaccgaaggcaagaaaatggtcgacgtcctcgtcgagcagaacattgtccctggtatcaaagtcgacaagggtttggtgccacttgttggatccaacaatgagtcatggtgccaaggactagatggtctatcatctcgaactgctgcttactatcaacagggtgcgcgtttcgccaaatggcgtactgtcgtgagcattcctaacggtccgtctgccctcgccgtcaaagaagctgcttggggtcttgctcgatacgctgccatttcacaggacagcggtttggttccgattgttgagccagagatcttgttggatggagaacacgacattgacagaacatacgacgtagcagagaaggtttgggctgaggttttcttttaccttgctcagaacaatgtcatgtttgaaggtatcctcctaaaaccgagcatggtgactcccggagctgagtctaaagacagagctactcctgaacaagttgccgcctacaccctcaagctcctccgcaacagagtccctcccgcagtccccggaatcatgtttttgtccggaggacagtcggaggtggaggcaacactcaacttgaacgcaatgaaccaggcaccaaacccatggcacgtgtccttctcctacgcacgtgcgttgcagaacacttgtctgaaaacatggggcggcagacccgagaacgtgaacgcagctcagaccactctcttggcccgtgccaaggccaattcgttggctcagctcggaaaatacaccggtgagggtgagtccgaagaggctaaggagggcatgttcgtcaaagggtacacctattgaagagatgatgctgtgaaaaaagagatgaagcagatgttttaatcacatttgtttttgagtttgcttgttattaatcatgtcaaatcattattttctctgcttactttgcgttagctactccttttaataagttctattatattgaagttatctatctctcttgatc

SEQ ID NO: 2626 - protein, 1444 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
AAGGGTGGTGTCATAAGCGTTTACTGTGAGTCTCTCAAAGAAACCAAAGGCAGAGAAAAGAGATAACACACACAAAAAAAAATGGCATCAACCTCACTCCTCAAGGCTTCTCCGGTGTTGGACAAATCCGAATGGGTCAAGGGACAAAGCGTTCTCTTCCGTCAGCCTTCTTCCGCTTCTGTCGTCCTCCGCAACCGTGCCACCTCCCTCACCGTCCGTGCCGCTTCCTCCTACGCCGATGAGCTTGTTAAGACAGCGAAAACTATTGCGTCTCCCGGACGTGGAATCTTGGCGATGGACGAGTCAAACGCGACTTGCGGGAAACGTTTGGATTCGATAGGGCTAGAGAACACTGAGGCAAATCGTCAAGCTTTCCGGACTTTGCTGGTCTCTGCACCGGGACTCGGACAGTACGTCTCCGGCGCAATTCTATTTGAGGAGACTCTGTACCAGTCTACCACCGAAGGCAAGAAAATGGTCGACGTCCTCGTCGAGCAGAACATTGTCCCTGGTATCAAAGTCGACAAGGGTTTGGTGCCACTTGTTGGATCCAACAATGAGTCATGGTGCCAAGGACTAGATGGTCTATCATCTCGAACTGCTGCTTACTATCAACAGGGTGCGCGTTTCGCCAAATGGCGTACTGTCGTGAGCATTCCTAACGGTCCGTCTGCCCTCGCCGTCAAAGAAGCTGCTTGGGGTCTTGCTCGATACGCTGCCATTTCACAGGACAGCGGTTTGGTTCCGATTGTTGAGCCAGAGATCTTGTTGGATGGAGAACACGACATTGACAGAACATACGACGTAGCAGAGAAGGTTTGGGCTGAGGTTTTCTTTTACCTTGCTCAGAACAATGTCATGTTTGAAGGTATCCTCCTAAAACCGAGCATGGTGACTCCCGGAGCTGAGTCTAAAGACAGAGCTACTCCTGAACAAGTTGCCGCCTACACCCTCAAGCTCCTCCGCAACAGAGTCCCTCCCGCAGTCCCCGGAATCATGTTTTTGTCCGGAGGACAGTCGGAGGTGGAGGCAACACTCAACTTGAACGCAATGAACCAGGCACCAAACCCATGGCACGTGTCCTTCTCCTACGCACGTGCGTTGCAGAACACTTGTCTGAAAACATGGGGCGGCAGACCCGAGAACGTGAACGCAGCTCAGACCACTCTCTTGGCCCGTGCCAAGGCCAATTCGTTGGCTCAGCTCGGAAAATACACCGGTGAGGGTGAGTCCGAAGAGGCTAAGGAGGGCATGTTCGTCAAAGGGTACACCTATTGAAGAGATGATGCTGTGAAAAAAGAGATGAAGCAGATGTTTTAATCACATTTGTTTTTGAGTTTGCTTGTTATTAATCATGTCAAATCATTATTTTCTCTGCTTACTTTGCGTTAGCTACTCCTTTTAATAAGTTCTATTATATTGAAGTTATCTATCTCTCTTGATC

SEQ ID NO: 2627 - DNA, 1358 bp, Arabidopsis thaliana
  misc_feature (1)..(1358): Ceres cDNA ID no. 13618192
  misc_feature (1)..(1358): Also known as  Ceres CDNA ID no. 23533084
aagttcataactgaaaaataaaaataagacagaaaacaaagttaaaaataaaataaaaacggaagagagaaaataaataaataaaatcactcaaaggatttccacagtttttctttccatgttgatttagcccattcgtagacttcctccgcgccgccgttagacgccgcctcggaagtatcagcaaccgccgtggtgttcgtcgccttcaaaggctcgtttctctcctctctctgagatctgaatttgagatgtttaaaaaaatgagtgctactacaagcaagacggatcagaaagcggcattagacattgcatcatggctattcaatgtggttacttccgttggaatcatcctcgttaacaaagctttaatggctacttatggctttagtttcgctactacattaaccggtttgcatttcggaacaacgacattgttgacaactttcttgacatggcttggttatatccaaccttctcagcttccttggcctgatcttttgaaattcgttttgttcgctaacttctctatcgttgggatgaacgtcagtctcatgtggaattctgttggcttctaccagattgcgaagctgagtatgatcccggtttcttgtcttctagaagttatgcttgacaatgtcaggtattcaagagatacaaagcttagcattttgttagttcttgctggtgttgccgtctgtactgtaaccgatgttagtgtcaatctcaacggatttctagctgccgctattgctgtctggagcaccgcgcttcagcaatactatgtacattatctacaacggaaatattcactcggttctttcaatttactggcgcataccgctccagttcaagctgcgtcattgttgttggtcggaccatttctagactactggttgactaaccaaagagtggatgcatacaacttttcatttgtatctctgttcttcttaatactctcgtgcagtatcgcggttgggaccaatctcagccaattcatctgtattggaagattcacggcggtgtctttccaagtacttggtcacatgaagacaattctggttttggttttgggattcactttcttcggtaaggaaggattaaacctacaagtagtgcttggaatgctgattgctatactcggtatgatctggtacggtaatgcatcttctaaaccgggtggtaaagaacgtcgtagcctgtctattcccataaccaagtcacagaaactatctgaaacaaacgaatctgatgaaaaggtgtagaagaaagaagtgaatcgcattgacatagaaacaaaaacaagatactcagatacaaacaggtagagttatcaaatgggatattatttataaacc

SEQ ID NO: 2628 - protein, 1358 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
AAGTTCATAACTGAAAAATAAAAATAAGACAGAAAACAAAGTTAAAAATAAAATAAAAACGGAAGAGAGAAAATAAATAAATAAAATCACTCAAAGGATTTCCACAGTTTTTCTTTCCATGTTGATTTAGCCCATTCGTAGACTTCCTCCGCGCCGCCGTTAGACGCCGCCTCGGAAGTATCAGCAACCGCCGTGGTGTTCGTCGCCTTCAAAGGCTCGTTTCTCTCCTCTCTCTGAGATCTGAATTTGAGATGTTTAAAAAAATGAGTGCTACTACAAGCAAGACGGATCAGAAAGCGGCATTAGACATTGCATCATGGCTATTCAATGTGGTTACTTCCGTTGGAATCATCCTCGTTAACAAAGCTTTAATGGCTACTTATGGCTTTAGTTTCGCTACTACATTAACCGGTTTGCATTTCGGAACAACGACATTGTTGACAACTTTCTTGACATGGCTTGGTTATATCCAACCTTCTCAGCTTCCTTGGCCTGATCTTTTGAAATTCGTTTTGTTCGCTAACTTCTCTATCGTTGGGATGAACGTCAGTCTCATGTGGAATTCTGTTGGCTTCTACCAGATTGCGAAGCTGAGTATGATCCCGGTTTCTTGTCTTCTAGAAGTTATGCTTGACAATGTCAGGTATTCAAGAGATACAAAGCTTAGCATTTTGTTAGTTCTTGCTGGTGTTGCCGTCTGTACTGTAACCGATGTTAGTGTCAATCTCAACGGATTTCTAGCTGCCGCTATTGCTGTCTGGAGCACCGCGCTTCAGCAATACTATGTACATTATCTACAACGGAAATATTCACTCGGTTCTTTCAATTTACTGGCGCATACCGCTCCAGTTCAAGCTGCGTCATTGTTGTTGGTCGGACCATTTCTAGACTACTGGTTGACTAACCAAAGAGTGGATGCATACAACTTTTCATTTGTATCTCTGTTCTTCTTAATACTCTCGTGCAGTATCGCGGTTGGGACCAATCTCAGCCAATTCATCTGTATTGGAAGATTCACGGCGGTGTCTTTCCAAGTACTTGGTCACATGAAGACAATTCTGGTTTTGGTTTTGGGATTCACTTTCTTCGGTAAGGAAGGATTAAACCTACAAGTAGTGCTTGGAATGCTGATTGCTATACTCGGTATGATCTGGTACGGTAATGCATCTTCTAAACCGGGTGGTAAAGAACGTCGTAGCCTGTCTATTCCCATAACCAAGTCACAGAAACTATCTGAAACAAACGAATCTGATGAAAAGGTGTAGAAGAAAGAAGTGAATCGCATTGACATAGAAACAAAAACAAGATACTCAGATACAAACAGGTAGAGTTATCAAATGGGATATTATTTATAAACC

SEQ ID NO: 2629 - DNA, 1094 bp, Arabidopsis thaliana
  misc_feature (1)..(1094): Ceres cDNA ID no. 13618200
  misc_feature (1)..(1094): Also known as  Ceres CDNA ID no. 23533084
gaaagagtctctgcctctcaagctccgccgtcggggaaaaaagaatatggaagcagctactgttcagaggtttcagtactcatcatggaatgatttgagaaattttgaagggaagcctcgtggttctctgaggtataatacacagcgaattaaggaagataaaaggtttagagttgttgctttaactcttgacaaaagaagggatcatcgacttagatcagtttctgataagaactcctcagcattgttggaaactggaagtcttcttcattctccatttgatgaagaacaacagattttgaagaaaaaagctgaagaggttaaaccgtatttaaatggacgatcgatgtatcttgttggtatgatgggttccgggaaaacgactgtagggaagattatggcaagatcgcttggttatacattctttgattgtgacactttgatcgagcaggctatgaagggaacttctgtagctgagatatttgagcatttcggtgagagtgtcttcagagaaaaagagactgaagcgttaaagaaactctctttgatgtaccaccaagttgttgtttcaaccgggggaggggcagttataagacccatcaattggaagtacatgcataaaggtattagtatttggcttgatgtacctctagaagccttagcgcatagaatagctgctgtaggaactggttcaagaccattgctacatgatgatgagtcaggggacacatacacagcggctttaaaccgtctttcaacgatttgggatgcacgtggtgaagcatacactaaagccagcgcaagagtttccttggagaatattactttgaagctcggttatagaagtgtctcagatcttacaccagctgaaatcgccattgaggcctttgagcaagttcagagctatttagagaaagaagatggtatggctagaccagatggactctagttccagaaagttatgtttccccgcaacatctcatgaatttgtgcctagttttgaatgttgtatataaatgaataatactctgtttgagcacattgtcttcttttcaaattgacccaaaaaatgaaaaggagccatttgcattttt

SEQ ID NO: 2630 - protein, 1094 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
GAAAGAGTCTCTGCCTCTCAAGCTCCGCCGTCGGGGAAAAAAGAATATGGAAGCAGCTACTGTTCAGAGGTTTCAGTACTCATCATGGAATGATTTGAGAAATTTTGAAGGGAAGCCTCGTGGTTCTCTGAGGTATAATACACAGCGAATTAAGGAAGATAAAAGGTTTAGAGTTGTTGCTTTAACTCTTGACAAAAGAAGGGATCATCGACTTAGATCAGTTTCTGATAAGAACTCCTCAGCATTGTTGGAAACTGGAAGTCTTCTTCATTCTCCATTTGATGAAGAACAACAGATTTTGAAGAAAAAAGCTGAAGAGGTTAAACCGTATTTAAATGGACGATCGATGTATCTTGTTGGTATGATGGGTTCCGGGAAAACGACTGTAGGGAAGATTATGGCAAGATCGCTTGGTTATACATTCTTTGATTGTGACACTTTGATCGAGCAGGCTATGAAGGGAACTTCTGTAGCTGAGATATTTGAGCATTTCGGTGAGAGTGTCTTCAGAGAAAAAGAGACTGAAGCGTTAAAGAAACTCTCTTTGATGTACCACCAAGTTGTTGTTTCAACCGGGGGAGGGGCAGTTATAAGACCCATCAATTGGAAGTACATGCATAAAGGTATTAGTATTTGGCTTGATGTACCTCTAGAAGCCTTAGCGCATAGAATAGCTGCTGTAGGAACTGGTTCAAGACCATTGCTACATGATGATGAGTCAGGGGACACATACACAGCGGCTTTAAACCGTCTTTCAACGATTTGGGATGCACGTGGTGAAGCATACACTAAAGCCAGCGCAAGAGTTTCCTTGGAGAATATTACTTTGAAGCTCGGTTATAGAAGTGTCTCAGATCTTACACCAGCTGAAATCGCCATTGAGGCCTTTGAGCAAGTTCAGAGCTATTTAGAGAAAGAAGATGGTATGGCTAGACCAGATGGACTCTAGTTCCAGAAAGTTATGTTTCCCCGCAACATCTCATGAATTTGTGCCTAGTTTTGAATGTTGTATATAAATGAATAATACTCTGTTTGAGCACATTGTCTTCTTTTCAAATTGACCCAAAAAATGAAAAGGAGCCATTTGCATTTTT

SEQ ID NO: 2631 - DNA, 1287 bp, Arabidopsis thaliana
  misc_feature (1)..(1287): Ceres cDNA ID no. 13618274
  misc_feature (1)..(1287): Also known as  Ceres CDNA ID no. 23533084
agtttcaatcaaattctgttttcttcatctccacaaagataactaaatccgatctcgtcttcgcaatcatcaaccatcaatggaagttgaagaagaagttaaacaaatcatagatgaggtcaaagagcttcatgactccgccgcttctttcatctcatcttcttctcaacaagagctctctctccgtcaaaaagcctccgccgttgattcctctatccgtcgtctccactctactatcgtctccaacaaaaatctcgatcctaagctcgtcgaaaagcttgaggaagatctgcatcgtgctagatgcatgcttgttgacggagaaacatcttcatttctcccatccaaaccacaaggacgctttgtgagaatgttttgtggacctgtgaatgttcgagctttgcgtaaagatgttcagcttaaagttaaagaagaatacaatcgttacagagacaagactgctcttctttttctttttttccctgccacacttttaatccttaggtcttattattggggtggatgtttgcctgcgtttcctgtccagctctatgaggcttggctgttgtttctctatgctgggttggctatgcgtgagaatatattaagagctaacggaagcgatattcgtccatggtggctatatcatcattattgtgccatggctatggcccttgtcagcctcacatgggaaatcaaaggtcaaccaaactgtgtccagaaacagagaggagtccatcttttcctacaatgggctatgatgcaaggtgtcgccatgcttttacaaaacagatatcaacgccaaagattatacactcgcattgcactaggaaaggctaagagaatggatgttgtttggggagaaacggctggagttgatggacaactatggctgttatgtcctatactgttcattttacaggtgtttgaagcatacgttggactgctgttgctaagaaaaacagtaactggagttgttaatgaatggcaggtgatggtttgtgggattcttctggtagtgatggcagttgggaacttcataaatacagtagagacactgatggcaaagtcaagagttaaggcaaagatgaagagaagtaaaagcagagcagagcttaattagacttcacaggtctctcatctgttcaaaatcttgctttttttgcagttcataaatttttgtcctttttgtttttaggccacggataaaataaaactgtgaccatcctttttctgtgtaaatggaagtggcagttgatatttgataattgatgttgtatttgtaca

SEQ ID NO: 2632 - protein, 1287 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
AGTTTCAATCAAATTCTGTTTTCTTCATCTCCACAAAGATAACTAAATCCGATCTCGTCTTCGCAATCATCAACCATCAATGGAAGTTGAAGAAGAAGTTAAACAAATCATAGATGAGGTCAAAGAGCTTCATGACTCCGCCGCTTCTTTCATCTCATCTTCTTCTCAACAAGAGCTCTCTCTCCGTCAAAAAGCCTCCGCCGTTGATTCCTCTATCCGTCGTCTCCACTCTACTATCGTCTCCAACAAAAATCTCGATCCTAAGCTCGTCGAAAAGCTTGAGGAAGATCTGCATCGTGCTAGATGCATGCTTGTTGACGGAGAAACATCTTCATTTCTCCCATCCAAACCACAAGGACGCTTTGTGAGAATGTTTTGTGGACCTGTGAATGTTCGAGCTTTGCGTAAAGATGTTCAGCTTAAAGTTAAAGAAGAATACAATCGTTACAGAGACAAGACTGCTCTTCTTTTTCTTTTTTTCCCTGCCACACTTTTAATCCTTAGGTCTTATTATTGGGGTGGATGTTTGCCTGCGTTTCCTGTCCAGCTCTATGAGGCTTGGCTGTTGTTTCTCTATGCTGGGTTGGCTATGCGTGAGAATATATTAAGAGCTAACGGAAGCGATATTCGTCCATGGTGGCTATATCATCATTATTGTGCCATGGCTATGGCCCTTGTCAGCCTCACATGGGAAATCAAAGGTCAACCAAACTGTGTCCAGAAACAGAGAGGAGTCCATCTTTTCCTACAATGGGCTATGATGCAAGGTGTCGCCATGCTTTTACAAAACAGATATCAACGCCAAAGATTATACACTCGCATTGCACTAGGAAAGGCTAAGAGAATGGATGTTGTTTGGGGAGAAACGGCTGGAGTTGATGGACAACTATGGCTGTTATGTCCTATACTGTTCATTTTACAGGTGTTTGAAGCATACGTTGGACTGCTGTTGCTAAGAAAAACAGTAACTGGAGTTGTTAATGAATGGCAGGTGATGGTTTGTGGGATTCTTCTGGTAGTGATGGCAGTTGGGAACTTCATAAATACAGTAGAGACACTGATGGCAAAGTCAAGAGTTAAGGCAAAGATGAAGAGAAGTAAAAGCAGAGCAGAGCTTAATTAGACTTCACAGGTCTCTCATCTGTTCAAAATCTTGCTTTTTTTGCAGTTCATAAATTTTTGTCCTTTTTGTTTTTAGGCCACGGATAAAATAAAACTGTGACCATCCTTTTTCTGTGTAAATGGAAGTGGCAGTTGATATTTGATAATTGATGTTGTATTTGTACA

SEQ ID NO: 2633 - DNA, 1090 bp, Arabidopsis thaliana
  misc_feature (1)..(1090): Ceres cDNA ID no. 13618451
  misc_feature (1)..(1090): Also known as  Ceres CDNA ID no. 23533084
aaaaagaaaaaagactacatttctacaaggacgttggttcttttagtcgtcgtcggtcgtcgaagaaagatcttctccttctttcttcgccgtacgatcgtcgtctaatgggagaatcatcaaatccaatggctacaagttcttcttcctcctcctcctcaattcctccttcgtctccaacaccctctccgacgtccacaaccactccgccacgtcaacatcctctcctccagccaccatcttcaaaaaagaagaaaaacagaacaaacgttttcagagtcttacgcaccgtgtttcgatctttcccaatctttacaacaccatccgtagcatgcaaaatcccggttatacatcccggtttaggcttaccggatccacatcacaacacgtcaagaatcaccggaacgttattcggataccgtaaaggccgagtaagtctttccattcaagaaaaccctaaatgtttaccttctttagtcgtggagctcgccatgcaaaccacaacgcttcaaaaagagctaagcacgggaatggtgagaatagctctcgagactgagaaacagcctcgagctgataataacaattctaaaaccgagaagaagacagatattttggaagaaccgttatggacaatgtattgtaaaggagagaaaacgggttacggtgtgaaacgagaagcgaccgaagaagatcttaacgtgatggagttgttacgtccggtgtctatgggcgccggagttttgccgggaaactcggagtcggaaggacccgacggcgaaatggcgtatatgagagcttattttgagagagttattgggtctaaagattcagagactttttatatgttgagtcctgaagggaataatggacccgaacttagctttttctttgtgagagtttgacttattttgttatggttcaaattaatgtaacgtgtatgtaaatgaccggaaacggcggtggtcgtcgacgttatatactattgtttaggataattgtaagaattttttgttgttctttcgttgttaatctctcgatctttataaaaagattgaattgtaagtgtgtgtatatacacacttcttcgtcc

SEQ ID NO: 2634 - protein, 1090 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
AAAAAGAAAAAAGACTACATTTCTACAAGGACGTTGGTTCTTTTAGTCGTCGTCGGTCGTCGAAGAAAGATCTTCTCCTTCTTTCTTCGCCGTACGATCGTCGTCTAATGGGAGAATCATCAAATCCAATGGCTACAAGTTCTTCTTCCTCCTCCTCCTCAATTCCTCCTTCGTCTCCAACACCCTCTCCGACGTCCACAACCACTCCGCCACGTCAACATCCTCTCCTCCAGCCACCATCTTCAAAAAAGAAGAAAAACAGAACAAACGTTTTCAGAGTCTTACGCACCGTGTTTCGATCTTTCCCAATCTTTACAACACCATCCGTAGCATGCAAAATCCCGGTTATACATCCCGGTTTAGGCTTACCGGATCCACATCACAACACGTCAAGAATCACCGGAACGTTATTCGGATACCGTAAAGGCCGAGTAAGTCTTTCCATTCAAGAAAACCCTAAATGTTTACCTTCTTTAGTCGTGGAGCTCGCCATGCAAACCACAACGCTTCAAAAAGAGCTAAGCACGGGAATGGTGAGAATAGCTCTCGAGACTGAGAAACAGCCTCGAGCTGATAATAACAATTCTAAAACCGAGAAGAAGACAGATATTTTGGAAGAACCGTTATGGACAATGTATTGTAAAGGAGAGAAAACGGGTTACGGTGTGAAACGAGAAGCGACCGAAGAAGATCTTAACGTGATGGAGTTGTTACGTCCGGTGTCTATGGGCGCCGGAGTTTTGCCGGGAAACTCGGAGTCGGAAGGACCCGACGGCGAAATGGCGTATATGAGAGCTTATTTTGAGAGAGTTATTGGGTCTAAAGATTCAGAGACTTTTTATATGTTGAGTCCTGAAGGGAATAATGGACCCGAACTTAGCTTTTTCTTTGTGAGAGTTTGACTTATTTTGTTATGGTTCAAATTAATGTAACGTGTATGTAAATGACCGGAAACGGCGGTGGTCGTCGACGTTATATACTATTGTTTAGGATAATTGTAAGAATTTTTTGTTGTTCTTTCGTTGTTAATCTCTCGATCTTTATAAAAAGATTGAATTGTAAGTGTGTGTATATACACACTTCTTCGTCC

SEQ ID NO: 2635 - DNA, 1707 bp, Arabidopsis thaliana
  misc_feature (1)..(1707): Ceres cDNA ID no. 13618754
  misc_feature (1)..(1707): Also known as  Ceres CDNA ID no. 23533084
atcttcttcccccataacactcttcttctctcatcaaaatctctaactcaaaccttcctttgatcccaagaaatctcttccaaagccctaagccaaaagcttcaagagaaaaaatggcgatgatgggtcagttatggactaacacaggctctgctcttgcaacactaatgtttgtatacacaatcttcaaacaattcttccctctcttcggaccccagttggaaccattcctttatagactcttcggtcgcttctacccttacatccaaataacattccatgaatacagcggagagcatttcaagagaagcgaagcctacttggggatccagagctatctaagcaaagactcttctgctagagcaaagaaactcaaagccaacacaactaaaggaagcaaatctattgttcttagcatggatgataaggaagagatcactgacgattttgagggcattagggtttggtggcagtcgaagaaagagggagctactaggcaatctttctcgttttaccctgaagctaatgagaagagatattacatgttaaggttccacagacgtgaccgagaagtaatcatagagaggtatcttgagcatgttatgagagaagggaagacgatagagcaaaagaacagagagaggaagctttattcgaatactccgggtcagagccatggaaacaacagtaagtggagtcatgtaacctttgagcatccagctacgtttgatactctagctatggaagagaataagaaggaagagatcaagagtgatctgatcaagtttagtaagagtaaagattattacaagaagatcggaaaagcgtggaagagagggtatcttttgtttggaccacccgggactgggaagtctacaatgatcgcagcgatggctaatttcttggagtatgatgtttatgatcttgagttgacaacggttaaggataatacacatctgagaaggttattgattgagacttcagcgaaatcgattattgtgattgaagatatcgattgttcgcttaatctaacggggcagagaaagaagaaggaggaggaagaggaagatggagacgataagaacacgattgagaagaagatgatgatgaagaatgaaggtgagaataaagagagtaaagttactttatcagggctactaaatttcattgatggtttatggtcagcttgtggtggtgagaggatcattgtattcactacaaactttgtggacaagttagatccggctttgattaggaaaggaagaatggataagcatatagagatgtcgtattgttgtttcgaagcgtttaaggtattggctaagaactatttggatgtggaagagagtgagatgtttgaggagataaagaggttgcttgaggttgaagaaatcaagatgacaccggcggatgttggggagaatctgttaccgaagtcagaaaaggaaggaggtgagacttgtttgaagagattgatcgaagcgttgaaggaagagaaggaggaagcgaagaagaaggtcgaggaagaggaggaagagaagcagaggaaaaaggaaaaggtgaaagaaatagaggcagagaaagagaagaagaaaaagattgaagaagagaattgagtttgaaggaaatttgttggattgtagtatctaactgaaataattgtagtctgattggttcatcttatgaatgttttgtgtttcatttagc

SEQ ID NO: 2636 - protein, 1707 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ATCTTCTTCCCCCATAACACTCTTCTTCTCTCATCAAAATCTCTAACTCAAACCTTCCTTTGATCCCAAGAAATCTCTTCCAAAGCCCTAAGCCAAAAGCTTCAAGAGAAAAAATGGCGATGATGGGTCAGTTATGGACTAACACAGGCTCTGCTCTTGCAACACTAATGTTTGTATACACAATCTTCAAACAATTCTTCCCTCTCTTCGGACCCCAGTTGGAACCATTCCTTTATAGACTCTTCGGTCGCTTCTACCCTTACATCCAAATAACATTCCATGAATACAGCGGAGAGCATTTCAAGAGAAGCGAAGCCTACTTGGGGATCCAGAGCTATCTAAGCAAAGACTCTTCTGCTAGAGCAAAGAAACTCAAAGCCAACACAACTAAAGGAAGCAAATCTATTGTTCTTAGCATGGATGATAAGGAAGAGATCACTGACGATTTTGAGGGCATTAGGGTTTGGTGGCAGTCGAAGAAAGAGGGAGCTACTAGGCAATCTTTCTCGTTTTACCCTGAAGCTAATGAGAAGAGATATTACATGTTAAGGTTCCACAGACGTGACCGAGAAGTAATCATAGAGAGGTATCTTGAGCATGTTATGAGAGAAGGGAAGACGATAGAGCAAAAGAACAGAGAGAGGAAGCTTTATTCGAATACTCCGGGTCAGAGCCATGGAAACAACAGTAAGTGGAGTCATGTAACCTTTGAGCATCCAGCTACGTTTGATACTCTAGCTATGGAAGAGAATAAGAAGGAAGAGATCAAGAGTGATCTGATCAAGTTTAGTAAGAGTAAAGATTATTACAAGAAGATCGGAAAAGCGTGGAAGAGAGGGTATCTTTTGTTTGGACCACCCGGGACTGGGAAGTCTACAATGATCGCAGCGATGGCTAATTTCTTGGAGTATGATGTTTATGATCTTGAGTTGACAACGGTTAAGGATAATACACATCTGAGAAGGTTATTGATTGAGACTTCAGCGAAATCGATTATTGTGATTGAAGATATCGATTGTTCGCTTAATCTAACGGGGCAGAGAAAGAAGAAGGAGGAGGAAGAGGAAGATGGAGACGATAAGAACACGATTGAGAAGAAGATGATGATGAAGAATGAAGGTGAGAATAAAGAGAGTAAAGTTACTTTATCAGGGCTACTAAATTTCATTGATGGTTTATGGTCAGCTTGTGGTGGTGAGAGGATCATTGTATTCACTACAAACTTTGTGGACAAGTTAGATCCGGCTTTGATTAGGAAAGGAAGAATGGATAAGCATATAGAGATGTCGTATTGTTGTTTCGAAGCGTTTAAGGTATTGGCTAAGAACTATTTGGATGTGGAAGAGAGTGAGATGTTTGAGGAGATAAAGAGGTTGCTTGAGGTTGAAGAAATCAAGATGACACCGGCGGATGTTGGGGAGAATCTGTTACCGAAGTCAGAAAAGGAAGGAGGTGAGACTTGTTTGAAGAGATTGATCGAAGCGTTGAAGGAAGAGAAGGAGGAAGCGAAGAAGAAGGTCGAGGAAGAGGAGGAAGAGAAGCAGAGGAAAAAGGAAAAGGTGAAAGAAATAGAGGCAGAGAAAGAGAAGAAGAAAAAGATTGAAGAAGAGAATTGAGTTTGAAGGAAATTTGTTGGATTGTAGTATCTAACTGAAATAATTGTAGTCTGATTGGTTCATCTTATGAATGTTTTGTGTTTCATTTAGC

SEQ ID NO: 2637 - DNA, 1125 bp, Arabidopsis thaliana
  misc_feature (1)..(1125): Ceres cDNA ID no. 13619361
  misc_feature (1)..(1125): Also known as  Ceres CDNA ID no. 23533084
tcgattggccaaatcggccctcgagggaacctcggtgcagtcaagatcttgcaacaactgtttccggaacctggaaagcttcaattcatttatgctgatcttggagatgcaaatgctgttaacaaaatattttctgaaaacgcatttgacgctgtgatgcattttgctgctgttgcttatgttggagaaagcacacagtttcctctcaatattatcacaatatcacatcgaacacattggtagttttagagacaatggctgctcatggtgtgaagactttgatatattcaagcacatgtgctacttatggagagcctgagaaaatgccaataacagaggaaactccacaggttccaatcaatccatatggaaaggctaaaaagatggcagaagatatcatcttggatttctccaagaattctattatggcagttatgatcctaagatatttcaatgtgattgggtctgatcctgagggtagactaggtgaagctccaagacctgaactcagtgagcatggacggatctctggtgcttgctttgatgctgcacgaggcatcattcccgggctgcagattaaaggaacagactacaagactgttgatgggacttgtgtacgtgattacattgatgtcaccgacttggttgatgctcatgttaaagctcttgaaaaggcgaaaccccgcaaagttggtatcttcaatgttggtaccgggaaaggtagctcggtgaaggagtttgtggaagcgtgcaaaaaggcgaccggcgttgatataaaagtcgattacttggaaagacgggcaggagattacgcagaggtttacagcgatccaagaaaaatcaaagaagagctgaattggacagctaagcacaccaatcttcaagaaagtttaaagatggcatggagatggcaaaagcttcatcgcagtggctatggatcttcttccttggtttctgcatactgaccattatgcattaggtatgtgagcattgcccttcaaggactccttcattagagtcttgattctagatggtagtgaaggtagtagaagaagatggatttattcttagtagaatagtattcatcttatccatatatagagattatatatgagattattgatt

SEQ ID NO: 2638 - protein, 1125 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
TCGATTGGCCAAATCGGCCCTCGAGGGAACCTCGGTGCAGTCAAGATCTTGCAACAACTGTTTCCGGAACCTGGAAAGCTTCAATTCATTTATGCTGATCTTGGAGATGCAAATGCTGTTAACAAAATATTTTCTGAAAACGCATTTGACGCTGTGATGCATTTTGCTGCTGTTGCTTATGTTGGAGAAAGCACACAGTTTCCTCTCAATATTATCACAATATCACATCGAACACATTGGTAGTTTTAGAGACAATGGCTGCTCATGGTGTGAAGACTTTGATATATTCAAGCACATGTGCTACTTATGGAGAGCCTGAGAAAATGCCAATAACAGAGGAAACTCCACAGGTTCCAATCAATCCATATGGAAAGGCTAAAAAGATGGCAGAAGATATCATCTTGGATTTCTCCAAGAATTCTATTATGGCAGTTATGATCCTAAGATATTTCAATGTGATTGGGTCTGATCCTGAGGGTAGACTAGGTGAAGCTCCAAGACCTGAACTCAGTGAGCATGGACGGATCTCTGGTGCTTGCTTTGATGCTGCACGAGGCATCATTCCCGGGCTGCAGATTAAAGGAACAGACTACAAGACTGTTGATGGGACTTGTGTACGTGATTACATTGATGTCACCGACTTGGTTGATGCTCATGTTAAAGCTCTTGAAAAGGCGAAACCCCGCAAAGTTGGTATCTTCAATGTTGGTACCGGGAAAGGTAGCTCGGTGAAGGAGTTTGTGGAAGCGTGCAAAAAGGCGACCGGCGTTGATATAAAAGTCGATTACTTGGAAAGACGGGCAGGAGATTACGCAGAGGTTTACAGCGATCCAAGAAAAATCAAAGAAGAGCTGAATTGGACAGCTAAGCACACCAATCTTCAAGAAAGTTTAAAGATGGCATGGAGATGGCAAAAGCTTCATCGCAGTGGCTATGGATCTTCTTCCTTGGTTTCTGCATACTGACCATTATGCATTAGGTATGTGAGCATTGCCCTTCAAGGACTCCTTCATTAGAGTCTTGATTCTAGATGGTAGTGAAGGTAGTAGAAGAAGATGGATTTATTCTTAGTAGAATAGTATTCATCTTATCCATATATAGAGATTATATATGAGATTATTGATT

SEQ ID NO: 2639 - DNA, 1358 bp, Arabidopsis thaliana
  misc_feature (1)..(1358): Ceres cDNA ID no. 13619586
  misc_feature (1)..(1358): Also known as  Ceres CDNA ID no. 23533084
atgaggtgtttctcttgtctcaacacgcaaactaatgacatgagaatcaacattgataccctctccgacctaaccgattatgcctcagttgccacaaaaatcgatccaagaggaacaggctcaaaatctggcattttagttaatgggaaagtgaatagccctaaaccgggtggtggcgcacggagtttcacgttcaaggagttagcagccgccacgaagaatttccgggaggggaatattataggaaaaggaggctttgggagtgtctacaagggacgtttagattcaggacaagtggtggcgatcaagcaattaaatccagatggacatcaaggaaatcaagaattcatagttgaagtctgtatgcttagcgtcttccatcatccaaatctagtaactttaatcggttactgtacttctggtgctcagagacttcttgtttatgaatacatgccaatgggtagcttagaagatcatctttttgatcttgagcctgatcagactccactaagctggtatactcggatgaaaatcgcggttggtgcagctcgtgggatagagtatctccactgtaaaataagcccgtctgtgatttaccgtgatttgaaatccgcaaacattttgttagataaagaatttagcgtcaagctctctgattttggactcgctaaggttggtcctgtggggaaccggacacatgtgtcgactcgagtcatgggtacttacggatactgtgctccagaatacgcaatgagcggaagattgactataaaatcggatatctatagctttggtgtagtgttgcttgagcttatttctggcaggaaggccattgatttgagtaaaccaaacggagagcagtaccttgttgcttgggctagaccgtatctcaaagatcctaagaaatttggacttctagttgacccgttgctacggggaaagttctcgaagaggtgtcttaactacgcgatttctataaccgagatgtgcctaaacgacgaagcgaatcaccggccaaaaataggagatgtggtggtggcatttgagtacatagcctctcagagcaaatcttatgaagatcgaagaacggctcgcaagtctacggactctaaccggttaagacgggaaacaaaacagagttattaattaaattgtatgagtcctaagtgaaacctctgctagaatcagaaggttcctgataaggccgcataattaatgtttgtactttttttccgggtgtttttgtttagtcagatttaagaatgggatttggtcggataaagaggttttttttttttggcttgaggtaaatggtgctttgtaaaaaaacttaaaaataaaaatgaactcttacgttt

SEQ ID NO: 2640 - protein, 1358 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ATGAGGTGTTTCTCTTGTCTCAACACGCAAACTAATGACATGAGAATCAACATTGATACCCTCTCCGACCTAACCGATTATGCCTCAGTTGCCACAAAAATCGATCCAAGAGGAACAGGCTCAAAATCTGGCATTTTAGTTAATGGGAAAGTGAATAGCCCTAAACCGGGTGGTGGCGCACGGAGTTTCACGTTCAAGGAGTTAGCAGCCGCCACGAAGAATTTCCGGGAGGGGAATATTATAGGAAAAGGAGGCTTTGGGAGTGTCTACAAGGGACGTTTAGATTCAGGACAAGTGGTGGCGATCAAGCAATTAAATCCAGATGGACATCAAGGAAATCAAGAATTCATAGTTGAAGTCTGTATGCTTAGCGTCTTCCATCATCCAAATCTAGTAACTTTAATCGGTTACTGTACTTCTGGTGCTCAGAGACTTCTTGTTTATGAATACATGCCAATGGGTAGCTTAGAAGATCATCTTTTTGATCTTGAGCCTGATCAGACTCCACTAAGCTGGTATACTCGGATGAAAATCGCGGTTGGTGCAGCTCGTGGGATAGAGTATCTCCACTGTAAAATAAGCCCGTCTGTGATTTACCGTGATTTGAAATCCGCAAACATTTTGTTAGATAAAGAATTTAGCGTCAAGCTCTCTGATTTTGGACTCGCTAAGGTTGGTCCTGTGGGGAACCGGACACATGTGTCGACTCGAGTCATGGGTACTTACGGATACTGTGCTCCAGAATACGCAATGAGCGGAAGATTGACTATAAAATCGGATATCTATAGCTTTGGTGTAGTGTTGCTTGAGCTTATTTCTGGCAGGAAGGCCATTGATTTGAGTAAACCAAACGGAGAGCAGTACCTTGTTGCTTGGGCTAGACCGTATCTCAAAGATCCTAAGAAATTTGGACTTCTAGTTGACCCGTTGCTACGGGGAAAGTTCTCGAAGAGGTGTCTTAACTACGCGATTTCTATAACCGAGATGTGCCTAAACGACGAAGCGAATCACCGGCCAAAAATAGGAGATGTGGTGGTGGCATTTGAGTACATAGCCTCTCAGAGCAAATCTTATGAAGATCGAAGAACGGCTCGCAAGTCTACGGACTCTAACCGGTTAAGACGGGAAACAAAACAGAGTTATTAATTAAATTGTATGAGTCCTAAGTGAAACCTCTGCTAGAATCAGAAGGTTCCTGATAAGGCCGCATAATTAATGTTTGTACTTTTTTTCCGGGTGTTTTTGTTTAGTCAGATTTAAGAATGGGATTTGGTCGGATAAAGAGGTTTTTTTTTTTTGGCTTGAGGTAAATGGTGCTTTGTAAAAAAACTTAAAAATAAAAATGAACTCTTACGTTT

SEQ ID NO: 2641 - DNA, 1611 bp, Arabidopsis thaliana
  misc_feature (1)..(1611): Ceres cDNA ID no. 13619788
  misc_feature (1)..(1611): Also known as  Ceres CDNA ID no. 23533084
atgtcacacacaaagtcgcaaccacaaacgtgaaacgtgtaaaatatgactgtgctttggtttgtatcacttatcttactcatctctatccttctcgttgccgtcaaacactctaagcggcgatgggtccggcaaccaccgtctcctccaggcttaccaatcattggaaacttgcaccagcttggagaattaccacatcaatctctatgtaagctctcaaagaagtatggtcctgtaatgttactgaaacttggaagagttccaacagttatagtttctactcctgaaacagcaaaacaagttcttaaagactatgacctccactgttgtagccgtccaagcttggaaggtacaagaaagctttcttacaactatctagacattgctttctctagatttgatgattattggaaagaattaaggaagctttgtgttgaagaactcttttgtaataaacgaattaactcgattcaaccaatcaaggaggcggagatggagaaactgattgactcaattgctgaatctgcttctcagaaaactctggttaacttgagtgatacgtttctttctttaaacgttaacgtaatttgcaaggcagtatttggtgtgaatttccaaggaactgtgcttaacaatgataagttccaagatttagtccacgaggcacttgagatgttggggagcttctctgcttcggatttcttcccgtatgtcggttggattgtcgattggttcacgggtttacacgctcggagggagagaagcgtacgagatcttgatgctttctatgaacaaatgattgatttacatctacagaaaaacagagaagaaagtgaagatgattttgtggacttgctcttgaggttggaaaaggaagaagctgttcttggatatggcaaactcacaagaaaccacatcaaagcaatcttgatgaacattcttttggggggaatcaatacttctgcaataaccatgacatgggcaatggcggaactcataagaaacccacgagtgatgaagaaagttcaatccgaaatcagagcccaaatagggaaaaacaacaaaacaagaatcataagtttagatgagataaatcatctcagttacctaaatatggttatcaaagaaacatgccggttacatccagtagcacctcttctagtcccaagagaagtgatatctgaattcaagatcaacggctacacgattcaaccgaagacaaggcttcatgtcaacgtatgggctatcggacgtgatcccgagatatggaaagatccagaagagtttctcccagagaggtttatggactgtgacattgatgttaaaggacaagactatgagttgttaccatttggaagtggtcgaagaatttgtccagcagtgtacatggggataacaacagttgagtttggtcttgctaatctcttgtatcactttgattggaagttaccagaaggtgttgccgttgaagatatttacatggatgaagcttctggactcacttctcataagaaacatgaccttttacttgttcctgtgaaatctttagtgtaacacttgtgtaagtaaacatgaccttttacttctcataagtaatgtaatggttaaacc

SEQ ID NO: 2642 - protein, 1611 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ATGTCACACACAAAGTCGCAACCACAAACGTGAAACGTGTAAAATATGACTGTGCTTTGGTTTGTATCACTTATCTTACTCATCTCTATCCTTCTCGTTGCCGTCAAACACTCTAAGCGGCGATGGGTCCGGCAACCACCGTCTCCTCCAGGCTTACCAATCATTGGAAACTTGCACCAGCTTGGAGAATTACCACATCAATCTCTATGTAAGCTCTCAAAGAAGTATGGTCCTGTAATGTTACTGAAACTTGGAAGAGTTCCAACAGTTATAGTTTCTACTCCTGAAACAGCAAAACAAGTTCTTAAAGACTATGACCTCCACTGTTGTAGCCGTCCAAGCTTGGAAGGTACAAGAAAGCTTTCTTACAACTATCTAGACATTGCTTTCTCTAGATTTGATGATTATTGGAAAGAATTAAGGAAGCTTTGTGTTGAAGAACTCTTTTGTAATAAACGAATTAACTCGATTCAACCAATCAAGGAGGCGGAGATGGAGAAACTGATTGACTCAATTGCTGAATCTGCTTCTCAGAAAACTCTGGTTAACTTGAGTGATACGTTTCTTTCTTTAAACGTTAACGTAATTTGCAAGGCAGTATTTGGTGTGAATTTCCAAGGAACTGTGCTTAACAATGATAAGTTCCAAGATTTAGTCCACGAGGCACTTGAGATGTTGGGGAGCTTCTCTGCTTCGGATTTCTTCCCGTATGTCGGTTGGATTGTCGATTGGTTCACGGGTTTACACGCTCGGAGGGAGAGAAGCGTACGAGATCTTGATGCTTTCTATGAACAAATGATTGATTTACATCTACAGAAAAACAGAGAAGAAAGTGAAGATGATTTTGTGGACTTGCTCTTGAGGTTGGAAAAGGAAGAAGCTGTTCTTGGATATGGCAAACTCACAAGAAACCACATCAAAGCAATCTTGATGAACATTCTTTTGGGGGGAATCAATACTTCTGCAATAACCATGACATGGGCAATGGCGGAACTCATAAGAAACCCACGAGTGATGAAGAAAGTTCAATCCGAAATCAGAGCCCAAATAGGGAAAAACAACAAAACAAGAATCATAAGTTTAGATGAGATAAATCATCTCAGTTACCTAAATATGGTTATCAAAGAAACATGCCGGTTACATCCAGTAGCACCTCTTCTAGTCCCAAGAGAAGTGATATCTGAATTCAAGATCAACGGCTACACGATTCAACCGAAGACAAGGCTTCATGTCAACGTATGGGCTATCGGACGTGATCCCGAGATATGGAAAGATCCAGAAGAGTTTCTCCCAGAGAGGTTTATGGACTGTGACATTGATGTTAAAGGACAAGACTATGAGTTGTTACCATTTGGAAGTGGTCGAAGAATTTGTCCAGCAGTGTACATGGGGATAACAACAGTTGAGTTTGGTCTTGCTAATCTCTTGTATCACTTTGATTGGAAGTTACCAGAAGGTGTTGCCGTTGAAGATATTTACATGGATGAAGCTTCTGGACTCACTTCTCATAAGAAACATGACCTTTTACTTGTTCCTGTGAAATCTTTAGTGTAACACTTGTGTAAGTAAACATGACCTTTTACTTCTCATAAGTAATGTAATGGTTAAACC

SEQ ID NO: 2643 - DNA, 1227 bp, Arabidopsis thaliana
  misc_feature (1)..(1227): Ceres cDNA ID no. 13619845
  misc_feature (1)..(1227): Also known as  Ceres CDNA ID no. 23533084
attctcaatactataatatatctctcccacacacaatcatactctctcaatctcaaccaacgatggattccgagatcgccgccgactactctccaatgctcataatctacaagagtggccgcattgagcgactcgtgggtgaaaccaccgtgccaccttcttccaacccacaaaacggagtcgtttccaaggacgtcgtttattctcctgacaacaacctctccctccgcatttacctcccggagaaagccgccaccgccgagaccgaagcctctgtaaaactccctctcctcgtctacttccacggcggaggattcctcgttgaaaccgctttctccccgacttaccacactttcctcacggcggctgtctcagcgtcagactgtgtagcggtctccgtggattaccgacgtgcaccggagcatccgattcctacttcttacgatgattcttggacagctctcaaatgggttttctcccacatcgccggatctggctcagaagattggttgaacaaacacgccgacttcagcaaagtgttcctcgccggagatagcgccggagcgaacataacgcatcacatgacgatgaaagctgcgaaagataaactcagtcccgagtctttgaacgagtcaggaatctctggaatcatcttagttcatccttatttctggtcaaaaaccccagtcgacgacaaggagacgacggatgtagcaataaggacgtggatcgagtcggtctggacgttggctagtcccaatagcaaagatggatcagatgatccattcatcaacgtggtgcaatcagagtcggtggatttgtccgggttgggttgtggtaaggttttggtaatggtggctgagaaagacgcgttggtgaggcaaggttggggttactgggagaagcttggtaagagccgttggaacggagaagtactggacgtggtggagactaagggagaaggtcatgtttttcatttgagggatcctaattctgaaaaggctcatgaactcgtgcacagattcgcagggtttatcaagggagacaagtaacattgtgctttttagtttggtgtttgagatgtgtcactgtctcactttctctaatgtttcagtaatttgcatgttgcttacaacatcattatattcaattgtattgctaataagagatgtttaattctgcccactaaatatttttattgtaatcttgatttttgtttttccactt

SEQ ID NO: 2644 - protein, 1227 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ATTCTCAATACTATAATATATCTCTCCCACACACAATCATACTCTCTCAATCTCAACCAACGATGGATTCCGAGATCGCCGCCGACTACTCTCCAATGCTCATAATCTACAAGAGTGGCCGCATTGAGCGACTCGTGGGTGAAACCACCGTGCCACCTTCTTCCAACCCACAAAACGGAGTCGTTTCCAAGGACGTCGTTTATTCTCCTGACAACAACCTCTCCCTCCGCATTTACCTCCCGGAGAAAGCCGCCACCGCCGAGACCGAAGCCTCTGTAAAACTCCCTCTCCTCGTCTACTTCCACGGCGGAGGATTCCTCGTTGAAACCGCTTTCTCCCCGACTTACCACACTTTCCTCACGGCGGCTGTCTCAGCGTCAGACTGTGTAGCGGTCTCCGTGGATTACCGACGTGCACCGGAGCATCCGATTCCTACTTCTTACGATGATTCTTGGACAGCTCTCAAATGGGTTTTCTCCCACATCGCCGGATCTGGCTCAGAAGATTGGTTGAACAAACACGCCGACTTCAGCAAAGTGTTCCTCGCCGGAGATAGCGCCGGAGCGAACATAACGCATCACATGACGATGAAAGCTGCGAAAGATAAACTCAGTCCCGAGTCTTTGAACGAGTCAGGAATCTCTGGAATCATCTTAGTTCATCCTTATTTCTGGTCAAAAACCCCAGTCGACGACAAGGAGACGACGGATGTAGCAATAAGGACGTGGATCGAGTCGGTCTGGACGTTGGCTAGTCCCAATAGCAAAGATGGATCAGATGATCCATTCATCAACGTGGTGCAATCAGAGTCGGTGGATTTGTCCGGGTTGGGTTGTGGTAAGGTTTTGGTAATGGTGGCTGAGAAAGACGCGTTGGTGAGGCAAGGTTGGGGTTACTGGGAGAAGCTTGGTAAGAGCCGTTGGAACGGAGAAGTACTGGACGTGGTGGAGACTAAGGGAGAAGGTCATGTTTTTCATTTGAGGGATCCTAATTCTGAAAAGGCTCATGAACTCGTGCACAGATTCGCAGGGTTTATCAAGGGAGACAAGTAACATTGTGCTTTTTAGTTTGGTGTTTGAGATGTGTCACTGTCTCACTTTCTCTAATGTTTCAGTAATTTGCATGTTGCTTACAACATCATTATATTCAATTGTATTGCTAATAAGAGATGTTTAATTCTGCCCACTAAATATTTTTATTGTAATCTTGATTTTTGTTTTTCCACTT

SEQ ID NO: 2645 - DNA, 1416 bp, Arabidopsis thaliana
  misc_feature (1)..(1416): Ceres cDNA ID no. 13619904
  misc_feature (1)..(1416): Also known as  Ceres CDNA ID no. 23533084
gccctttgggaattttttgattgcagatgttagtatgagtttttcacaagatatggataatgagtatgagaagctgataagaagaatgaatccaccaagggttgtgattgataatgactcttgcaagaaggcaactgtgataagggtggatagtgcaaatgaatatgggattcttcttgaagttgtacaaatccttactgatcttaaccttactatcactaaggcgtacatatcttctgatggtggttggtttatggatgtatttaatgtcactgatcaagatggtaacaaagtcactgatgaagttgttctagactatatccaaaagtctcttgggcctgaagcttgtttctccacttccatgagatcagttggtgtcataccatcaacagacagcacggttattgagttaactggatgtgacagaccaggtctgctgtctgaactgtcagctgttttgacccatctcaaatgcagtgtcctcaacgctgagatttggacacacaacaccagagcagctgctgtgatgcaggtcacagatgacttaaccgggtgtggcatttctgatccagagaggttgtctcggatcaagaaccttctcagaaatgtgcttaagggaagcaacacaccaagggaagctaaaaccgtagtgtctcatggggaggtccacacggataggaggcttcatcagatgatgtttgaggatagagactatgaacaccgtttggtggatgatgattcctctatccaagatgaaaggcaaagaccagatgtttgtgttgataattggctcgataaggattactctgtggtcacagttagatgtaaagacagaccaaagcttctgttcgacacagtctgcactttgactgatatgcagtatgtggttttccatggaagtgttgatactgagggcaccgaggcgtttcaggagtattatgtgagacatatagatggatcccctgtgaaatcagaggcagagaagcaaagagtcatacaatgtcttgaagcagctatcaaaagaagagtatctgagggattgaagttggaactgtgcacgacggatagagtaggcttattgtcaaacgtgactcgcatattccgtgaaaacagcctaacggtcacaagagctgaagtgaaaaccaaaggaggcaaagctctaaacacattctatgtcagtgatgcatctggttactcaatcgatgctaagaccatagattccataagacaaaccataggccaaactattctcaaagtcaagaacaaccctcaagaacaacaacaaagacagaaatcgccttctcacgaatcaccgacaagatttctctttgggggtctcttcaagtcgaaatcttttgtcaactttggcttggtccgttcctactcttgaagaacaacttcacttagctgtgaggt

SEQ ID NO: 2646 - protein, 1416 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
GCCCTTTGGGAATTTTTTGATTGCAGATGTTAGTATGAGTTTTTCACAAGATATGGATAATGAGTATGAGAAGCTGATAAGAAGAATGAATCCACCAAGGGTTGTGATTGATAATGACTCTTGCAAGAAGGCAACTGTGATAAGGGTGGATAGTGCAAATGAATATGGGATTCTTCTTGAAGTTGTACAAATCCTTACTGATCTTAACCTTACTATCACTAAGGCGTACATATCTTCTGATGGTGGTTGGTTTATGGATGTATTTAATGTCACTGATCAAGATGGTAACAAAGTCACTGATGAAGTTGTTCTAGACTATATCCAAAAGTCTCTTGGGCCTGAAGCTTGTTTCTCCACTTCCATGAGATCAGTTGGTGTCATACCATCAACAGACAGCACGGTTATTGAGTTAACTGGATGTGACAGACCAGGTCTGCTGTCTGAACTGTCAGCTGTTTTGACCCATCTCAAATGCAGTGTCCTCAACGCTGAGATTTGGACACACAACACCAGAGCAGCTGCTGTGATGCAGGTCACAGATGACTTAACCGGGTGTGGCATTTCTGATCCAGAGAGGTTGTCTCGGATCAAGAACCTTCTCAGAAATGTGCTTAAGGGAAGCAACACACCAAGGGAAGCTAAAACCGTAGTGTCTCATGGGGAGGTCCACACGGATAGGAGGCTTCATCAGATGATGTTTGAGGATAGAGACTATGAACACCGTTTGGTGGATGATGATTCCTCTATCCAAGATGAAAGGCAAAGACCAGATGTTTGTGTTGATAATTGGCTCGATAAGGATTACTCTGTGGTCACAGTTAGATGTAAAGACAGACCAAAGCTTCTGTTCGACACAGTCTGCACTTTGACTGATATGCAGTATGTGGTTTTCCATGGAAGTGTTGATACTGAGGGCACCGAGGCGTTTCAGGAGTATTATGTGAGACATATAGATGGATCCCCTGTGAAATCAGAGGCAGAGAAGCAAAGAGTCATACAATGTCTTGAAGCAGCTATCAAAAGAAGAGTATCTGAGGGATTGAAGTTGGAACTGTGCACGACGGATAGAGTAGGCTTATTGTCAAACGTGACTCGCATATTCCGTGAAAACAGCCTAACGGTCACAAGAGCTGAAGTGAAAACCAAAGGAGGCAAAGCTCTAAACACATTCTATGTCAGTGATGCATCTGGTTACTCAATCGATGCTAAGACCATAGATTCCATAAGACAAACCATAGGCCAAACTATTCTCAAAGTCAAGAACAACCCTCAAGAACAACAACAAAGACAGAAATCGCCTTCTCACGAATCACCGACAAGATTTCTCTTTGGGGGTCTCTTCAAGTCGAAATCTTTTGTCAACTTTGGCTTGGTCCGTTCCTACTCTTGAAGAACAACTTCACTTAGCTGTGAGGT

SEQ ID NO: 2647 - DNA, 1575 bp, Arabidopsis thaliana
  misc_feature (1)..(1575): Ceres cDNA ID no. 13620003
  misc_feature (1)..(1575): Also known as  Ceres CDNA ID no. 23533084
tttgtcactgggagggaagggagagagtgaaaaattgaaaatatctagttttttttttctctctcttgcttttaggctttaggctttcactactaatactctcttagtttaagacattgccttcacatccaaacacaaatgcaaatctttgtctcctctcttccttcaaagtctttcattacaaaaccctaatatctctaatcttctctctgtctctcttaagggcaatatcttcaatagagttctgaactttggaagcatattaagatatcaaagtaattttctacttttagttgtgaagctagtctctcctctgtccccaaaccaagaaacaatttgcaaagagaaagcaaaaggtttttgaagaagacccaattaaaaaagatggaaattgcaagtcaagaagatcatgatatgcccatcccattaaacactacatttggtggtggtggtagtcatggtcacatgatccatcatcatgatcatcatgctgctaattctgctcctccaactcacaacaacaacaatactactcaaccacctccaatgccgttacatggtaatggtcatggcaacaattatgatcatcatcatcatcaagatcctcatcatgttggttacaacgctatcatcaagaagcctatgataaagtacaaggagtgtctcaagaaccatgcagcagctatgggaggcaatgctactgatgggtgtggagagtttatgccaagtggtgaagatggctccattgaggctctcacttgctcagcttgcaattgccacaggaacttccatagaaaagaagtggaaggcgaactcgcagccaccgccatgtccccttaccaccaacaccctccacaccgaaaactcatgctcaaccaccaaaagatcagatcagctatgccacaccaaatgatcatgcccattggagtctctaactaccggtacatgcataacaactccgagtccgaggactttatggaggaagatggcgtaaccaccgcatctagatcgctaccaaacctgccatacaaccagaagaagaggttcaggacaaagttcacgccggaacagaaggagaagatgcttagttttgctgagaaagttgggtggaaaatacaaaggcaagaagattgtgttgttcaaaggttttgtgaagagattggagtgaagagaagagtgcttaaggtttggatgcacaacaacaagatccatttctccaagaagaacaacattaacctcgaagacaacgacaacgaaaagatcaacaatctcaacaatgttgatctgtccggtaataacgacatgactaagatcgtcccatgatataattaataacgttatttttatatgatctttgataattatttagttatctttatgttagctactagggttttaattttatcttctagctggtttggttttattttatatatataagctcatttcgctatctctcgttaaacccatggattttatataattttctgctctttgttgtgttttatttatttggaagttatatatattaatcttgttgtaataaatgtatgaccagccgtatttttcttcttc

SEQ ID NO: 2648 - protein, 1575 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
TTTGTCACTGGGAGGGAAGGGAGAGAGTGAAAAATTGAAAATATCTAGTTTTTTTTTTCTCTCTCTTGCTTTTAGGCTTTAGGCTTTCACTACTAATACTCTCTTAGTTTAAGACATTGCCTTCACATCCAAACACAAATGCAAATCTTTGTCTCCTCTCTTCCTTCAAAGTCTTTCATTACAAAACCCTAATATCTCTAATCTTCTCTCTGTCTCTCTTAAGGGCAATATCTTCAATAGAGTTCTGAACTTTGGAAGCATATTAAGATATCAAAGTAATTTTCTACTTTTAGTTGTGAAGCTAGTCTCTCCTCTGTCCCCAAACCAAGAAACAATTTGCAAAGAGAAAGCAAAAGGTTTTTGAAGAAGACCCAATTAAAAAAGATGGAAATTGCAAGTCAAGAAGATCATGATATGCCCATCCCATTAAACACTACATTTGGTGGTGGTGGTAGTCATGGTCACATGATCCATCATCATGATCATCATGCTGCTAATTCTGCTCCTCCAACTCACAACAACAACAATACTACTCAACCACCTCCAATGCCGTTACATGGTAATGGTCATGGCAACAATTATGATCATCATCATCATCAAGATCCTCATCATGTTGGTTACAACGCTATCATCAAGAAGCCTATGATAAAGTACAAGGAGTGTCTCAAGAACCATGCAGCAGCTATGGGAGGCAATGCTACTGATGGGTGTGGAGAGTTTATGCCAAGTGGTGAAGATGGCTCCATTGAGGCTCTCACTTGCTCAGCTTGCAATTGCCACAGGAACTTCCATAGAAAAGAAGTGGAAGGCGAACTCGCAGCCACCGCCATGTCCCCTTACCACCAACACCCTCCACACCGAAAACTCATGCTCAACCACCAAAAGATCAGATCAGCTATGCCACACCAAATGATCATGCCCATTGGAGTCTCTAACTACCGGTACATGCATAACAACTCCGAGTCCGAGGACTTTATGGAGGAAGATGGCGTAACCACCGCATCTAGATCGCTACCAAACCTGCCATACAACCAGAAGAAGAGGTTCAGGACAAAGTTCACGCCGGAACAGAAGGAGAAGATGCTTAGTTTTGCTGAGAAAGTTGGGTGGAAAATACAAAGGCAAGAAGATTGTGTTGTTCAAAGGTTTTGTGAAGAGATTGGAGTGAAGAGAAGAGTGCTTAAGGTTTGGATGCACAACAACAAGATCCATTTCTCCAAGAAGAACAACATTAACCTCGAAGACAACGACAACGAAAAGATCAACAATCTCAACAATGTTGATCTGTCCGGTAATAACGACATGACTAAGATCGTCCCATGATATAATTAATAACGTTATTTTTATATGATCTTTGATAATTATTTAGTTATCTTTATGTTAGCTACTAGGGTTTTAATTTTATCTTCTAGCTGGTTTGGTTTTATTTTATATATATAAGCTCATTTCGCTATCTCTCGTTAAACCCATGGATTTTATATAATTTTCTGCTCTTTGTTGTGTTTTATTTATTTGGAAGTTATATATATTAATCTTGTTGTAATAAATGTATGACCAGCCGTATTTTTCTTCTTC

SEQ ID NO: 2649 - DNA, 1621 bp, Arabidopsis thaliana
  misc_feature (1)..(1621): Ceres cDNA ID no. 13620179
  misc_feature (1)..(1621): Also known as  Ceres CDNA ID no. 23533084
actccgatagaaacagagccaacaaaacaaaaacagaggaagaaaaacaaaaatgacgatcttgctctgtttcttcttagtttcacttcttactatcgtatcatcaatctttcttaaacagaataaaacctcaaaattcaatcttcccccaagcccttcaagccttccgatcattggaaacttacaccatctcgcaggattgcctcacagatgttttcataagctctctatcaaatacggacccttggtctttcttcgtctcgggtctgttccggttgttgtgatctcatcgagtgaagcagctgaagcagttctcaaaaccaatgacttggaatgttgcagccgaccaaagacggtggggagcggaaaactctcttacggtttcaaagacatcactttcgcaccatacggtatataagagaggaagaggtcgacttcgtggtcaagaaagtgtcagaatcagctttgaagcaatctcctgtggatttaagcaaaacctttttctccctcaccgctagtatcatttgtagagtcgccttaggacagaatttcaatgaaagcggctttgttatcgatcaagacaggatcgaagaacttgttaccgaatcagcagaagctctagggactttcactttctctgacttcttccctggtggacttggaagatttgtagattggttgtttcaacgacacaagaagatcaacaaagtctttaaggaacttgatgctttttatcagcatgtgattgatgatcacttgaagccagagggaagaaagaatcaagatattgtcaccttgattttggatatgatcgataaacaagaagattcagattctttcaaactcaacatggataatctcaaggcaattgtcatggatgtatttctcgcggggatagatacaagcgcggtaacaatgatttgggcgatgacagaacttattagaaaccctagagtgatgaagaaggctcaagaaagtattcgaaccactctgggtctcaagaaggaaagaatcactgaagaagatttaggcaaagttgagtatttgaaccacatactcaaggaaacttttaggttacacccggcacttccatttgtggtgccaagggaaacaatgtctcacatcaagatccaaggctatgatattccaccgaaaacacaaatccagcttaacgtgtggacgatcggacgtgaccctaagcgttggaatgaccctgaagaattcaaccctgaaaggtttgcaaatagctctgtagattttagaggacaacattttgacctattaccgtttggttctggtcgaaggatttgtcccggaatgccaatggcgattgctagtgtggaactagcattgatgaatttgctttattattttgattggagtatgcctgatgggactaaaggtgaagacattgatatggaagaagctggtaatatctctattgtcaagaaaatacctcttcaacttgtgcctgttcaacgttattgatgagcaataatataagctcgataacatggaaagtgtatgaagcaaaaaacataagattctttagattttgttgtgttatataagaaagaaatgttccaataataaatcaagaaagaataacttttgttcattt

SEQ ID NO: 2650 - protein, 1621 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ACTCCGATAGAAACAGAGCCAACAAAACAAAAACAGAGGAAGAAAAACAAAAATGACGATCTTGCTCTGTTTCTTCTTAGTTTCACTTCTTACTATCGTATCATCAATCTTTCTTAAACAGAATAAAACCTCAAAATTCAATCTTCCCCCAAGCCCTTCAAGCCTTCCGATCATTGGAAACTTACACCATCTCGCAGGATTGCCTCACAGATGTTTTCATAAGCTCTCTATCAAATACGGACCCTTGGTCTTTCTTCGTCTCGGGTCTGTTCCGGTTGTTGTGATCTCATCGAGTGAAGCAGCTGAAGCAGTTCTCAAAACCAATGACTTGGAATGTTGCAGCCGACCAAAGACGGTGGGGAGCGGAAAACTCTCTTACGGTTTCAAAGACATCACTTTCGCACCATACGGTATATAAGAGAGGAAGAGGTCGACTTCGTGGTCAAGAAAGTGTCAGAATCAGCTTTGAAGCAATCTCCTGTGGATTTAAGCAAAACCTTTTTCTCCCTCACCGCTAGTATCATTTGTAGAGTCGCCTTAGGACAGAATTTCAATGAAAGCGGCTTTGTTATCGATCAAGACAGGATCGAAGAACTTGTTACCGAATCAGCAGAAGCTCTAGGGACTTTCACTTTCTCTGACTTCTTCCCTGGTGGACTTGGAAGATTTGTAGATTGGTTGTTTCAACGACACAAGAAGATCAACAAAGTCTTTAAGGAACTTGATGCTTTTTATCAGCATGTGATTGATGATCACTTGAAGCCAGAGGGAAGAAAGAATCAAGATATTGTCACCTTGATTTTGGATATGATCGATAAACAAGAAGATTCAGATTCTTTCAAACTCAACATGGATAATCTCAAGGCAATTGTCATGGATGTATTTCTCGCGGGGATAGATACAAGCGCGGTAACAATGATTTGGGCGATGACAGAACTTATTAGAAACCCTAGAGTGATGAAGAAGGCTCAAGAAAGTATTCGAACCACTCTGGGTCTCAAGAAGGAAAGAATCACTGAAGAAGATTTAGGCAAAGTTGAGTATTTGAACCACATACTCAAGGAAACTTTTAGGTTACACCCGGCACTTCCATTTGTGGTGCCAAGGGAAACAATGTCTCACATCAAGATCCAAGGCTATGATATTCCACCGAAAACACAAATCCAGCTTAACGTGTGGACGATCGGACGTGACCCTAAGCGTTGGAATGACCCTGAAGAATTCAACCCTGAAAGGTTTGCAAATAGCTCTGTAGATTTTAGAGGACAACATTTTGACCTATTACCGTTTGGTTCTGGTCGAAGGATTTGTCCCGGAATGCCAATGGCGATTGCTAGTGTGGAACTAGCATTGATGAATTTGCTTTATTATTTTGATTGGAGTATGCCTGATGGGACTAAAGGTGAAGACATTGATATGGAAGAAGCTGGTAATATCTCTATTGTCAAGAAAATACCTCTTCAACTTGTGCCTGTTCAACGTTATTGATGAGCAATAATATAAGCTCGATAACATGGAAAGTGTATGAAGCAAAAAACATAAGATTCTTTAGATTTTGTTGTGTTATATAAGAAAGAAATGTTCCAATAATAAATCAAGAAAGAATAACTTTTGTTCATTT

SEQ ID NO: 2651 - DNA, 1587 bp, Arabidopsis thaliana
  misc_feature (1)..(1587): Ceres cDNA ID no. 13620224
  misc_feature (1)..(1587): Also known as  Ceres CDNA ID no. 23533084
gcattcacacaacaacaacaactaagaaatggcacgatatgaattcttccgccaaatattcattgtcttgtctatagtttctccgttggtcagatctttcactgtgatcacctccgactcgacggccccatctgctctgatcgacggcccacaaactggattcacgatgaccaatgacggcgctcgcacggagcctgacgagcaagacgccgtctacgacattatgcgtgcgaccggcaacgactgggctgccgcgattccagacgtttgccgagggagatggcacgggatcgagtgtatgccggaccaggataacgtctaccacgtggtctctctgtcgttcggagcgctctcagacgacacggcgtttccgacttgtgatccacaacgctcttacgtctctgagtccctcacgaggctcaaacacctcaaagccttgttcttctaccgatgtttaggccgcgccccacagcgcataccggcgtttctgggacgcctcggctcgagtctgcaaacgctggttctgagggagaatggttttttgggacctatccctgacgaattgggcaatctcaccaatttgaaagttcttgatttgcataaaaatcacctcaacggctccattcccttgtcgttcaaccggttctccggtttaagatcgcttgatttgagtggtaaccggttgactggttccattcccggttttgttcttccggcgctgagcgttctggatttgaaccagaatcttttaaccggaccggttccacccacactcacaagctgtggatcgttgatcaaaatcgatcttagccgaaacagagtcactggtcctatcccagaatcgattaaccggctcaaccaattagtgcttttggatttgagctataaccggttatcaggtccattcccgtcttctctccaaggcctaaactctcttcaagctttaatgctcaaaggcaacacaaaattctcaacaacgattcctgaaaacgcgttcaaagggctcaagaacttgatgattcttgttctctcgaatacgaacatccagggctcgataccgaaatcattgactcggttaaacagtcttcgggtccttcacctagagggcaataatctgaccggagagattcctttggagttccgggacgtgaagcatctaagcgagctgaggctcaacgataacagtctgacaggaccagtaccgttcgagagagacacagtgtggaggatgaggagaaagctgaggctgtataacaatgctggtttgtgtgttaaccgggacagtgacttggatgatgcattcggttcaaaatctggttcaactgtaagattgtgtgatgcagaaacgtcgagaccagctccttccggtacggtccagcacctatctagagaagaagacggtgctttgccggacggagctacggacgtgtcaagcacttccaagtctttggggttctcctatctttctgcattctttcttgtattccctaatttcatttttatgctaatatctagttagaggagggatgataaaactgctgtaaatacttcccgagtttaataatgttagttagatgccttttctcc

SEQ ID NO: 2652 - protein, 1587 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
GCATTCACACAACAACAACAACTAAGAAATGGCACGATATGAATTCTTCCGCCAAATATTCATTGTCTTGTCTATAGTTTCTCCGTTGGTCAGATCTTTCACTGTGATCACCTCCGACTCGACGGCCCCATCTGCTCTGATCGACGGCCCACAAACTGGATTCACGATGACCAATGACGGCGCTCGCACGGAGCCTGACGAGCAAGACGCCGTCTACGACATTATGCGTGCGACCGGCAACGACTGGGCTGCCGCGATTCCAGACGTTTGCCGAGGGAGATGGCACGGGATCGAGTGTATGCCGGACCAGGATAACGTCTACCACGTGGTCTCTCTGTCGTTCGGAGCGCTCTCAGACGACACGGCGTTTCCGACTTGTGATCCACAACGCTCTTACGTCTCTGAGTCCCTCACGAGGCTCAAACACCTCAAAGCCTTGTTCTTCTACCGATGTTTAGGCCGCGCCCCACAGCGCATACCGGCGTTTCTGGGACGCCTCGGCTCGAGTCTGCAAACGCTGGTTCTGAGGGAGAATGGTTTTTTGGGACCTATCCCTGACGAATTGGGCAATCTCACCAATTTGAAAGTTCTTGATTTGCATAAAAATCACCTCAACGGCTCCATTCCCTTGTCGTTCAACCGGTTCTCCGGTTTAAGATCGCTTGATTTGAGTGGTAACCGGTTGACTGGTTCCATTCCCGGTTTTGTTCTTCCGGCGCTGAGCGTTCTGGATTTGAACCAGAATCTTTTAACCGGACCGGTTCCACCCACACTCACAAGCTGTGGATCGTTGATCAAAATCGATCTTAGCCGAAACAGAGTCACTGGTCCTATCCCAGAATCGATTAACCGGCTCAACCAATTAGTGCTTTTGGATTTGAGCTATAACCGGTTATCAGGTCCATTCCCGTCTTCTCTCCAAGGCCTAAACTCTCTTCAAGCTTTAATGCTCAAAGGCAACACAAAATTCTCAACAACGATTCCTGAAAACGCGTTCAAAGGGCTCAAGAACTTGATGATTCTTGTTCTCTCGAATACGAACATCCAGGGCTCGATACCGAAATCATTGACTCGGTTAAACAGTCTTCGGGTCCTTCACCTAGAGGGCAATAATCTGACCGGAGAGATTCCTTTGGAGTTCCGGGACGTGAAGCATCTAAGCGAGCTGAGGCTCAACGATAACAGTCTGACAGGACCAGTACCGTTCGAGAGAGACACAGTGTGGAGGATGAGGAGAAAGCTGAGGCTGTATAACAATGCTGGTTTGTGTGTTAACCGGGACAGTGACTTGGATGATGCATTCGGTTCAAAATCTGGTTCAACTGTAAGATTGTGTGATGCAGAAACGTCGAGACCAGCTCCTTCCGGTACGGTCCAGCACCTATCTAGAGAAGAAGACGGTGCTTTGCCGGACGGAGCTACGGACGTGTCAAGCACTTCCAAGTCTTTGGGGTTCTCCTATCTTTCTGCATTCTTTCTTGTATTCCCTAATTTCATTTTTATGCTAATATCTAGTTAGAGGAGGGATGATAAAACTGCTGTAAATACTTCCCGAGTTTAATAATGTTAGTTAGATGCCTTTTCTCC

SEQ ID NO: 2653 - DNA, 1538 bp, Arabidopsis thaliana
  misc_feature (1)..(1538): Ceres cDNA ID no. 13620313
  misc_feature (1)..(1538): Also known as  Ceres CDNA ID no. 23533084
tccccgatctccgacccgactaaagaaatgggatcgtctgcggatacagagacggcgatgataatcgccacaccggcgtcgaaccataataatccggcaaccaacggcggagatgcgaatcagaatcatacttctggtgcgatactcgctctcacgaattcagaatcggatgcttcgaagaagagaagaatgggggtgcttccgctcgaggttggtactcgcgtgatgtgtcaatggagagacggaaaataccatccggtgaaggttatcgagcgccgaaagaattataatggtggtcacaatgattacgagtactacgttcattacacagagtttaatagaagattggatgaatggattaagcttgaacagcttgaccttgattcagtagagtgtgctttagatgaaaaagttgaagacaaggtgactagcttgaagatgacacgacaccagaaacggaagattgatgagactcatgtagagggtcatgaagagctggatgctgccagtttgcgtgaacacgaggagttcacgaaagtgaagaacatagctacgattgagcttgggaagtatgagattgagacgtggtacttctctccttttcctccagaatacaatgactgcgtgaagctctttttctgtgagttttgcctcagttttatgaagcgcaaagagcagcttcaaagacatatgaggaaatgcgatttgaagcacccccctggggatgaaatctatcgaagctctactttgtcaatgtttgaggtggatggcaagaagaataaggtctatgcacagaacctctgttatctggcaaagttatttcttgaccacaaaactctttactatgacgttgatttgttcctgttctatattctctgtgaatgtgatgatcgtggatgccacatggttggatacttttcaaaggaaaaacactcagaagaagcttacaacttggcttgcatccttacacttcctccatatcaaaggaagggctatggcaaattcttaatagccttctcctatgaactctcaaagaaagagggcaaagtcgggacaccggaaaggccgctctctgatctagggttagtgagttacagaggttactggactcggattttattagacattttgaaaaagcacaagggaaacatatctatcaaggagctgagcgacatgacagcgattaaagcagaagatatattaagcaccctgcagagcttggaactgatacaatacaggaaaggacaacacgtaatctgcgcggatcctaaggtactggaccgacacttgaaagcggcaggccgaggtggtcttgatgtggatgtgagcaaaatgatatggactccttacaaagagcagagctaagagggcattacacttcaaatagttatggttatggtctacttttaatctgcatatccttagatgacttttgtctgtaacaatttaacacgcactctgttcaatagatcttgtaactgtaggaatcttttgtctggatggtaaaacgatcagtagtaactttggtgtttcattct

SEQ ID NO: 2654 - protein, 1538 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
TCCCCGATCTCCGACCCGACTAAAGAAATGGGATCGTCTGCGGATACAGAGACGGCGATGATAATCGCCACACCGGCGTCGAACCATAATAATCCGGCAACCAACGGCGGAGATGCGAATCAGAATCATACTTCTGGTGCGATACTCGCTCTCACGAATTCAGAATCGGATGCTTCGAAGAAGAGAAGAATGGGGGTGCTTCCGCTCGAGGTTGGTACTCGCGTGATGTGTCAATGGAGAGACGGAAAATACCATCCGGTGAAGGTTATCGAGCGCCGAAAGAATTATAATGGTGGTCACAATGATTACGAGTACTACGTTCATTACACAGAGTTTAATAGAAGATTGGATGAATGGATTAAGCTTGAACAGCTTGACCTTGATTCAGTAGAGTGTGCTTTAGATGAAAAAGTTGAAGACAAGGTGACTAGCTTGAAGATGACACGACACCAGAAACGGAAGATTGATGAGACTCATGTAGAGGGTCATGAAGAGCTGGATGCTGCCAGTTTGCGTGAACACGAGGAGTTCACGAAAGTGAAGAACATAGCTACGATTGAGCTTGGGAAGTATGAGATTGAGACGTGGTACTTCTCTCCTTTTCCTCCAGAATACAATGACTGCGTGAAGCTCTTTTTCTGTGAGTTTTGCCTCAGTTTTATGAAGCGCAAAGAGCAGCTTCAAAGACATATGAGGAAATGCGATTTGAAGCACCCCCCTGGGGATGAAATCTATCGAAGCTCTACTTTGTCAATGTTTGAGGTGGATGGCAAGAAGAATAAGGTCTATGCACAGAACCTCTGTTATCTGGCAAAGTTATTTCTTGACCACAAAACTCTTTACTATGACGTTGATTTGTTCCTGTTCTATATTCTCTGTGAATGTGATGATCGTGGATGCCACATGGTTGGATACTTTTCAAAGGAAAAACACTCAGAAGAAGCTTACAACTTGGCTTGCATCCTTACACTTCCTCCATATCAAAGGAAGGGCTATGGCAAATTCTTAATAGCCTTCTCCTATGAACTCTCAAAGAAAGAGGGCAAAGTCGGGACACCGGAAAGGCCGCTCTCTGATCTAGGGTTAGTGAGTTACAGAGGTTACTGGACTCGGATTTTATTAGACATTTTGAAAAAGCACAAGGGAAACATATCTATCAAGGAGCTGAGCGACATGACAGCGATTAAAGCAGAAGATATATTAAGCACCCTGCAGAGCTTGGAACTGATACAATACAGGAAAGGACAACACGTAATCTGCGCGGATCCTAAGGTACTGGACCGACACTTGAAAGCGGCAGGCCGAGGTGGTCTTGATGTGGATGTGAGCAAAATGATATGGACTCCTTACAAAGAGCAGAGCTAAGAGGGCATTACACTTCAAATAGTTATGGTTATGGTCTACTTTTAATCTGCATATCCTTAGATGACTTTTGTCTGTAACAATTTAACACGCACTCTGTTCAATAGATCTTGTAACTGTAGGAATCTTTTGTCTGGATGGTAAAACGATCAGTAGTAACTTTGGTGTTTCATTCT

SEQ ID NO: 2655 - DNA, 1524 bp, Arabidopsis thaliana
  misc_feature (1)..(1524): Ceres cDNA ID no. 13620338
  misc_feature (1)..(1524): Also known as  Ceres CDNA ID no. 23533084
atctacgaagagagaccatggccgagccaaaaccgaagcttcatgttgcagtgttcccatggttagctttaggtcacatgattccttacttgcaactctcaaagctcatagcaaggaaaggccatactgtgtccttcatctccacagctcgtaacatttcacgtcttcccaatatatcctccgacctttccgtgaatttcgtttctttgccgttaagtcaaaccgtcgaccatctcccagagaacgctgaggccaccactgatgtcccggagactcacatagcttatctgaagaaagcatttgatgggctttctgaagctttcacagagtttttagaagcttccaaaccaaactggatagtgtatgatatcttgcaccattgggtcccgcctatcgctgagaagctcggcgtgagacgagccatcttctgcacgttcaacgcagcttccatcatcatcatcggtgggccagcatcagtcatgattcaaggtcatgaccctcgaaagactgctgaagatcttatcgtgcctccaccatgggtcccgtttgagaccaacatagtttaccgtctctttgaagctaagaggatcatggagtatcccacggcaggtgtaactggagttgaattgaacgacaactgtagattgggtttggcttacgttggctctgaggttattgtgattagatcatgtatggaactcgaacctgagtggattcaattgctcagtaaactccaaggaaagcctgtgattccaattggtttactcccggctacaccaatggatgatgcagatgacgagggaacatggttagacatcagagaatggctagacagacatcaagcaaagtctgtggtttatgtagccttaggaactgaagtgacaattagtaacgaagagattcaaggtttagctcatgggttggagctttgcaggttacctttcttttggacgctaaggaagaggactagagcttctatgctactacctgatgggttcaaagagagagtcaaagagcgtggagtcatttggaccgagtgggtacctcagaccaagatactgagccatggttcagttggtgggtttgttactcattgtggttggggatcagctgtggaagggcttagctttggtgtccctttgatcatgtttccatgtaacctagaccagccgctagtggctaggttgctcagtgggatgaatataggcttggagattccaaggaatgagcgagacgggctgttcacgagtgcttctgttgcagagacaatcagacatgttgttgtggaagaagaaggaaagatctacaggaacaatgctgcatctcagcaaaagaaaatattcgggaacaagagattgcaagatcagtatgcggatggttttatcgagtttctggagaatcctatagcaggagtgtagagcaaaataatgaagaattatactgtcttctctgtcaacgtcagcgatgtgtgtaataagagttgagaaataaggcacaatcaatgtgataaccaatgttaatttt

SEQ ID NO: 2656 - protein, 1524 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ATCTACGAAGAGAGACCATGGCCGAGCCAAAACCGAAGCTTCATGTTGCAGTGTTCCCATGGTTAGCTTTAGGTCACATGATTCCTTACTTGCAACTCTCAAAGCTCATAGCAAGGAAAGGCCATACTGTGTCCTTCATCTCCACAGCTCGTAACATTTCACGTCTTCCCAATATATCCTCCGACCTTTCCGTGAATTTCGTTTCTTTGCCGTTAAGTCAAACCGTCGACCATCTCCCAGAGAACGCTGAGGCCACCACTGATGTCCCGGAGACTCACATAGCTTATCTGAAGAAAGCATTTGATGGGCTTTCTGAAGCTTTCACAGAGTTTTTAGAAGCTTCCAAACCAAACTGGATAGTGTATGATATCTTGCACCATTGGGTCCCGCCTATCGCTGAGAAGCTCGGCGTGAGACGAGCCATCTTCTGCACGTTCAACGCAGCTTCCATCATCATCATCGGTGGGCCAGCATCAGTCATGATTCAAGGTCATGACCCTCGAAAGACTGCTGAAGATCTTATCGTGCCTCCACCATGGGTCCCGTTTGAGACCAACATAGTTTACCGTCTCTTTGAAGCTAAGAGGATCATGGAGTATCCCACGGCAGGTGTAACTGGAGTTGAATTGAACGACAACTGTAGATTGGGTTTGGCTTACGTTGGCTCTGAGGTTATTGTGATTAGATCATGTATGGAACTCGAACCTGAGTGGATTCAATTGCTCAGTAAACTCCAAGGAAAGCCTGTGATTCCAATTGGTTTACTCCCGGCTACACCAATGGATGATGCAGATGACGAGGGAACATGGTTAGACATCAGAGAATGGCTAGACAGACATCAAGCAAAGTCTGTGGTTTATGTAGCCTTAGGAACTGAAGTGACAATTAGTAACGAAGAGATTCAAGGTTTAGCTCATGGGTTGGAGCTTTGCAGGTTACCTTTCTTTTGGACGCTAAGGAAGAGGACTAGAGCTTCTATGCTACTACCTGATGGGTTCAAAGAGAGAGTCAAAGAGCGTGGAGTCATTTGGACCGAGTGGGTACCTCAGACCAAGATACTGAGCCATGGTTCAGTTGGTGGGTTTGTTACTCATTGTGGTTGGGGATCAGCTGTGGAAGGGCTTAGCTTTGGTGTCCCTTTGATCATGTTTCCATGTAACCTAGACCAGCCGCTAGTGGCTAGGTTGCTCAGTGGGATGAATATAGGCTTGGAGATTCCAAGGAATGAGCGAGACGGGCTGTTCACGAGTGCTTCTGTTGCAGAGACAATCAGACATGTTGTTGTGGAAGAAGAAGGAAAGATCTACAGGAACAATGCTGCATCTCAGCAAAAGAAAATATTCGGGAACAAGAGATTGCAAGATCAGTATGCGGATGGTTTTATCGAGTTTCTGGAGAATCCTATAGCAGGAGTGTAGAGCAAAATAATGAAGAATTATACTGTCTTCTCTGTCAACGTCAGCGATGTGTGTAATAAGAGTTGAGAAATAAGGCACAATCAATGTGATAACCAATGTTAATTTT

SEQ ID NO: 2657 - DNA, 1773 bp, Arabidopsis thaliana
  misc_feature (1)..(1773): Ceres cDNA ID no. 13620576
  misc_feature (1)..(1773): Also known as  Ceres CDNA ID no. 23533084
acttgcactcctctttttctttctttctttcttgttggtctctcttacttctttcttattcatctaaaacaatttcgatccatttacacataaatatatgtaactggccgtagaagaaacacattgaaggaagagatggctcataggagattaatcatgacgatgacaaagatgatgatgatggtgaccatgatgatgatgatggataaaacatgcatatgtgcggacatttccagaggcagttttccaaagggctttgtctttggaactgcttcttcggcttttcagcatgaaggagcggtgaaggcagaaggcagaggtcctacgatatgggacacattttcccacacttttggtaaaatcaccgattttagcaatgctgatgtcgctgttgatcagtatcatcgttacgaggaagatgtacaacttatgaagaatatgggaatggacgcttacagattttccatttcttggacccgcatctttccaaatggtgttggacatataaatgaagccggaatcgatcactacaacaaactcataaatgctttacttgctaaagggatcgagccgtacgtgacactgtaccactgggatcttccacaagcacttcatgatcgatacctcggttggctaaacccacaaatcataaatgattttgcagcgtatgcggaggtttgtttccagagatttggagatagagtgaagcactggatcacgttcaacgagccacacacgttcgcgatacaaggctatgatgttggcctacaagctccaggccgttgcactattctttttaagctcacttgtcgcgaaggaaactcatcgaccgagccttacattgttggtcacaatgttattttaactcacgccacagtatccgatatctataggaaaaagtataaggcaaagcaaggaggttcgttagggattgcgtttgatgtaatgtggtttgaaccagagtcgaacaagacagaggacattgaagctgcacaaagagctcaagactttcaacttggctggtttttggatccgttgatgtttggggattacccaagctcgatgagaagcagagtcggaagcagattaccggtgtttacaggatctcaatcttctctggtgaagggttctttagattttgtagggattaatcactacacaacgtactacgcaaggaacaatgccaccaatctcattggcactcttctacacgacgccgtttctgattctggaaccgtcactctaccgtttaagggtttaagcacgattggagatagggcaagttcgatatggttgtacatagtgcctagagggatgagaagcttgatgaattacattaaacatagatatggaaaccctccagtcttcatcactgaaaatggaatggacgacccaaacagcattctgatctcaagaaaagacgctctcaaagatgcaaagaggatcaaataccatcatgattacctttctagcttacaagcttcgataaaagaggatggatgtaatgtcaaagggtacttcgtatggtcgctattggacaattgggaatgggcagcaggttatagttcaagatttggtctctacttcgttgattacagagacaacctcaagagatatcctaaagactctgttcattggttcacttctttcttaaactccacttcttgatttttccttcccattttattggtttagcgtaatgtatacaaaagtttatgattagttatggatttcggtttagataaatatatttaaatcaagatatgttgatat

SEQ ID NO: 2658 - protein, 1773 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ACTTGCACTCCTCTTTTTCTTTCTTTCTTTCTTGTTGGTCTCTCTTACTTCTTTCTTATTCATCTAAAACAATTTCGATCCATTTACACATAAATATATGTAACTGGCCGTAGAAGAAACACATTGAAGGAAGAGATGGCTCATAGGAGATTAATCATGACGATGACAAAGATGATGATGATGGTGACCATGATGATGATGATGGATAAAACATGCATATGTGCGGACATTTCCAGAGGCAGTTTTCCAAAGGGCTTTGTCTTTGGAACTGCTTCTTCGGCTTTTCAGCATGAAGGAGCGGTGAAGGCAGAAGGCAGAGGTCCTACGATATGGGACACATTTTCCCACACTTTTGGTAAAATCACCGATTTTAGCAATGCTGATGTCGCTGTTGATCAGTATCATCGTTACGAGGAAGATGTACAACTTATGAAGAATATGGGAATGGACGCTTACAGATTTTCCATTTCTTGGACCCGCATCTTTCCAAATGGTGTTGGACATATAAATGAAGCCGGAATCGATCACTACAACAAACTCATAAATGCTTTACTTGCTAAAGGGATCGAGCCGTACGTGACACTGTACCACTGGGATCTTCCACAAGCACTTCATGATCGATACCTCGGTTGGCTAAACCCACAAATCATAAATGATTTTGCAGCGTATGCGGAGGTTTGTTTCCAGAGATTTGGAGATAGAGTGAAGCACTGGATCACGTTCAACGAGCCACACACGTTCGCGATACAAGGCTATGATGTTGGCCTACAAGCTCCAGGCCGTTGCACTATTCTTTTTAAGCTCACTTGTCGCGAAGGAAACTCATCGACCGAGCCTTACATTGTTGGTCACAATGTTATTTTAACTCACGCCACAGTATCCGATATCTATAGGAAAAAGTATAAGGCAAAGCAAGGAGGTTCGTTAGGGATTGCGTTTGATGTAATGTGGTTTGAACCAGAGTCGAACAAGACAGAGGACATTGAAGCTGCACAAAGAGCTCAAGACTTTCAACTTGGCTGGTTTTTGGATCCGTTGATGTTTGGGGATTACCCAAGCTCGATGAGAAGCAGAGTCGGAAGCAGATTACCGGTGTTTACAGGATCTCAATCTTCTCTGGTGAAGGGTTCTTTAGATTTTGTAGGGATTAATCACTACACAACGTACTACGCAAGGAACAATGCCACCAATCTCATTGGCACTCTTCTACACGACGCCGTTTCTGATTCTGGAACCGTCACTCTACCGTTTAAGGGTTTAAGCACGATTGGAGATAGGGCAAGTTCGATATGGTTGTACATAGTGCCTAGAGGGATGAGAAGCTTGATGAATTACATTAAACATAGATATGGAAACCCTCCAGTCTTCATCACTGAAAATGGAATGGACGACCCAAACAGCATTCTGATCTCAAGAAAAGACGCTCTCAAAGATGCAAAGAGGATCAAATACCATCATGATTACCTTTCTAGCTTACAAGCTTCGATAAAAGAGGATGGATGTAATGTCAAAGGGTACTTCGTATGGTCGCTATTGGACAATTGGGAATGGGCAGCAGGTTATAGTTCAAGATTTGGTCTCTACTTCGTTGATTACAGAGACAACCTCAAGAGATATCCTAAAGACTCTGTTCATTGGTTCACTTCTTTCTTAAACTCCACTTCTTGATTTTTCCTTCCCATTTTATTGGTTTAGCGTAATGTATACAAAAGTTTATGATTAGTTATGGATTTCGGTTTAGATAAATATATTTAAATCAAGATATGTTGATAT

SEQ ID NO: 2659 - DNA, 1801 bp, Arabidopsis thaliana
  misc_feature (1)..(1801): Ceres cDNA ID no. 13620725
  misc_feature (1)..(1801): Also known as  Ceres CDNA ID no. 23533084
atggatagtaggaggggtgtatagggctttcaagtcttttcttacagaaactatctataactctagcagagagctcattatagaacagaacagaaacagagctttctaagtctacagcacagaaataaacctcatttacagactgttttactttctttcctttttgagcatttcttctttctgtttctttcctctgttttctctttctttccctttttgggtgtcatctctttaagacagaagaaacgtttctcagagtttcctgtgaactcatctgtttgttctcttcttccggtttcactttttcatgtcctgccgttattacaacgaggattgtgtttgatccgatggaaggattggaatctgtgtacgctcaagctatgtatggaatgacacgagagagcaaaatcatggagcatcaaggatcagatttgatttggggaggaaatgagctaatggctcgagaactctgttcttcttcttcttatcaccaccaactcattaatccgaatcttagcagctgtttcatgtctgatcttggagtcttaggtgagattcaacagcagcaacatgttggcaacagagctagctcgatagatccatcatcactcgattgtttgttatctgcgacgtcgaatagcaacaacacctcgacggaggacgatgaaggaatatctgtgcttttctcagattgtcagactctttggagctttggtggagtctcatctgcagagtctgagaacagagagatcactactgagacgacaacaacgataaagcctaagcctttgaagagaaacagaggaggagatggaggaactactgagactacaacaacaacaacaaaacctaagtctttgaagagaaacagaggagacgagacaggaagtcactttagtcttgttcatcctcaagatgattcggagaaaggaggtttcaagcttatatacgatgagaatcaatcgaaatcaaagaaaccaagaacagagaaagaacgaggcggttcttcgaacattagtttccaacattcaacttgtttgtctgacaatgtcgagcccgatgctgaggcgattgcacaaatgaaggagatgatatacagagcggctgcatttagaccggtgaatttcgggttagagattgtggagaagcctaagaggaagaacgtcaagatatcgacggatcctcaaacggttgcagcgagacagagaagggagaggataagtgagaagattagggttttacaaacattggttccaggtgggacgaagatggatactgcatcaatgcttgatgaagctgctaattatctcaagttccttagagcacaagtaaaagctttagaaaacttgagacccaagcttgaccaaaccaatctctctttctcttctgctcctacatcgtttccattattccacccatcttttcttccattgcaaaatcctaatcaaatccatcatccagagtgttgacagattataaacttttgagtttcatcatcatcaacagaatcatggcgtcttgattgttttagcagttctcaagaaaggcaacttctgtgacaagggtggtgtcgggcagtgttgtttacactttccagtctttgttttgcatttctttttatataaagtttgtattttatatagaatctgtggaattcgagggttgaaatattgtgaaaaacagagccgcaagaggttaattacagtctctgcaatattttcaaccttttattactttattagagtaaagatagcgtaagataattgcaattatgaagcgatgattatcaacaaaagtgttt

SEQ ID NO: 2660 - protein, 1801 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ATGGATAGTAGGAGGGGTGTATAGGGCTTTCAAGTCTTTTCTTACAGAAACTATCTATAACTCTAGCAGAGAGCTCATTATAGAACAGAACAGAAACAGAGCTTTCTAAGTCTACAGCACAGAAATAAACCTCATTTACAGACTGTTTTACTTTCTTTCCTTTTTGAGCATTTCTTCTTTCTGTTTCTTTCCTCTGTTTTCTCTTTCTTTCCCTTTTTGGGTGTCATCTCTTTAAGACAGAAGAAACGTTTCTCAGAGTTTCCTGTGAACTCATCTGTTTGTTCTCTTCTTCCGGTTTCACTTTTTCATGTCCTGCCGTTATTACAACGAGGATTGTGTTTGATCCGATGGAAGGATTGGAATCTGTGTACGCTCAAGCTATGTATGGAATGACACGAGAGAGCAAAATCATGGAGCATCAAGGATCAGATTTGATTTGGGGAGGAAATGAGCTAATGGCTCGAGAACTCTGTTCTTCTTCTTCTTATCACCACCAACTCATTAATCCGAATCTTAGCAGCTGTTTCATGTCTGATCTTGGAGTCTTAGGTGAGATTCAACAGCAGCAACATGTTGGCAACAGAGCTAGCTCGATAGATCCATCATCACTCGATTGTTTGTTATCTGCGACGTCGAATAGCAACAACACCTCGACGGAGGACGATGAAGGAATATCTGTGCTTTTCTCAGATTGTCAGACTCTTTGGAGCTTTGGTGGAGTCTCATCTGCAGAGTCTGAGAACAGAGAGATCACTACTGAGACGACAACAACGATAAAGCCTAAGCCTTTGAAGAGAAACAGAGGAGGAGATGGAGGAACTACTGAGACTACAACAACAACAACAAAACCTAAGTCTTTGAAGAGAAACAGAGGAGACGAGACAGGAAGTCACTTTAGTCTTGTTCATCCTCAAGATGATTCGGAGAAAGGAGGTTTCAAGCTTATATACGATGAGAATCAATCGAAATCAAAGAAACCAAGAACAGAGAAAGAACGAGGCGGTTCTTCGAACATTAGTTTCCAACATTCAACTTGTTTGTCTGACAATGTCGAGCCCGATGCTGAGGCGATTGCACAAATGAAGGAGATGATATACAGAGCGGCTGCATTTAGACCGGTGAATTTCGGGTTAGAGATTGTGGAGAAGCCTAAGAGGAAGAACGTCAAGATATCGACGGATCCTCAAACGGTTGCAGCGAGACAGAGAAGGGAGAGGATAAGTGAGAAGATTAGGGTTTTACAAACATTGGTTCCAGGTGGGACGAAGATGGATACTGCATCAATGCTTGATGAAGCTGCTAATTATCTCAAGTTCCTTAGAGCACAAGTAAAAGCTTTAGAAAACTTGAGACCCAAGCTTGACCAAACCAATCTCTCTTTCTCTTCTGCTCCTACATCGTTTCCATTATTCCACCCATCTTTTCTTCCATTGCAAAATCCTAATCAAATCCATCATCCAGAGTGTTGACAGATTATAAACTTTTGAGTTTCATCATCATCAACAGAATCATGGCGTCTTGATTGTTTTAGCAGTTCTCAAGAAAGGCAACTTCTGTGACAAGGGTGGTGTCGGGCAGTGTTGTTTACACTTTCCAGTCTTTGTTTTGCATTTCTTTTTATATAAAGTTTGTATTTTATATAGAATCTGTGGAATTCGAGGGTTGAAATATTGTGAAAAACAGAGCCGCAAGAGGTTAATTACAGTCTCTGCAATATTTTCAACCTTTTATTACTTTATTAGAGTAAAGATAGCGTAAGATAATTGCAATTATGAAGCGATGATTATCAACAAAAGTGTTT

SEQ ID NO: 2661 - DNA, 2068 bp, Arabidopsis thaliana
  misc_feature (1)..(2068): Ceres cDNA ID no. 13620813
  misc_feature (1)..(2068): Also known as  Ceres CDNA ID no. 23533084
aatcttattttcacagactctcactagggttttggtttctcctatcagggttttaatcgttcaccatttctctcagagaaaatgtcttctctaatggccattcgttgcgcacgaacccagaatatcgtcacaatcggctctctccttcagttacgttcttcatttcccagactctcctctcaattccacttctccggtaccctaaactcaattccgatcaaacacctaagcacatccgccgccgcaaacgattaccaccagaatcctcaatctggatcaccgtctcagcatcaacgcccatatccacctcaaagcttcgattctcagaatcagaccaacactaatcaacgagttccacaaagccctaatcaatggtctactcaacacggtggtcaaatacctcaatacggtggtcaaaatcctcaacacgggggtcaaaggcctccatacggtggtcaaaatcctcaacaaggtggtcaaatgtctcaatacggtggtcacaatcctcaacacggtggtcacaggcctcagtacggtggtcagaggcctcaatacggtggacctggtaacaattatcagaatcagaatgttcaacaaagtaatcagagtcagtactacactccgcagcagcagcaacaaccgcaaccaccacgaagctcgaatcaaagccctaatcagatgaatgaggtagctcctcctcctagtgttgaagaggtgatgaggttatgtcagcgtaggctatataaagatgctattgaattgcttgataaaggagctatgcctgatagagaatgtttcgttttgttgtttgagtcttgtgcgaatttgaagtcgcttgagcattctaagaaggtacatgatcatttccttcagtctaagtttagaggtgatccaaaacttaacaatatggtgattagtatgtttggagagtgtagtagtattactgatgctaagagagtgtttgatcatatggttgataaagatatggattcttggcatttgatgatgtgtgcgtatagtgataacggaatgggagatgatgcgttgcatttgttcgaagagatgacgaaacatgggttgaagccgaacgaggagactttccttacggtcttcttggcttgtgctactgttggtggtatagaagaagcgtttttgcattttgattcgatgaagaacgagcatgggattagtccgaagacagagcattatttgggtgttttaggtgttcttgggaaatgtggacatcttgttgaggctgagcaatatatccgtgatcttccgtttgaacccacagctgatttctgggaggctatgcggaactatgctcggttacatggtgatatcgatttagaggattacatggaggaattgatggttgatgttgatccttcaaaggctgtaatcaacaaaattcctactcctccacctaaatcattcaaggaaacaaatatggttactagtaagagtaggatccttgagtttcgaaatctgactttctacaaggatgaagcaaaggagatggctgcaaagaaaggagtggtttatgttcctgacacacggtttgtgcttcatgatatcgatcaagaggctaaagaacaggcactactctaccacagtgagaggttagcgattgcttatggtatcatatgcaccccaccaaggaagaccctaacaatcatcaagaatctccgtgtgtgtggggattgtcacaactttatcaagatcatgtccaaaatcattggtagggtgttgatcgtgagagacaacaaacgtttccatcacttcaaagacggtaaatgttcttgcggggattactggtagagcggcgttttctgtgactttgtttcgcatcatgtatagcgcgctctaagctctcgccagaactttgctagcagttgggaaatggaatagtatttgctacgctgtaacaagtttcatctgctctagacccttttacatgaggaattatcaagtttattgctttatatctactattattggtctcattctcgaagaacgtgacttaatgttttgaaattagatcgtatgaataatgaactttgattac

SEQ ID NO: 2662 - protein, 2068 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
AATCTTATTTTCACAGACTCTCACTAGGGTTTTGGTTTCTCCTATCAGGGTTTTAATCGTTCACCATTTCTCTCAGAGAAAATGTCTTCTCTAATGGCCATTCGTTGCGCACGAACCCAGAATATCGTCACAATCGGCTCTCTCCTTCAGTTACGTTCTTCATTTCCCAGACTCTCCTCTCAATTCCACTTCTCCGGTACCCTAAACTCAATTCCGATCAAACACCTAAGCACATCCGCCGCCGCAAACGATTACCACCAGAATCCTCAATCTGGATCACCGTCTCAGCATCAACGCCCATATCCACCTCAAAGCTTCGATTCTCAGAATCAGACCAACACTAATCAACGAGTTCCACAAAGCCCTAATCAATGGTCTACTCAACACGGTGGTCAAATACCTCAATACGGTGGTCAAAATCCTCAACACGGGGGTCAAAGGCCTCCATACGGTGGTCAAAATCCTCAACAAGGTGGTCAAATGTCTCAATACGGTGGTCACAATCCTCAACACGGTGGTCACAGGCCTCAGTACGGTGGTCAGAGGCCTCAATACGGTGGACCTGGTAACAATTATCAGAATCAGAATGTTCAACAAAGTAATCAGAGTCAGTACTACACTCCGCAGCAGCAGCAACAACCGCAACCACCACGAAGCTCGAATCAAAGCCCTAATCAGATGAATGAGGTAGCTCCTCCTCCTAGTGTTGAAGAGGTGATGAGGTTATGTCAGCGTAGGCTATATAAAGATGCTATTGAATTGCTTGATAAAGGAGCTATGCCTGATAGAGAATGTTTCGTTTTGTTGTTTGAGTCTTGTGCGAATTTGAAGTCGCTTGAGCATTCTAAGAAGGTACATGATCATTTCCTTCAGTCTAAGTTTAGAGGTGATCCAAAACTTAACAATATGGTGATTAGTATGTTTGGAGAGTGTAGTAGTATTACTGATGCTAAGAGAGTGTTTGATCATATGGTTGATAAAGATATGGATTCTTGGCATTTGATGATGTGTGCGTATAGTGATAACGGAATGGGAGATGATGCGTTGCATTTGTTCGAAGAGATGACGAAACATGGGTTGAAGCCGAACGAGGAGACTTTCCTTACGGTCTTCTTGGCTTGTGCTACTGTTGGTGGTATAGAAGAAGCGTTTTTGCATTTTGATTCGATGAAGAACGAGCATGGGATTAGTCCGAAGACAGAGCATTATTTGGGTGTTTTAGGTGTTCTTGGGAAATGTGGACATCTTGTTGAGGCTGAGCAATATATCCGTGATCTTCCGTTTGAACCCACAGCTGATTTCTGGGAGGCTATGCGGAACTATGCTCGGTTACATGGTGATATCGATTTAGAGGATTACATGGAGGAATTGATGGTTGATGTTGATCCTTCAAAGGCTGTAATCAACAAAATTCCTACTCCTCCACCTAAATCATTCAAGGAAACAAATATGGTTACTAGTAAGAGTAGGATCCTTGAGTTTCGAAATCTGACTTTCTACAAGGATGAAGCAAAGGAGATGGCTGCAAAGAAAGGAGTGGTTTATGTTCCTGACACACGGTTTGTGCTTCATGATATCGATCAAGAGGCTAAAGAACAGGCACTACTCTACCACAGTGAGAGGTTAGCGATTGCTTATGGTATCATATGCACCCCACCAAGGAAGACCCTAACAATCATCAAGAATCTCCGTGTGTGTGGGGATTGTCACAACTTTATCAAGATCATGTCCAAAATCATTGGTAGGGTGTTGATCGTGAGAGACAACAAACGTTTCCATCACTTCAAAGACGGTAAATGTTCTTGCGGGGATTACTGGTAGAGCGGCGTTTTCTGTGACTTTGTTTCGCATCATGTATAGCGCGCTCTAAGCTCTCGCCAGAACTTTGCTAGCAGTTGGGAAATGGAATAGTATTTGCTACGCTGTAACAAGTTTCATCTGCTCTAGACCCTTTTACATGAGGAATTATCAAGTTTATTGCTTTATATCTACTATTATTGGTCTCATTCTCGAAGAACGTGACTTAATGTTTTGAAATTAGATCGTATGAATAATGAACTTTGATTAC

SEQ ID NO: 2663 - DNA, 1600 bp, Arabidopsis thaliana
  misc_feature (1)..(1600): Ceres cDNA ID no. 13621023
  misc_feature (1)..(1600): Also known as  Ceres CDNA ID no. 23533084
atggatgtgagcaaagtaaccacaagcgacggcggaggagattcaatggagactaagccatctcctcaacctcagcctgcggcgattctaagttcaaacgcgcctcctccgtttctgagcaagacctatgatatggttgatgatcacaatacagattcgattgtctcttggagtgctaataacaacagttttatcgtttggaaaccaccggagttcgctcgcgatcttcttcctaagaactttaagcataataatttctccagcttcgttagacagcttaatacctatggtttcaggaaggttgacccagatagatgggaatttgcgaatgaaggttttttaagaggtcagaagcacttgctacaatcaataactaggcgaaaacctgcccatggacagggacagggacatcagcgatctcagcactcgaatggacagaactcatctgttagcgcatgtgttgaagttggcaaatttggtctcgaagaagaagttgaaaggcttaaaagagataagaacgtccttatgcaagaactcgtcagattaagacagcagcaacagtccactgataaccaacttcaaacgatggttcagcgtctccagggcatggagaatcggcaacaacaattaatgtcattccttgcaaaggcagtacaaagccctcattttctatctcaattcttacagcagcagaatcagcaaaacgagagtaataggcgcatcagtgataccagtaagaagcggagattcaagcgagacggcattgtccgtaataatgattctgctactcctgatggacagatagtgaagtatcaacctccaatgcacgagcaagccaaagcaatgtttaaacagcttatgaagatggaaccttacaaaaccggcgatgatggtttccttctaggtaatggtacgtctactaccgagggaacagagatggagacttcatcaaaccaagtatcgggtataactcttaaggaaatgcctacagcttctgagatacagtcatcatcaccaattgaaacaactcctgaaaatgtttcggcagcatcagaagcaaccgagaactgtattccttcacctgatgatctaactcttcccgacttcactcatatgctaccggaaaataattcagagaagcctccagagagtttcatggaaccaaacctgggaggttctagtccattactagatccagatctgttgatcgatgattctttgtccttcgacattgacgactttccaatggattctgatatagaccctgttgattacggtttactcgaacgcttactcatgtcaagcccggttccagataatatggattcaacaccagtggacaatgaaacagagcaggaacaaaatggatgggacaaaactaagcatatggataatctgactcaacagatgggtctcctctctcctgaaaccttagatctctcaaggcaaaatccttgattttgggagtttttaaagtcttttgaggtaacacagtccctgagagcagcatattcatttttcatacgctgatcttttatttcttctttcttgtatcaaagtggtttaacattactgcttcatacaactctcaattttacac

SEQ ID NO: 2664 - protein, 1600 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ATGGATGTGAGCAAAGTAACCACAAGCGACGGCGGAGGAGATTCAATGGAGACTAAGCCATCTCCTCAACCTCAGCCTGCGGCGATTCTAAGTTCAAACGCGCCTCCTCCGTTTCTGAGCAAGACCTATGATATGGTTGATGATCACAATACAGATTCGATTGTCTCTTGGAGTGCTAATAACAACAGTTTTATCGTTTGGAAACCACCGGAGTTCGCTCGCGATCTTCTTCCTAAGAACTTTAAGCATAATAATTTCTCCAGCTTCGTTAGACAGCTTAATACCTATGGTTTCAGGAAGGTTGACCCAGATAGATGGGAATTTGCGAATGAAGGTTTTTTAAGAGGTCAGAAGCACTTGCTACAATCAATAACTAGGCGAAAACCTGCCCATGGACAGGGACAGGGACATCAGCGATCTCAGCACTCGAATGGACAGAACTCATCTGTTAGCGCATGTGTTGAAGTTGGCAAATTTGGTCTCGAAGAAGAAGTTGAAAGGCTTAAAAGAGATAAGAACGTCCTTATGCAAGAACTCGTCAGATTAAGACAGCAGCAACAGTCCACTGATAACCAACTTCAAACGATGGTTCAGCGTCTCCAGGGCATGGAGAATCGGCAACAACAATTAATGTCATTCCTTGCAAAGGCAGTACAAAGCCCTCATTTTCTATCTCAATTCTTACAGCAGCAGAATCAGCAAAACGAGAGTAATAGGCGCATCAGTGATACCAGTAAGAAGCGGAGATTCAAGCGAGACGGCATTGTCCGTAATAATGATTCTGCTACTCCTGATGGACAGATAGTGAAGTATCAACCTCCAATGCACGAGCAAGCCAAAGCAATGTTTAAACAGCTTATGAAGATGGAACCTTACAAAACCGGCGATGATGGTTTCCTTCTAGGTAATGGTACGTCTACTACCGAGGGAACAGAGATGGAGACTTCATCAAACCAAGTATCGGGTATAACTCTTAAGGAAATGCCTACAGCTTCTGAGATACAGTCATCATCACCAATTGAAACAACTCCTGAAAATGTTTCGGCAGCATCAGAAGCAACCGAGAACTGTATTCCTTCACCTGATGATCTAACTCTTCCCGACTTCACTCATATGCTACCGGAAAATAATTCAGAGAAGCCTCCAGAGAGTTTCATGGAACCAAACCTGGGAGGTTCTAGTCCATTACTAGATCCAGATCTGTTGATCGATGATTCTTTGTCCTTCGACATTGACGACTTTCCAATGGATTCTGATATAGACCCTGTTGATTACGGTTTACTCGAACGCTTACTCATGTCAAGCCCGGTTCCAGATAATATGGATTCAACACCAGTGGACAATGAAACAGAGCAGGAACAAAATGGATGGGACAAAACTAAGCATATGGATAATCTGACTCAACAGATGGGTCTCCTCTCTCCTGAAACCTTAGATCTCTCAAGGCAAAATCCTTGATTTTGGGAGTTTTTAAAGTCTTTTGAGGTAACACAGTCCCTGAGAGCAGCATATTCATTTTTCATACGCTGATCTTTTATTTCTTCTTTCTTGTATCAAAGTGGTTTAACATTACTGCTTCATACAACTCTCAATTTTACAC

SEQ ID NO: 2665 - DNA, 3291 bp, Arabidopsis thaliana
  misc_feature (1)..(3291): Ceres cDNA ID no. 13621059
  misc_feature (1)..(3291): Also known as  Ceres CDNA ID no. 23533084
atctatctgattctgatcgtgtacaaaaaacatgaacccttcttttgtttttataagcctatcaacaatttgcagtctttcaacttgtaaactttagcttcttcttcctctctttttctcccaaacacaaaatttctctctcttttcttgcaacctaagttagctcctctaggttacttttgatctttctctgaaatgcgtctcaaaaatttccccttttttgttctcttcttcttcttttgcttcaacagcaatcaatcatggggcttgatgagttcgaaccaacaacctcaattcttcaaacttatgaagaactctctcttcggcgacgctttgtccacttggaatgtctatgacgttggtaccaactactgtaacttcaccggcgtaagatgtgacggtcaagggctagtcaccgatcttgatctttccggtttgtcactctccgggattttccctgatggggtttgctcttacttcccaaacctccgtgtacttcgtctctctcacaaccatctcaacaaaagtagcagcttcctcaacaccatccctaattgttctctgcttcgagacctaaacatgagctctgtatatctcaaaggaactctccctgatttctcacagatgaaatctttaagagtcatcgacatgtcttggaaccacttcaccggtagcttccctctctctatcttcaatctcactgacttagagtatctcaatttcaatgagaatccagagcttgatctatggactctaccggattctgtctctaagctgacaaagctcacacacatgctcttgatgacgtgtatgctccatggtaatatcccaagatccattgggaacttgacttctcttgttgatcttgaacttagcggaaacttcctctccggtgagattccaaaagaaatagggaacctttccaacctaaggcagcttgagctttactataactatcacttaaccgggagtataccggaggaaatcggtaatctcaagaatcttacggatatcgatatctcggtaagtaggttaaccggaagcataccggattcaatctgcagtctaccaaacctccgagtgcttcagctctacaacaacagcttaacaggtgagattcctaagtcacttggcaattcaaaaaccttgaagatcttgtctctctacgacaactacttaaccggtgaactcccgccaaatctcggttcttcctcgcctatgatcgctcttgatgtctccgaaaaccgcctttctggtcctcttccggctcacgtttgcaaatccggtaagcttttgtactttcttgtactacaaaaccggttcactggttcgatccctgagacttatgggagctgcaagaccctcatacggttccgtgttgcgagcaaccgccttgttggaaccatacctcaaggagttatgtctctgcctcatgtctccatcatcgacttggcttacaactccttgtctggtccaatacctaatgcgatcggaaacgcttggaatttgtcagagctgtttatgcagagtaacagaatctccggtgttatacctcatgagctctctcactccaccaatcttgtgaagcttgacctcagcaacaatcaactgtctggtccaataccttcagaagtcggaagacttaggaaactgaacttacttgtactgcaaggcaaccacctcgattcttctatacctgattcactttctaatctcaaatctctcaacgttcttgatctgtccagtaatctcctcactggaagaatacctgaaaacctctccgagttgctcccaacctcgattaatttctccagcaaccggctctctggtcctatccccgtctcattgataagaggaggtcttgtagaaagcttttcggataaccctaatctctgtattccaccaactgctggttcatcagatttgaagtttccgatgtgtcaagagcctcacggcaagaagaagttgagctccatctgggcaatacttgtctcagttttcatcctagtcctaggggtcatcatgttttacttgagacaacggatgagtaaaaacagagcagtgatagagcaagacgagaccttagcgtcttctttcttctcctacgacgtcaagagtttccaccgcataagtttcgaccaaagggagattcttgaatctcttgtggacaagaacatcgtaggtcatggtggttcgggtactgtctatagagtagagcttaaatccggtgaagtagttgcggtgaagaaactatggagccaaagcaacaaagactcagcttctgaagacaaaatgcatttgaacaaggagttgaaaaccgaagttgagaccctcgggagcattcgccataagaacattgtgaaactcttcagctatttctcaagtttggattgtagtcttttggtatatgagtacatgcctaatggtaacttatgggacgctcttcacaaaggctttgttcatcttgagtggcgtactcgtcatcaaatcgcggttggagtagctcaaggattggcttaccttcaccatgatctctccccaccaatcattcatcgcgatatcaaatcgacaaacatcttgttggatgttaactatcagcctaaagttgcggactttggcattgcaaaggtgttacaagctagaggcaaagattcaaccacaaccgttatggctggcacctatggttacttggccccagaatatgcgtactcgtccaaagcaacgatcaaatgcgacgtgtacagtttcggggttgtgttgatggagctgatcacggggaagaaaccggtggattcgtgtttcggggagaacaaaaacatagtgaactgggtgtcaacaaagattgacacaaaagaaggattgattgagacactagacaagagattatcagaatcatcgaaagcagacatgatcaacgccttgcgtgtggctatccgctgtacaagtagaactccaacaatccgtcctaccatgaacgaagttgttcagcttctgatcgacgcaacgcctcaaggaggacccgacatgacctccaaacctacgaccaagattaaggattcaatagtgtcagatcatctcacgcaaacaagactctagtcatgctttcttggtgaagaggtgtagcaaacagttcgtataacttctaaagatatcatgtatttaaatatatatcatagaagaaactgcttatatatatagtcttttaatacttcaatgtattttaacatctatcctttaaagactttggttatttccggttttaattctcccaattcagatcatcatataaac

SEQ ID NO: 2666 - protein, 3291 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ATCTATCTGATTCTGATCGTGTACAAAAAACATGAACCCTTCTTTTGTTTTTATAAGCCTATCAACAATTTGCAGTCTTTCAACTTGTAAACTTTAGCTTCTTCTTCCTCTCTTTTTCTCCCAAACACAAAATTTCTCTCTCTTTTCTTGCAACCTAAGTTAGCTCCTCTAGGTTACTTTTGATCTTTCTCTGAAATGCGTCTCAAAAATTTCCCCTTTTTTGTTCTCTTCTTCTTCTTTTGCTTCAACAGCAATCAATCATGGGGCTTGATGAGTTCGAACCAACAACCTCAATTCTTCAAACTTATGAAGAACTCTCTCTTCGGCGACGCTTTGTCCACTTGGAATGTCTATGACGTTGGTACCAACTACTGTAACTTCACCGGCGTAAGATGTGACGGTCAAGGGCTAGTCACCGATCTTGATCTTTCCGGTTTGTCACTCTCCGGGATTTTCCCTGATGGGGTTTGCTCTTACTTCCCAAACCTCCGTGTACTTCGTCTCTCTCACAACCATCTCAACAAAAGTAGCAGCTTCCTCAACACCATCCCTAATTGTTCTCTGCTTCGAGACCTAAACATGAGCTCTGTATATCTCAAAGGAACTCTCCCTGATTTCTCACAGATGAAATCTTTAAGAGTCATCGACATGTCTTGGAACCACTTCACCGGTAGCTTCCCTCTCTCTATCTTCAATCTCACTGACTTAGAGTATCTCAATTTCAATGAGAATCCAGAGCTTGATCTATGGACTCTACCGGATTCTGTCTCTAAGCTGACAAAGCTCACACACATGCTCTTGATGACGTGTATGCTCCATGGTAATATCCCAAGATCCATTGGGAACTTGACTTCTCTTGTTGATCTTGAACTTAGCGGAAACTTCCTCTCCGGTGAGATTCCAAAAGAAATAGGGAACCTTTCCAACCTAAGGCAGCTTGAGCTTTACTATAACTATCACTTAACCGGGAGTATACCGGAGGAAATCGGTAATCTCAAGAATCTTACGGATATCGATATCTCGGTAAGTAGGTTAACCGGAAGCATACCGGATTCAATCTGCAGTCTACCAAACCTCCGAGTGCTTCAGCTCTACAACAACAGCTTAACAGGTGAGATTCCTAAGTCACTTGGCAATTCAAAAACCTTGAAGATCTTGTCTCTCTACGACAACTACTTAACCGGTGAACTCCCGCCAAATCTCGGTTCTTCCTCGCCTATGATCGCTCTTGATGTCTCCGAAAACCGCCTTTCTGGTCCTCTTCCGGCTCACGTTTGCAAATCCGGTAAGCTTTTGTACTTTCTTGTACTACAAAACCGGTTCACTGGTTCGATCCCTGAGACTTATGGGAGCTGCAAGACCCTCATACGGTTCCGTGTTGCGAGCAACCGCCTTGTTGGAACCATACCTCAAGGAGTTATGTCTCTGCCTCATGTCTCCATCATCGACTTGGCTTACAACTCCTTGTCTGGTCCAATACCTAATGCGATCGGAAACGCTTGGAATTTGTCAGAGCTGTTTATGCAGAGTAACAGAATCTCCGGTGTTATACCTCATGAGCTCTCTCACTCCACCAATCTTGTGAAGCTTGACCTCAGCAACAATCAACTGTCTGGTCCAATACCTTCAGAAGTCGGAAGACTTAGGAAACTGAACTTACTTGTACTGCAAGGCAACCACCTCGATTCTTCTATACCTGATTCACTTTCTAATCTCAAATCTCTCAACGTTCTTGATCTGTCCAGTAATCTCCTCACTGGAAGAATACCTGAAAACCTCTCCGAGTTGCTCCCAACCTCGATTAATTTCTCCAGCAACCGGCTCTCTGGTCCTATCCCCGTCTCATTGATAAGAGGAGGTCTTGTAGAAAGCTTTTCGGATAACCCTAATCTCTGTATTCCACCAACTGCTGGTTCATCAGATTTGAAGTTTCCGATGTGTCAAGAGCCTCACGGCAAGAAGAAGTTGAGCTCCATCTGGGCAATACTTGTCTCAGTTTTCATCCTAGTCCTAGGGGTCATCATGTTTTACTTGAGACAACGGATGAGTAAAAACAGAGCAGTGATAGAGCAAGACGAGACCTTAGCGTCTTCTTTCTTCTCCTACGACGTCAAGAGTTTCCACCGCATAAGTTTCGACCAAAGGGAGATTCTTGAATCTCTTGTGGACAAGAACATCGTAGGTCATGGTGGTTCGGGTACTGTCTATAGAGTAGAGCTTAAATCCGGTGAAGTAGTTGCGGTGAAGAAACTATGGAGCCAAAGCAACAAAGACTCAGCTTCTGAAGACAAAATGCATTTGAACAAGGAGTTGAAAACCGAAGTTGAGACCCTCGGGAGCATTCGCCATAAGAACATTGTGAAACTCTTCAGCTATTTCTCAAGTTTGGATTGTAGTCTTTTGGTATATGAGTACATGCCTAATGGTAACTTATGGGACGCTCTTCACAAAGGCTTTGTTCATCTTGAGTGGCGTACTCGTCATCAAATCGCGGTTGGAGTAGCTCAAGGATTGGCTTACCTTCACCATGATCTCTCCCCACCAATCATTCATCGCGATATCAAATCGACAAACATCTTGTTGGATGTTAACTATCAGCCTAAAGTTGCGGACTTTGGCATTGCAAAGGTGTTACAAGCTAGAGGCAAAGATTCAACCACAACCGTTATGGCTGGCACCTATGGTTACTTGGCCCCAGAATATGCGTACTCGTCCAAAGCAACGATCAAATGCGACGTGTACAGTTTCGGGGTTGTGTTGATGGAGCTGATCACGGGGAAGAAACCGGTGGATTCGTGTTTCGGGGAGAACAAAAACATAGTGAACTGGGTGTCAACAAAGATTGACACAAAAGAAGGATTGATTGAGACACTAGACAAGAGATTATCAGAATCATCGAAAGCAGACATGATCAACGCCTTGCGTGTGGCTATCCGCTGTACAAGTAGAACTCCAACAATCCGTCCTACCATGAACGAAGTTGTTCAGCTTCTGATCGACGCAACGCCTCAAGGAGGACCCGACATGACCTCCAAACCTACGACCAAGATTAAGGATTCAATAGTGTCAGATCATCTCACGCAAACAAGACTCTAGTCATGCTTTCTTGGTGAAGAGGTGTAGCAAACAGTTCGTATAACTTCTAAAGATATCATGTATTTAAATATATATCATAGAAGAAACTGCTTATATATATAGTCTTTTAATACTTCAATGTATTTTAACATCTATCCTTTAAAGACTTTGGTTATTTCCGGTTTTAATTCTCCCAATTCAGATCATCATATAAAC

SEQ ID NO: 2667 - DNA, 1736 bp, Arabidopsis thaliana
  misc_feature (1)..(1736): Ceres cDNA ID no. 13621063
  misc_feature (1)..(1736): Also known as  Ceres CDNA ID no. 23533084
atgtccatgctttattgaagatgtgcagagaataacaaaaatggtcgacaagagagaagaagttatgcacgtagccatgtttccatggctagctatgggtcatctccttccttttcttcgtctctccaagttactagctcaaaagggtcacaagatctctttcatatcaacaccaagaaacatcgaaagacttcctaaattacaatcaaacctcgcctcctccatcaccttcgtctctttccctctccctcccatctcaggcttgcctccttcttcagaatcatccatggacgttccttacaacaagcaacagtctcttaaagccgcttttgatcttcttcagccaccgttgaaagagtttctccgacggtcttctccggattggatcatatacgactatgcttctcactggcttccttctattgcggccgagcttggaatctctaaggctttctttagtctctttaacgcagctactctctgtttcatgggaccgtcttcgtctttgattgaagaaattagatcaacgccggaagatttcacggtggtgccaccgtgggtcccgttcaagtcaaacatcgtgtttcgttatcatgaagttactagatacgttgagaagacagaggaagatgtaaccggagtctctgactcagttcggtttggttactcgattgacgaaagcgatgcggtttttgtccgtagctgtccggagtttgaaccggaatggtttggtttactaaaagacctgtaccgtaaaccggtatttccaatcgggtttttgcctccggttattgaagacgacgatgccgttgatactacatgggttcgtataaagaagtggctcgacaagcaacggcttaattcagttgtttacgtgtcacttggcaccgaagcgagtcttcgtcatgaggaagtaactgagctagctcttgggttagagaagtcagagacaccgttcttttgggtcctaaggaacgagccaaagattccagatgggttcaaaacacgagtcaagggacgtggaatggttcatgttggttgggttccacaagtgaaaatacttagtcacgagtcagtaggagggttcttgacacattgtggttggaactcagtggtggaagggttagggtttggtaaagttccaatcttttttccggtgttgaatgagcaaggacttaatacgaggttgttgcatgggaaaggacttggtgttgaggtttcaagagatgagagagatgggtcgtttgattctgactcggtcgctgactcgattaggttggtgatgattgatgatgctggcgaggagataagggctaaggctaaagtgatgaaggatttgtttgggaacatggatgagaatattcgttatgttgacgaacttgttaggtttatgagaagtaaaggatcatcatcatcatcatgatcttgttgttgctatgattttgacttgtccattacggctgccgtgggagaactcaatctttttttcctccaagtctcgttttattaatatttcacaataccatcatagtccatagacacgcaaggcacggcaatatatccacaaaagacacgttggcttacacatacatgacgagtgttctaaaaaccagtataaacgttaggaactcagatgtgaccgtttagaccgattataattgtataaatttcatttttttgtattttccaatgtcgaacgaagttttattttcatatacatagttataaatattcgt

SEQ ID NO: 2668 - protein, 1736 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ATGTCCATGCTTTATTGAAGATGTGCAGAGAATAACAAAAATGGTCGACAAGAGAGAAGAAGTTATGCACGTAGCCATGTTTCCATGGCTAGCTATGGGTCATCTCCTTCCTTTTCTTCGTCTCTCCAAGTTACTAGCTCAAAAGGGTCACAAGATCTCTTTCATATCAACACCAAGAAACATCGAAAGACTTCCTAAATTACAATCAAACCTCGCCTCCTCCATCACCTTCGTCTCTTTCCCTCTCCCTCCCATCTCAGGCTTGCCTCCTTCTTCAGAATCATCCATGGACGTTCCTTACAACAAGCAACAGTCTCTTAAAGCCGCTTTTGATCTTCTTCAGCCACCGTTGAAAGAGTTTCTCCGACGGTCTTCTCCGGATTGGATCATATACGACTATGCTTCTCACTGGCTTCCTTCTATTGCGGCCGAGCTTGGAATCTCTAAGGCTTTCTTTAGTCTCTTTAACGCAGCTACTCTCTGTTTCATGGGACCGTCTTCGTCTTTGATTGAAGAAATTAGATCAACGCCGGAAGATTTCACGGTGGTGCCACCGTGGGTCCCGTTCAAGTCAAACATCGTGTTTCGTTATCATGAAGTTACTAGATACGTTGAGAAGACAGAGGAAGATGTAACCGGAGTCTCTGACTCAGTTCGGTTTGGTTACTCGATTGACGAAAGCGATGCGGTTTTTGTCCGTAGCTGTCCGGAGTTTGAACCGGAATGGTTTGGTTTACTAAAAGACCTGTACCGTAAACCGGTATTTCCAATCGGGTTTTTGCCTCCGGTTATTGAAGACGACGATGCCGTTGATACTACATGGGTTCGTATAAAGAAGTGGCTCGACAAGCAACGGCTTAATTCAGTTGTTTACGTGTCACTTGGCACCGAAGCGAGTCTTCGTCATGAGGAAGTAACTGAGCTAGCTCTTGGGTTAGAGAAGTCAGAGACACCGTTCTTTTGGGTCCTAAGGAACGAGCCAAAGATTCCAGATGGGTTCAAAACACGAGTCAAGGGACGTGGAATGGTTCATGTTGGTTGGGTTCCACAAGTGAAAATACTTAGTCACGAGTCAGTAGGAGGGTTCTTGACACATTGTGGTTGGAACTCAGTGGTGGAAGGGTTAGGGTTTGGTAAAGTTCCAATCTTTTTTCCGGTGTTGAATGAGCAAGGACTTAATACGAGGTTGTTGCATGGGAAAGGACTTGGTGTTGAGGTTTCAAGAGATGAGAGAGATGGGTCGTTTGATTCTGACTCGGTCGCTGACTCGATTAGGTTGGTGATGATTGATGATGCTGGCGAGGAGATAAGGGCTAAGGCTAAAGTGATGAAGGATTTGTTTGGGAACATGGATGAGAATATTCGTTATGTTGACGAACTTGTTAGGTTTATGAGAAGTAAAGGATCATCATCATCATCATGATCTTGTTGTTGCTATGATTTTGACTTGTCCATTACGGCTGCCGTGGGAGAACTCAATCTTTTTTTCCTCCAAGTCTCGTTTTATTAATATTTCACAATACCATCATAGTCCATAGACACGCAAGGCACGGCAATATATCCACAAAAGACACGTTGGCTTACACATACATGACGAGTGTTCTAAAAACCAGTATAAACGTTAGGAACTCAGATGTGACCGTTTAGACCGATTATAATTGTATAAATTTCATTTTTTTGTATTTTCCAATGTCGAACGAAGTTTTATTTTCATATACATAGTTATAAATATTCGT

SEQ ID NO: 2669 - DNA, 1309 bp, Arabidopsis thaliana
  misc_feature (1)..(1309): Ceres cDNA ID no. 13621420
  misc_feature (1)..(1309): Also known as  Ceres CDNA ID no. 23533084
aactcgtttgatttgttttcacatgtcgtgaaatttacagctttgtttcctactctcaaaaatagagcatagagctggctgatcacacttcaaattaaaaccaacaacgtatataaactataacccatgtgaacacaaaaatttagaccttttttcaaaaccattccaatttctaacaaaaacaaaattagaaatcctaaaatctgcaaggtgtatggaaggcaaaaaaggctaacaggattaaaaacagtttacattagttattctctttaaaatagaaagaagattttcgataaaaacgtcgtcgtatcttcgtcgacgtctccgtctttaatgggggagcaaagggcaagcggtgcttcctcctccaccgactcatattcaactccttcgccgtctgcgtcaccgtctccatctccggctccacgtcaacatgtcacgttactcgaaccatctcatcaacacaagaagaaaagcaaaaaagtcttccgagtttttcgttcggttttccgatctttcccgatcatcacaccggcagcttgcaaaatcccggtcctccccggcggtagcttacctgaccagcaccgaagcgggtcaagcggatcaagagttaccggaaccttattcggataccgtaaaggccgtgtaagcctctcgattcaagaaagccctagatgtttaccatctctcgtcgtcgagctcgcaatgcaaacaatggtgctacaaaaagagcttagcggagggatggttaggatcgcgttagagacagagaaacgaggtgataaagagaagatcaagatcatggacgagccattatggacaatgtttagtaacggtaagaaaacggggtacggtgtgaaacgtgacgcgacggaggaagacctcaacgttatggagctattaagaccggtttcgatgggtgccggagttttgccagggaacacggagtttgaaggaccagactcggagatggcttacatgagggcttacttcgaacgagtcgttgggtctaaagattcagagacattttatatgttgagtcccgaaggaaataatggaccagaacttagtatcttcttcgtaagagtatgatttgatgtaatatatggtcggagaaatgcgttcttgatcgatctcagtttgtggattgatatgtgattatatgatcatattgatatgtgtgtatatgcgtgggtccttttggtggtgaggtatatgaggatggatttggaggtaatattgttctttaggatgatttataaaaaaagtgtttcaggttaatacatacaaattaattcacgtttgattt

SEQ ID NO: 2670 - protein, 1309 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
AACTCGTTTGATTTGTTTTCACATGTCGTGAAATTTACAGCTTTGTTTCCTACTCTCAAAAATAGAGCATAGAGCTGGCTGATCACACTTCAAATTAAAACCAACAACGTATATAAACTATAACCCATGTGAACACAAAAATTTAGACCTTTTTTCAAAACCATTCCAATTTCTAACAAAAACAAAATTAGAAATCCTAAAATCTGCAAGGTGTATGGAAGGCAAAAAAGGCTAACAGGATTAAAAACAGTTTACATTAGTTATTCTCTTTAAAATAGAAAGAAGATTTTCGATAAAAACGTCGTCGTATCTTCGTCGACGTCTCCGTCTTTAATGGGGGAGCAAAGGGCAAGCGGTGCTTCCTCCTCCACCGACTCATATTCAACTCCTTCGCCGTCTGCGTCACCGTCTCCATCTCCGGCTCCACGTCAACATGTCACGTTACTCGAACCATCTCATCAACACAAGAAGAAAAGCAAAAAAGTCTTCCGAGTTTTTCGTTCGGTTTTCCGATCTTTCCCGATCATCACACCGGCAGCTTGCAAAATCCCGGTCCTCCCCGGCGGTAGCTTACCTGACCAGCACCGAAGCGGGTCAAGCGGATCAAGAGTTACCGGAACCTTATTCGGATACCGTAAAGGCCGTGTAAGCCTCTCGATTCAAGAAAGCCCTAGATGTTTACCATCTCTCGTCGTCGAGCTCGCAATGCAAACAATGGTGCTACAAAAAGAGCTTAGCGGAGGGATGGTTAGGATCGCGTTAGAGACAGAGAAACGAGGTGATAAAGAGAAGATCAAGATCATGGACGAGCCATTATGGACAATGTTTAGTAACGGTAAGAAAACGGGGTACGGTGTGAAACGTGACGCGACGGAGGAAGACCTCAACGTTATGGAGCTATTAAGACCGGTTTCGATGGGTGCCGGAGTTTTGCCAGGGAACACGGAGTTTGAAGGACCAGACTCGGAGATGGCTTACATGAGGGCTTACTTCGAACGAGTCGTTGGGTCTAAAGATTCAGAGACATTTTATATGTTGAGTCCCGAAGGAAATAATGGACCAGAACTTAGTATCTTCTTCGTAAGAGTATGATTTGATGTAATATATGGTCGGAGAAATGCGTTCTTGATCGATCTCAGTTTGTGGATTGATATGTGATTATATGATCATATTGATATGTGTGTATATGCGTGGGTCCTTTTGGTGGTGAGGTATATGAGGATGGATTTGGAGGTAATATTGTTCTTTAGGATGATTTATAAAAAAAGTGTTTCAGGTTAATACATACAAATTAATTCACGTTTGATTT

SEQ ID NO: 2671 - DNA, 2762 bp, Arabidopsis thaliana
  misc_feature (1)..(2762): Ceres cDNA ID no. 13621442
  misc_feature (1)..(2762): Also known as  Ceres CDNA ID no. 23533084
gaactatatcacatgttccaaatatagacgagaacaaaacaaaaaaaaaaaagtcgtcgataagagagtcctttgaaatccccaaaatgcccttcaacataacctccgtgaaaacctcatctaacggagtatggcaaggcgacaatcctttaaacttcgcttttccgttactcatcgtccaaacggcgttaatcatcgccgtcagtcgcttcctcgccgtcttattcaaacctctccgtcaacccaaagtcatcgccgagattgtcggagggattttgttaggaccatcggctttaggtagaaacatggcgtacatggaccgtatatttccgaaatggagtatgccgatactcgaatccgtcgcgagcataggacttctcttcttcctcttcctcgtcggtctagaactcgatttatcatcgatccgacgaagcggcaaacgcgctttcggaatcgcagtcgctggaattacactaccgtttatcgccggcgtcggagtcgcgtttgtgatccgtaacactctctacaccgccgcggataaaccaggttacgccgagtttctcgttttcatgggagtcgcactctcgatcacagcttttccggtacttgcgcgtattttagcagagctcaagcttttaacgactcagataggagaaaccgcgatggctgcagccgcttttaacgatgtagccgcgtggattttactcgctttagcggttgcgttagcgggtaatggcggtgagggaggtggagagaaaaagagtccgttagtgtcgttgtgggttttgttatcgggcgctgggtttgtggtttttatgttggttgtgatccgacccggaatgaaatgggtcgcgaaacgtggatctcctgaaaacgacgtcgtacgcgagtcttacgtgtgtttgacgttagccggtgttatggtttccggtttcgcgacggatttaattgggattcattcgatttttggagcgtttgttttcggtttgactataccgaaagatggagagtttggtcagcgattgattgaacgaattgaggattttgtttccggtttactcttaccgctttatttcgctacgagtggtttgaagactgacgtggctaagattagaggagctgagtcgtgggggatgttgggtcttgttgttgttacggcttgtgccgggaagatagtcggaacttttgttgtggcggtgatggttaaagttccggcgagagaggcgttgacacttggtttcttgatgaatactaaaggtttagtggagctcattgtactcaacataggcaaggagaaaaaggtactaaacgacgagacgtttgcaatactagtgctaatggcactcttcacaacgttcataacgacgcctactgtaatggccatttacaagccggcacgtggcacccaccgcaaactaaaagacttgtcggcgagccaagactccaccaaggaagagcttcgcatcctagcctgcctccacggcccagccaatgtctcctccctcatctctctcgtcgagtccatccgaaccaccaagatactacggctaaagctgtttgtgatgcatctgatggaactaacggaacggtcttcgtcaatcataatggtgcaaagagcccgtaaaaacggacttcctttcgttcaccgttaccgtcatggtgagcgtcacagcaacgtcataggaggcttcgaagcctatcgtcaactaggccgggtcgcagtccggcccatcaccgcagtctctccattacccacaatgcacgaagacatttgccacatggcagataccaagagggtcacaatgatcattttacctttccacaaacgatggaacgctgatcatggtcatagccaccaccaccaagacggaggaggagatggaaacgtaccggaaaacgttggtcatggttggcgattggttaaccaaagggttttgaagaatgcgccgtgttcggtggcggttcttgtagaccgtggacttgggtccattgaggcccaaactttgagcttagatgggtcgaatgtggttgaaagggtttgtgtgattttctttggtgggcctgatgaccgtgagtctatagagctcggcgggagaatggctgagcatccggccgttaaagttaccgttattaggtttttggtaagagaaacgttgaggagtaccgccgtcactttacgaccggcaccgtctaaaggcaaggagaagaactatgcctttttaacaaccaacgtggatccagaaaaagaaaaggaattagacgaaggggcattggaagacttcaagagcaaatggaaagaaatggtggagtacaaagaaaaggaaccaaacaacatcattgaagaaatactgtcaataggacagagtaaagactttgatctaatagtggttggaagagggaggataccgtcggccgaggtggcggcattagctgagcgtcaagctgaacatcctgagttaggtcctatcggagacgtgctcgcctcttcgatcaaccacatcattccatcaatccttgtggttcaacaacacaacaaagctcatgtagaggatattacggtttccaaaattgttagtgagtcttctctaagtattaacggagacacaaatgtatgataacaataaataaattgatctagtacttaaacctcggcttaatgcatggttaaagtggttagttgaagatgtagtttatctacaatatatagatagctcttgagtaagaattgtaagatcgtctacatataaataaccatgattggc

SEQ ID NO: 2672 - protein, 2762 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
GAACTATATCACATGTTCCAAATATAGACGAGAACAAAACAAAAAAAAAAAAGTCGTCGATAAGAGAGTCCTTTGAAATCCCCAAAATGCCCTTCAACATAACCTCCGTGAAAACCTCATCTAACGGAGTATGGCAAGGCGACAATCCTTTAAACTTCGCTTTTCCGTTACTCATCGTCCAAACGGCGTTAATCATCGCCGTCAGTCGCTTCCTCGCCGTCTTATTCAAACCTCTCCGTCAACCCAAAGTCATCGCCGAGATTGTCGGAGGGATTTTGTTAGGACCATCGGCTTTAGGTAGAAACATGGCGTACATGGACCGTATATTTCCGAAATGGAGTATGCCGATACTCGAATCCGTCGCGAGCATAGGACTTCTCTTCTTCCTCTTCCTCGTCGGTCTAGAACTCGATTTATCATCGATCCGACGAAGCGGCAAACGCGCTTTCGGAATCGCAGTCGCTGGAATTACACTACCGTTTATCGCCGGCGTCGGAGTCGCGTTTGTGATCCGTAACACTCTCTACACCGCCGCGGATAAACCAGGTTACGCCGAGTTTCTCGTTTTCATGGGAGTCGCACTCTCGATCACAGCTTTTCCGGTACTTGCGCGTATTTTAGCAGAGCTCAAGCTTTTAACGACTCAGATAGGAGAAACCGCGATGGCTGCAGCCGCTTTTAACGATGTAGCCGCGTGGATTTTACTCGCTTTAGCGGTTGCGTTAGCGGGTAATGGCGGTGAGGGAGGTGGAGAGAAAAAGAGTCCGTTAGTGTCGTTGTGGGTTTTGTTATCGGGCGCTGGGTTTGTGGTTTTTATGTTGGTTGTGATCCGACCCGGAATGAAATGGGTCGCGAAACGTGGATCTCCTGAAAACGACGTCGTACGCGAGTCTTACGTGTGTTTGACGTTAGCCGGTGTTATGGTTTCCGGTTTCGCGACGGATTTAATTGGGATTCATTCGATTTTTGGAGCGTTTGTTTTCGGTTTGACTATACCGAAAGATGGAGAGTTTGGTCAGCGATTGATTGAACGAATTGAGGATTTTGTTTCCGGTTTACTCTTACCGCTTTATTTCGCTACGAGTGGTTTGAAGACTGACGTGGCTAAGATTAGAGGAGCTGAGTCGTGGGGGATGTTGGGTCTTGTTGTTGTTACGGCTTGTGCCGGGAAGATAGTCGGAACTTTTGTTGTGGCGGTGATGGTTAAAGTTCCGGCGAGAGAGGCGTTGACACTTGGTTTCTTGATGAATACTAAAGGTTTAGTGGAGCTCATTGTACTCAACATAGGCAAGGAGAAAAAGGTACTAAACGACGAGACGTTTGCAATACTAGTGCTAATGGCACTCTTCACAACGTTCATAACGACGCCTACTGTAATGGCCATTTACAAGCCGGCACGTGGCACCCACCGCAAACTAAAAGACTTGTCGGCGAGCCAAGACTCCACCAAGGAAGAGCTTCGCATCCTAGCCTGCCTCCACGGCCCAGCCAATGTCTCCTCCCTCATCTCTCTCGTCGAGTCCATCCGAACCACCAAGATACTACGGCTAAAGCTGTTTGTGATGCATCTGATGGAACTAACGGAACGGTCTTCGTCAATCATAATGGTGCAAAGAGCCCGTAAAAACGGACTTCCTTTCGTTCACCGTTACCGTCATGGTGAGCGTCACAGCAACGTCATAGGAGGCTTCGAAGCCTATCGTCAACTAGGCCGGGTCGCAGTCCGGCCCATCACCGCAGTCTCTCCATTACCCACAATGCACGAAGACATTTGCCACATGGCAGATACCAAGAGGGTCACAATGATCATTTTACCTTTCCACAAACGATGGAACGCTGATCATGGTCATAGCCACCACCACCAAGACGGAGGAGGAGATGGAAACGTACCGGAAAACGTTGGTCATGGTTGGCGATTGGTTAACCAAAGGGTTTTGAAGAATGCGCCGTGTTCGGTGGCGGTTCTTGTAGACCGTGGACTTGGGTCCATTGAGGCCCAAACTTTGAGCTTAGATGGGTCGAATGTGGTTGAAAGGGTTTGTGTGATTTTCTTTGGTGGGCCTGATGACCGTGAGTCTATAGAGCTCGGCGGGAGAATGGCTGAGCATCCGGCCGTTAAAGTTACCGTTATTAGGTTTTTGGTAAGAGAAACGTTGAGGAGTACCGCCGTCACTTTACGACCGGCACCGTCTAAAGGCAAGGAGAAGAACTATGCCTTTTTAACAACCAACGTGGATCCAGAAAAAGAAAAGGAATTAGACGAAGGGGCATTGGAAGACTTCAAGAGCAAATGGAAAGAAATGGTGGAGTACAAAGAAAAGGAACCAAACAACATCATTGAAGAAATACTGTCAATAGGACAGAGTAAAGACTTTGATCTAATAGTGGTTGGAAGAGGGAGGATACCGTCGGCCGAGGTGGCGGCATTAGCTGAGCGTCAAGCTGAACATCCTGAGTTAGGTCCTATCGGAGACGTGCTCGCCTCTTCGATCAACCACATCATTCCATCAATCCTTGTGGTTCAACAACACAACAAAGCTCATGTAGAGGATATTACGGTTTCCAAAATTGTTAGTGAGTCTTCTCTAAGTATTAACGGAGACACAAATGTATGATAACAATAAATAAATTGATCTAGTACTTAAACCTCGGCTTAATGCATGGTTAAAGTGGTTAGTTGAAGATGTAGTTTATCTACAATATATAGATAGCTCTTGAGTAAGAATTGTAAGATCGTCTACATATAAATAACCATGATTGGC

SEQ ID NO: 2673 - DNA, 1762 bp, Arabidopsis thaliana
  misc_feature (1)..(1762): Ceres cDNA ID no. 13621498
  misc_feature (1)..(1762): Also known as  Ceres CDNA ID no. 23533084
aaatttaaatcttcattgaatgctttttctgaagctttatctaataaatctcttcgttgatccttcctttccattaacgaggtagaaattccaaaacgcgtaataatcttgtcgtcattacaaattacaataaaaagaagacatttttatttagatttccctctgatcctctcttttagatttcgaatcgagaccagatctgcgtgaagatgatagagaagtgtataggagcgcatcggtttcggagattacagagattcatgcgtcaagggaaagtgacgattctttgtctcgttctcaccgtcatcgtcttacgtggcacaatcggagccggtaagtttggtacgccggagaaagatatcgaggagatccgtgagcatttcttctacacgcgtaaacgcggcgagcctcaccgtgtcctcgtcgaggtctcttccaaaacgacgtcgtccgaagacggaggaaatggtggtaacagctacgagaccttcgatatcaacaagctattcgttgatgaaggagacgaagagaaatctcgagaccggactaataaaccttattctcttggtcccaagatctctgattgggatgagcagagacgtgattggctcaaacaaaaccctagcttccctaatttcgtggcgccaaacaagcctagggttcttcttgtcacaggttcagctcctaaaccgtgtgagaatcctgtaggagaccattacctcttgaaatcgattaagaacaaaatcgattactgtagaatacacggaatcgagatcttctacaacatggcgttgctcgatgctgagatggctggattctgggctaagcttccgttgattaggaagttactcttgtcacatcctgagattgagtttctatggtggatggatagtgatgccatgttcacggacatggtgttcgagcttccatgggagaggtacaaagattacaacttggtgatgcatggttggaacgagatggtttatgaccagaagaattggattggtctcaacacgggaagtttcttgctcaggaactcacagtggtcgcttgatcttcttgacgcttgggctcctatgggcccaaaagggaagatccgagaagaagcgggtaaagtcttgacccgggaacttaaagaccgacccgctttcgaagctgacgatcaatcggcgatggtttatctgctggcgacggagagagagaaatggggaggcaaagtttatctagagagtggttattacttgcacggttattgggggattttggtagaccggtacgaggagatgattgagaatcataaaccgggttttggagaccatcggtggccattggttacgcatttcgtcgggtgtaaaccgtgcgggaaatttggagattatccggtggaacggtgtctacggcagatggatagagcgtttaatttcggagacaatcagatccttcaaatgtatggtttcacgcataaatcgcttgggagccggcgcgtgaaacccacgcgcaatcagacggataggccgctcgatgccaaggacgagtttgggctgcttcatccgccgttcaaagcggccaagcttagtacgacgacgacgtgagtgagtgagaggatatattgttttgtatcttttaattttgcgtttaggggacacacgtttatttgttttattcaattttatttgtttgtagtttacttaattgttttgatctcccattcatggtggagtcgtgtatggagtatttaatgatttattgtagacgttatttc

SEQ ID NO: 2674 - protein, 1762 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
AAATTTAAATCTTCATTGAATGCTTTTTCTGAAGCTTTATCTAATAAATCTCTTCGTTGATCCTTCCTTTCCATTAACGAGGTAGAAATTCCAAAACGCGTAATAATCTTGTCGTCATTACAAATTACAATAAAAAGAAGACATTTTTATTTAGATTTCCCTCTGATCCTCTCTTTTAGATTTCGAATCGAGACCAGATCTGCGTGAAGATGATAGAGAAGTGTATAGGAGCGCATCGGTTTCGGAGATTACAGAGATTCATGCGTCAAGGGAAAGTGACGATTCTTTGTCTCGTTCTCACCGTCATCGTCTTACGTGGCACAATCGGAGCCGGTAAGTTTGGTACGCCGGAGAAAGATATCGAGGAGATCCGTGAGCATTTCTTCTACACGCGTAAACGCGGCGAGCCTCACCGTGTCCTCGTCGAGGTCTCTTCCAAAACGACGTCGTCCGAAGACGGAGGAAATGGTGGTAACAGCTACGAGACCTTCGATATCAACAAGCTATTCGTTGATGAAGGAGACGAAGAGAAATCTCGAGACCGGACTAATAAACCTTATTCTCTTGGTCCCAAGATCTCTGATTGGGATGAGCAGAGACGTGATTGGCTCAAACAAAACCCTAGCTTCCCTAATTTCGTGGCGCCAAACAAGCCTAGGGTTCTTCTTGTCACAGGTTCAGCTCCTAAACCGTGTGAGAATCCTGTAGGAGACCATTACCTCTTGAAATCGATTAAGAACAAAATCGATTACTGTAGAATACACGGAATCGAGATCTTCTACAACATGGCGTTGCTCGATGCTGAGATGGCTGGATTCTGGGCTAAGCTTCCGTTGATTAGGAAGTTACTCTTGTCACATCCTGAGATTGAGTTTCTATGGTGGATGGATAGTGATGCCATGTTCACGGACATGGTGTTCGAGCTTCCATGGGAGAGGTACAAAGATTACAACTTGGTGATGCATGGTTGGAACGAGATGGTTTATGACCAGAAGAATTGGATTGGTCTCAACACGGGAAGTTTCTTGCTCAGGAACTCACAGTGGTCGCTTGATCTTCTTGACGCTTGGGCTCCTATGGGCCCAAAAGGGAAGATCCGAGAAGAAGCGGGTAAAGTCTTGACCCGGGAACTTAAAGACCGACCCGCTTTCGAAGCTGACGATCAATCGGCGATGGTTTATCTGCTGGCGACGGAGAGAGAGAAATGGGGAGGCAAAGTTTATCTAGAGAGTGGTTATTACTTGCACGGTTATTGGGGGATTTTGGTAGACCGGTACGAGGAGATGATTGAGAATCATAAACCGGGTTTTGGAGACCATCGGTGGCCATTGGTTACGCATTTCGTCGGGTGTAAACCGTGCGGGAAATTTGGAGATTATCCGGTGGAACGGTGTCTACGGCAGATGGATAGAGCGTTTAATTTCGGAGACAATCAGATCCTTCAAATGTATGGTTTCACGCATAAATCGCTTGGGAGCCGGCGCGTGAAACCCACGCGCAATCAGACGGATAGGCCGCTCGATGCCAAGGACGAGTTTGGGCTGCTTCATCCGCCGTTCAAAGCGGCCAAGCTTAGTACGACGACGACGTGAGTGAGTGAGAGGATATATTGTTTTGTATCTTTTAATTTTGCGTTTAGGGGACACACGTTTATTTGTTTTATTCAATTTTATTTGTTTGTAGTTTACTTAATTGTTTTGATCTCCCATTCATGGTGGAGTCGTGTATGGAGTATTTAATGATTTATTGTAGACGTTATTTC

SEQ ID NO: 2675 - DNA, 2762 bp, Arabidopsis thaliana
  misc_feature (1)..(2762): Ceres cDNA ID no. 13621646
  misc_feature (1)..(2762): Also known as  Ceres CDNA ID no. 23533084
atttctctgtgtactggcgcgtgagatagaacagaaaataaagacatcaaatctttgctacatgtctttggtcgtatccgtatatatgttcttcttctaattattttagcagaaagaaaaaaaactaatcgctttcataaactcagatttgtttttttttttcaatggtagaagaagacaagtgttcttggagtttagtttcttcttatgattcattcataaatccgaggaaatatatcaaatctgtttctttctttctctaagtcaaaacccaactaagagattcttcttcttctttctttgagatcagttacaaagtgagctttgtttttaagttctaattgctaatttgctacacataagttctgtttagcttcttagagatgggatttgaagacaagaaaatgctgagacagagacataagcgttctaagagctgtactgttcctgagaagaaaaagcttgaagatgagaatagcattgattcttctctggatgcttctcaacgcctcaagctcgacttacctcgttgcggcgataaatcttttgaaatgaagaaggatctatcccctgatgtaaaattcaagagctctctgaagcaagagattcaagagcttgagaaaagattacagaaccagtttgatgtccgtggtgcgttagagaaggcattaggctataaaacaccatctcgagacatcaaaggcgactctactccaaagcctccaacagaattgatcaaggaaatcgcggtgttggagttagaagtttctcatttggaacagtaccttctatctttgtatcgtaaagcgtttgatcaacaaacatcttctgtatcgccaccaacatcgaaacaacaaagctcgtgttcacctaaatctactcttagaggaaaacgtctagacttctcaagaacacctgaatctcggtgtttctcctttgacaacagactgaagagtccacgtttggtagagaaggagctagagtctcctaaccttagatgtagacaagaaagcttagccacgcaacctcgatgtttctcatttgacaatagactgaaggaacctagttctgctggtcgacaatgtaatcaagaagtctcaagaatcgattctcggagtttctcctttgacaatagagtgaaggaacccggttctgctgctcggcatttcaatcaagaagactcaagaatcgattctcagtgtgtctcctttgacaatagagtgaaggaacccgtttctggtgttcgacaattcgatcaagaaagctcaagaatcgattctcggtgtttctctttcgacaatagactgaaagatcaatgttttatcgagaaggaggacatcgattcatgtgttcgtcgttgccagtcctctcttaatcaacgttccaccttcaataaccgaatatctccaccagaagactcggtattcgcgtgccactcccaaccattgtccatacatgaatacatacaaaatggatcaaatgatgcaagccttgcagaacacatgggaactcggatatctgatcacatattcatgactccaaacaagttatcagaggaaatgatcaagtgtgcatcagctatatattccaagctcgctgatccaccatcgataaaccacggtttctcatccccgagttcgtctccatcatcaacaagcgagttttcaccacaagaccagtatgatatgtggagtccaagcttcagaaaaaactcgtctttcgatgaccagtttgaattcagcggaccttatagctcaatgatcgaagtgtcacacattcatcgaaaccgtaaaagacgcgaccttgacctgatgaatcgaaacttcagcttacttcttaagcaactggaaagtgttgatccgagaaaactgactcatcaagagaaactggcgttctggattaacgtacataacgctcttgtgatgcatacatttctggcaaatgggattccacagaacaatgggaagcgatttttactactctccaagccagcttacaagataggaggtcgcatggtaagcttagaagcaatacaaagttatattcttcgtatcaagatgcctcgtcctggccagtggctgaagttattactcatacctaaaaaattcagaaccggagatgaacatcaagaatattccctcgagcattccgagcctctcttatactttgcactttgttcaggcaaccattctgaccctgcgattcgtgtttttacgcccaagggaatataccaagagctagaaaccgcaaaggaagagtacatccgcgcaacgtttggagtaaagaaagaccagaaactagtcttaccaaagatcattgagtcttttagcaaagactcaggtttaggtcaagcagcattgatggagatgattcaagaatgtctcccggaaacaatgaaaaaaaccataaagaaacttaactcagggagatcccgaaagagcattgtcgaatggacgcctcataatttcgtgtttcggtatttgatagccagagaacttgttagatgaaattttcttatgtgattgtcttgggaagggtttttatttgcaaggactctgtttctttgtaatgtattattggtttagtgtataggtggatgtcttgtgtggtgagtgtagagtagaaatagaaatagaggaaaaattgcatgccgttttttggttaccaatccgcgatgatgtttgtacatacaaaatcgattctcttattttttaaaatttatttgttatagtaacgatatatattactaagcaaaatttcct

SEQ ID NO: 2676 - protein, 2762 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
ATTTCTCTGTGTACTGGCGCGTGAGATAGAACAGAAAATAAAGACATCAAATCTTTGCTACATGTCTTTGGTCGTATCCGTATATATGTTCTTCTTCTAATTATTTTAGCAGAAAGAAAAAAAACTAATCGCTTTCATAAACTCAGATTTGTTTTTTTTTTTCAATGGTAGAAGAAGACAAGTGTTCTTGGAGTTTAGTTTCTTCTTATGATTCATTCATAAATCCGAGGAAATATATCAAATCTGTTTCTTTCTTTCTCTAAGTCAAAACCCAACTAAGAGATTCTTCTTCTTCTTTCTTTGAGATCAGTTACAAAGTGAGCTTTGTTTTTAAGTTCTAATTGCTAATTTGCTACACATAAGTTCTGTTTAGCTTCTTAGAGATGGGATTTGAAGACAAGAAAATGCTGAGACAGAGACATAAGCGTTCTAAGAGCTGTACTGTTCCTGAGAAGAAAAAGCTTGAAGATGAGAATAGCATTGATTCTTCTCTGGATGCTTCTCAACGCCTCAAGCTCGACTTACCTCGTTGCGGCGATAAATCTTTTGAAATGAAGAAGGATCTATCCCCTGATGTAAAATTCAAGAGCTCTCTGAAGCAAGAGATTCAAGAGCTTGAGAAAAGATTACAGAACCAGTTTGATGTCCGTGGTGCGTTAGAGAAGGCATTAGGCTATAAAACACCATCTCGAGACATCAAAGGCGACTCTACTCCAAAGCCTCCAACAGAATTGATCAAGGAAATCGCGGTGTTGGAGTTAGAAGTTTCTCATTTGGAACAGTACCTTCTATCTTTGTATCGTAAAGCGTTTGATCAACAAACATCTTCTGTATCGCCACCAACATCGAAACAACAAAGCTCGTGTTCACCTAAATCTACTCTTAGAGGAAAACGTCTAGACTTCTCAAGAACACCTGAATCTCGGTGTTTCTCCTTTGACAACAGACTGAAGAGTCCACGTTTGGTAGAGAAGGAGCTAGAGTCTCCTAACCTTAGATGTAGACAAGAAAGCTTAGCCACGCAACCTCGATGTTTCTCATTTGACAATAGACTGAAGGAACCTAGTTCTGCTGGTCGACAATGTAATCAAGAAGTCTCAAGAATCGATTCTCGGAGTTTCTCCTTTGACAATAGAGTGAAGGAACCCGGTTCTGCTGCTCGGCATTTCAATCAAGAAGACTCAAGAATCGATTCTCAGTGTGTCTCCTTTGACAATAGAGTGAAGGAACCCGTTTCTGGTGTTCGACAATTCGATCAAGAAAGCTCAAGAATCGATTCTCGGTGTTTCTCTTTCGACAATAGACTGAAAGATCAATGTTTTATCGAGAAGGAGGACATCGATTCATGTGTTCGTCGTTGCCAGTCCTCTCTTAATCAACGTTCCACCTTCAATAACCGAATATCTCCACCAGAAGACTCGGTATTCGCGTGCCACTCCCAACCATTGTCCATACATGAATACATACAAAATGGATCAAATGATGCAAGCCTTGCAGAACACATGGGAACTCGGATATCTGATCACATATTCATGACTCCAAACAAGTTATCAGAGGAAATGATCAAGTGTGCATCAGCTATATATTCCAAGCTCGCTGATCCACCATCGATAAACCACGGTTTCTCATCCCCGAGTTCGTCTCCATCATCAACAAGCGAGTTTTCACCACAAGACCAGTATGATATGTGGAGTCCAAGCTTCAGAAAAAACTCGTCTTTCGATGACCAGTTTGAATTCAGCGGACCTTATAGCTCAATGATCGAAGTGTCACACATTCATCGAAACCGTAAAAGACGCGACCTTGACCTGATGAATCGAAACTTCAGCTTACTTCTTAAGCAACTGGAAAGTGTTGATCCGAGAAAACTGACTCATCAAGAGAAACTGGCGTTCTGGATTAACGTACATAACGCTCTTGTGATGCATACATTTCTGGCAAATGGGATTCCACAGAACAATGGGAAGCGATTTTTACTACTCTCCAAGCCAGCTTACAAGATAGGAGGTCGCATGGTAAGCTTAGAAGCAATACAAAGTTATATTCTTCGTATCAAGATGCCTCGTCCTGGCCAGTGGCTGAAGTTATTACTCATACCTAAAAAATTCAGAACCGGAGATGAACATCAAGAATATTCCCTCGAGCATTCCGAGCCTCTCTTATACTTTGCACTTTGTTCAGGCAACCATTCTGACCCTGCGATTCGTGTTTTTACGCCCAAGGGAATATACCAAGAGCTAGAAACCGCAAAGGAAGAGTACATCCGCGCAACGTTTGGAGTAAAGAAAGACCAGAAACTAGTCTTACCAAAGATCATTGAGTCTTTTAGCAAAGACTCAGGTTTAGGTCAAGCAGCATTGATGGAGATGATTCAAGAATGTCTCCCGGAAACAATGAAAAAAACCATAAAGAAACTTAACTCAGGGAGATCCCGAAAGAGCATTGTCGAATGGACGCCTCATAATTTCGTGTTTCGGTATTTGATAGCCAGAGAACTTGTTAGATGAAATTTTCTTATGTGATTGTCTTGGGAAGGGTTTTTATTTGCAAGGACTCTGTTTCTTTGTAATGTATTATTGGTTTAGTGTATAGGTGGATGTCTTGTGTGGTGAGTGTAGAGTAGAAATAGAAATAGAGGAAAAATTGCATGCCGTTTTTTGGTTACCAATCCGCGATGATGTTTGTACATACAAAATCGATTCTCTTATTTTTTAAAATTTATTTGTTATAGTAACGATATATATTACTAAGCAAAATTTCCT

SEQ ID NO: 2677 - DNA, 2073 bp, Arabidopsis thaliana
  misc_feature (1)..(2073): Ceres cDNA ID no. 13621684
  misc_feature (1)..(2073): Also known as  Ceres CDNA ID no. 23533084
aattttgcaaaacagcgaaaatagttctttgtgattttcgagtgagagagacgacagcttccattatcccctgtctctctccctctcgaactacaaatcaaattcgagtgttttcatattgttaatctttttcttcaaggaaagaagagattttgttttccgtttctgggggtttttcttgattctgatctctgatctgatctcatcatcattgtccgtggattctccgatgggtttctgattgtgggttctttcaaatttcttcacttttggagcttttcttctctctgtcttttgttttccctcagctatggcttggaatgagaccaaactcaagaggctctatcaagtttggagaggaagcaataaatttctatgtggcgggaggctaatatttggtcctgatgcatcatctctatatctatcaaccatcttgatccttggtcctgctgtaatgttctttgtcaaaatgtacactaaaatggctgatcctcgtaccaagaatccaaatctatgtattccaattctctgtgtgtcttggatactcacaattttggatatatttttcctcttaatgacatctagtagagatcccgggattgtgccaagaagttttaggcctccggaaaccgatgatgcaccggattcaactactccatcgatggaatgggttagcggtagaacccctaatataagaataccacgggtcaaagatgtaactgttaatggacataccgtaaaagtgaaattctgtgacacttgtttgctttaccgtccacctagagcttctcattgttccatatgcaacaactgtgtccagagatttgatcatcactgcccttgggttggccagtgcattggagtgcgaaattaccggttcttcttcatgttcatatcaacatcaaccactctgtgcatatatgtgtttgccttttcttggttgaacatatttcaaagacatatggatgaaaagattagcatctggaaagctatatccaaagatgttctatcggatattctcatagtttactgcttcattactgtttggtttgttggaggactcacaatatttcattcctatctcatctgtactaaccagacgacttatgagaatttccgataccgttatgataagaaggagaatccatacaacaaaggaattttggggaacatatgggaaatatttctgtctaagattcctccatcaatgaacaagtttagatcatttgtcaaggaagaagattatatgatgatgatggttgaaactcctacttcaaatctaggtgaaagtctagttagctcgaaagagaagattgatatcgaaatgggaggaggaaggattgttgatgagagtggaaagagctactctctacctgagattctccggaatctaaactatgaagatcttgaggatgattgtgaggaagatgacttgaaggctaaggatcatcaccaccaccatcaccatcaacatcaacataatgagggaatcatccctccttttgaccctttttttaccaatgagattggtagtaacaaagatgagagaaatggagaagaatcaggaggatcttcaagtgatggtgaaaatacagggaaacgcgttcgggtctcagatgaagatgaagagaaagttgaagggtatgaacgaaattggagtacagataaaggtatgaatataaacgcaggatctgaagatggagcaagctctcctgtatccacttcaccaatgcttcgtaaatagagagaaggaaggacttgaagctggagaaatggagtttgtgctttatcattcttttaattctgtttcatataattgtgggaaaaaaaatccgaaaaataacaatcatcttagaaaattgtgagtttgagcactagatttttttatttttaaaattctcctttttagttgtatttatatataccagaatggtctggatatcaccagcatcacatattttctctcttttttatttttccttttttgttataaaaaaagatttggaccacgaatttgtaacgtatatactgttgtcggaattatttttccttattttattggttgattttcat

SEQ ID NO: 2678 - protein, 2073 aa, Arabidopsis thaliana
  misc_feature: PFam Name: Chal_sti_synt_C; PFam Description: Chalcone and
  misc_feature: PFam Name: Chal_sti_synt_N; PFam Description: Chalcone and
  misc_feature: PFam Name: MMTV_SAg; PFam Description: Mouse mammary tumour
  misc_feature: GI Number: 50920373; NR Description: Putative fiddlehead-like protein [Oryza sativa (japonica cultivar-group)] >gi|24960748|gb|AAN65442.1| Putative fiddlehead-like protein [Oryza
  misc_feature: GI Number: 3142289; NR Description: Strong similarity to beta-keto-Coa synthase gbU37088 from Simmondsia chinensis. [Arabidopsis thaliana] gi|7488037|pir||T00951 probable
  misc_feature: GI Number: 1045614; NR Description: beta-ketoacyl-CoA synthase
  misc_feature: GI Number: 23297625; NR Description: beta-ketoacyl-CoA synthase [Arabidopsis thaliana] >gi|10177945|dbj|BAB11304.1| beta-ketoacyl-CoA synthase [Arabidopsis thaliana] >gi|15983491|gb|AAL11613.1| AT5g43760/MQD19_11 [Arabidopsis
  misc_feature: GI Number: 50932775; NR Description: putative beta-ketoacyl synthase [Oryza sativa (japonica cultivar-group)] >gi|50080251|gb|AAT69586.1| putative beta-ketoacyl synthase [Oryza
AATTTTGCAAAACAGCGAAAATAGTTCTTTGTGATTTTCGAGTGAGAGAGACGACAGCTTCCATTATCCCCTGTCTCTCTCCCTCTCGAACTACAAATCAAATTCGAGTGTTTTCATATTGTTAATCTTTTTCTTCAAGGAAAGAAGAGATTTTGTTTTCCGTTTCTGGGGGTTTTTCTTGATTCTGATCTCTGATCTGATCTCATCATCATTGTCCGTGGATTCTCCGATGGGTTTCTGATTGTGGGTTCTTTCAAATTTCTTCACTTTTGGAGCTTTTCTTCTCTCTGTCTTTTGTTTTCCCTCAGCTATGGCTTGGAATGAGACCAAACTCAAGAGGCTCTATCAAGTTTGGAGAGGAAGCAATAAATTTCTATGTGGCGGGAGGCTAATATTTGGTCCTGATGCATCATCTCTATATCTATCAACCATCTTGATCCTTGGTCCTGCTGTAATGTTCTTTGTCAAAATGTACACTAAAATGGCTGATCCTCGTACCAAGAATCCAAATCTATGTATTCCAATTCTCTGTGTGTCTTGGATACTCACAATTTTGGATATATTTTTCCTCTTAATGACATCTAGTAGAGATCCCGGGATTGTGCCAAGAAGTTTTAGGCCTCCGGAAACCGATGATGCACCGGATTCAACTACTCCATCGATGGAATGGGTTAGCGGTAGAACCCCTAATATAAGAATACCACGGGTCAAAGATGTAACTGTTAATGGACATACCGTAAAAGTGAAATTCTGTGACACTTGTTTGCTTTACCGTCCACCTAGAGCTTCTCATTGTTCCATATGCAACAACTGTGTCCAGAGATTTGATCATCACTGCCCTTGGGTTGGCCAGTGCATTGGAGTGCGAAATTACCGGTTCTTCTTCATGTTCATATCAACATCAACCACTCTGTGCATATATGTGTTTGCCTTTTCTTGGTTGAACATATTTCAAAGACATATGGATGAAAAGATTAGCATCTGGAAAGCTATATCCAAAGATGTTCTATCGGATATTCTCATAGTTTACTGCTTCATTACTGTTTGGTTTGTTGGAGGACTCACAATATTTCATTCCTATCTCATCTGTACTAACCAGACGACTTATGAGAATTTCCGATACCGTTATGATAAGAAGGAGAATCCATACAACAAAGGAATTTTGGGGAACATATGGGAAATATTTCTGTCTAAGATTCCTCCATCAATGAACAAGTTTAGATCATTTGTCAAGGAAGAAGATTATATGATGATGATGGTTGAAACTCCTACTTCAAATCTAGGTGAAAGTCTAGTTAGCTCGAAAGAGAAGATTGATATCGAAATGGGAGGAGGAAGGATTGTTGATGAGAGTGGAAAGAGCTACTCTCTACCTGAGATTCTCCGGAATCTAAACTATGAAGATCTTGAGGATGATTGTGAGGAAGATGACTTGAAGGCTAAGGATCATCACCACCACCATCACCATCAACATCAACATAATGAGGGAATCATCCCTCCTTTTGACCCTTTTTTTACCAATGAGATTGGTAGTAACAAAGATGAGAGAAATGGAGAAGAATCAGGAGGATCTTCAAGTGATGGTGAAAATACAGGGAAACGCGTTCGGGTCTCAGATGAAGATGAAGAGAAAGTTGAAGGGTATGAACGAAATTGGAGTACAGATAAAGGTATGAATATAAACGCAGGATCTGAAGATGGAGCAAGCTCTCCTGTATCCACTTCACCAATGCTTCGTAAATAGAGAGAAGGAAGGACTTGAAGCTGGAGAAATGGAGTTTGTGCTTTATCATTCTTTTAATTCTGTTTCATATAATTGTGGGAAAAAAAATCCGAAAAATAACAATCATCTTAGAAAATTGTGAGTTTGAGCACTAGATTTTTTTATTTTTAAAATTCTCCTTTTTAGTTGTATTTATATATACCAGAATGGTCTGGATATCACCAGCATCACATATTTTCTCTCTTTTTTATTTTTCCTTTTTTGTTATAAAAAAAGATTTGGACCACGAATTTGTAACGTATATACTGTTGTCGGAATTATTTTTCCTTATTTTATTGGTTGATTTTCAT

SEQ ID NO: 2679 - DNA, 986 bp, Zea mays
  misc_feature (1)..(986): Ceres cDNA ID no. 13622682
  misc_feature (1)..(986): Ceres CLONE  ID no. 447737
  misc_feature (1)..(986): Also known as  Ceres CDNA ID no. 24364743
attcccgctcgctacggccccagtcgcgctcctcaccggccggcaccaccccgcccgccctcgccttttgcctgcccagatttaggcctggcattctagcaatgcagaagaagtgatcttataatcataaaagataacaatggggatatccaaggtgaccggcattgctgcgacagcttttcttgtcacatctgttggtctgtaccagctcggcatgagaattgttgtgcttcctttcctagccaccagtattgttgcttctgttgtcaccgttgcatcccatgatgccatcaacctaccgtggatcctggggaagaactcagtgggaaggtttcctctttggtcagttatactgtttggtcctttcttgacgcttgctcggacatatgcaatggttaagagatacatgaggaaagagtccgtgtatgacaagattgtggaagacctatatcttggaggatggccctttctcttgaaacatttaccccctggaaacccatctgtcatagactgcacttgtgagcttccaagaagttccttcgttccagcagacgagtatctttgtcttgcaacttgggataccagagctccaacaccataccaaattgaaaaagctgcacgttgggcttgtggaaagagatctgaggggaagccggtttatgtccattgcgcatttggtcatggaagaagtgcttgtgttgtgtgtgcaattctagtagcgctgggcattgctgagaactggaaagatgctgagaacatcatccgtgaaagaagaaagataaaaatgaacgcccttcacaggaaaaccttagatgagtggtccaaacaacgagattttcagaaaaaggataagtagttgactagttgtaagtgtaacattttccttagtgatgaacttgtttgtggtgttaaagcctgtttgaaacatcaatggcatatttacttaagacaagtgtaatgtctgtgaaattattatttaaattttt

SEQ ID NO: 2680 - protein, 986 aa, Zea mays
  misc_feature: PFam Name: DSPc; PFam Description: Dual specificity
  misc_feature: GI Number: 34908470; NR Description: P0489B03.9 [Oryza sativa (japonica cultivar-group)] >gi|20161641|dbj|BAB90560.1| P0489B03.9 [Oryza sativa (japonica cultivar-group)] >gi|20521237|dbj|BAB91753.1| P0679C12.2 [Oryza sativa (japonica
  misc_feature: GI Number: 48864307; NR Description: COG1597: Sphingosine kinase and enzymes related to eukaryotic diacylglycerol kinase
ATTCCCGCTCGCTACGGCCCCAGTCGCGCTCCTCACCGGCCGGCACCACCCCGCCCGCCCTCGCCTTTTGCCTGCCCAGATTTAGGCCTGGCATTCTAGCAATGCAGAAGAAGTGATCTTATAATCATAAAAGATAACAATGGGGATATCCAAGGTGACCGGCATTGCTGCGACAGCTTTTCTTGTCACATCTGTTGGTCTGTACCAGCTCGGCATGAGAATTGTTGTGCTTCCTTTCCTAGCCACCAGTATTGTTGCTTCTGTTGTCACCGTTGCATCCCATGATGCCATCAACCTACCGTGGATCCTGGGGAAGAACTCAGTGGGAAGGTTTCCTCTTTGGTCAGTTATACTGTTTGGTCCTTTCTTGACGCTTGCTCGGACATATGCAATGGTTAAGAGATACATGAGGAAAGAGTCCGTGTATGACAAGATTGTGGAAGACCTATATCTTGGAGGATGGCCCTTTCTCTTGAAACATTTACCCCCTGGAAACCCATCTGTCATAGACTGCACTTGTGAGCTTCCAAGAAGTTCCTTCGTTCCAGCAGACGAGTATCTTTGTCTTGCAACTTGGGATACCAGAGCTCCAACACCATACCAAATTGAAAAAGCTGCACGTTGGGCTTGTGGAAAGAGATCTGAGGGGAAGCCGGTTTATGTCCATTGCGCATTTGGTCATGGAAGAAGTGCTTGTGTTGTGTGTGCAATTCTAGTAGCGCTGGGCATTGCTGAGAACTGGAAAGATGCTGAGAACATCATCCGTGAAAGAAGAAAGATAAAAATGAACGCCCTTCACAGGAAAACCTTAGATGAGTGGTCCAAACAACGAGATTTTCAGAAAAAGGATAAGTAGTTGACTAGTTGTAAGTGTAACATTTTCCTTAGTGATGAACTTGTTTGTGGTGTTAAAGCCTGTTTGAAACATCAATGGCATATTTACTTAAGACAAGTGTAATGTCTGTGAAATTATTATTTAAATTTTT

SEQ ID NO: 2681 - DNA, 2017 bp, Zea mays
  misc_feature (1)..(2017): Ceres cDNA ID no. 13622795
  misc_feature (1)..(2017): Ceres CLONE  ID no. 483472
  misc_feature (1)..(2017): Also known as  Ceres CDNA ID no. 24362688
atccttctagcttcgatctctatatacctctgtatgtgagtgaggccaatgagagccctcgtagtcgtaagtttcgcttcggcgtgcttgctgctgctgttgcagctcgcaggagcgtcgcatgtcgtctacaactacaaggacctcgaagccgaggctgctgcggcgacggaccaggtgccgccgtccatcgtcaaccccctgctcaggacggggtaccacttccagccccccaagaactggatcaatgatcccaacgcgcccatgtactacaaggggtggtaccatttcttctaccaatacaatcccaagggcgccgtatggggcaacatcgtgtgggcgcactcggtgtcgcgagacctcatcaactgggtggcgctagagccggcgctcagaccaagcatcccgggcgacaggtacggctgctggtccgggtcggcgacggtgctgcccgacggcggcggcccggtgatcatgtacacgggcgtggaccacccggacatcaactaccaggtccagaacgtggcgtacccgaagaacgtgtcggacccgctgctccgggagtgggtgaagccctcgcacaaccccgtcatcgtccccgagggcggcatcaacgcgacgcagttccgcgacccgaccacggcctggcgcggccccggccccgagcagtggcggctgctcgtcggcagcgcggcggggtcgtcgccgccccgcggcgtggcgtacgtgtaccgtagccgcgacttccggcggtggaggcgggtgcggcggccgctgcactcggcgcccacggggatgtgggagtgccctgacttctacccggtgagcaagggcggcgcgccgcgcgcggggctcgagacgtccgtgccgcccggcccaagggtcaagcacgtgctcaagaacagcctcgacctccggcggtacgactactacaccgtgggcacgtaccacccgagggccgagcggtacgtgccggacgaccccgccggcgacgagcaccgcctgcgctacgactacggcaacttctacgcgtccaagacgttctacgacccggccaagcggcgccgcatcctgtggggctgggctaacgagtccgacaccgccgccgacgatgtggctaaaggctgggctggaatccaggcgattccaaggacggtgtggctggaccccagtgggaagcagctgctgcagtggcctatcgaggaggtggaggcgctgagagcaaagtcggtcactctcaggaacagggtaatcaaggcaggacatcacgtcgaggtgaccgggatacaaacggcacaggctgacgtggaggtgagcttcgaagtgtcgccggcggccctggccggtgccgagacgctggacccggcgctggcctacgacgcggagaggctgtgcggcgtgaagcgcgcggacgtgaggggcggcgtggggccgttcgggctgtgggtgctggcctccgccaaccgcaaggagagaaccgcggtgttcttcagggtgttcaagcccgccgccggcgacaagcccgtggtgctcatgtgcaccgaccctaccaagtcgtccctgaacccgaacctgtaccgcccgacatttgcaggatttgtcgacacggacatctcgaacggcaagatatccctgagaagcctgatcgaccggtcggtcgttgagagcttcggagccgggggcaagacctgcatcctctccagggtctacccgtcgctggccatcggcaaggacgctcgcctctacgtgttcaacaacgggagggcgcacgtcaaggtgtcccgtctcaccgcgtgggagatgaagaagccggtcatgaacggggcctgaagatcttgaataaatatatcactcatgcatgacatatagtggcgcctgagaaatctttccttatatatatatatattttagatatatcgtttaagaattcattttctacactaaaagggcgccccgttatgttacaatggtaccagctgcacttctagtaacaaagacaattgactatttgttgttc

SEQ ID NO: 2682 - protein, 2017 aa, Zea mays
  misc_feature: PFam Name: Glyco_hydro_32; PFam Description: Glycosyl
  misc_feature: PFam Name: Mucin; PFam Description: Mucin-like glycoprotein
  misc_feature: GI Number: 3372518; NR Description: invertase [Zea mays] >gi|7435479|pir||T01575 beta-fructofuranosidase (EC 3.2.1.26) INCW2
  misc_feature: GI Number: 4105719; NR Description: cell wall invertase
  misc_feature: GI Number: 6318659; NR Description: cell wall invertase 2
  misc_feature: GI Number: 6318661; NR Description: cell wall invertase 2
  misc_feature: GI Number: 6318663; NR Description: cell wall invertase [Zea mays]
ATCCTTCTAGCTTCGATCTCTATATACCTCTGTATGTGAGTGAGGCCAATGAGAGCCCTCGTAGTCGTAAGTTTCGCTTCGGCGTGCTTGCTGCTGCTGTTGCAGCTCGCAGGAGCGTCGCATGTCGTCTACAACTACAAGGACCTCGAAGCCGAGGCTGCTGCGGCGACGGACCAGGTGCCGCCGTCCATCGTCAACCCCCTGCTCAGGACGGGGTACCACTTCCAGCCCCCCAAGAACTGGATCAATGATCCCAACGCGCCCATGTACTACAAGGGGTGGTACCATTTCTTCTACCAATACAATCCCAAGGGCGCCGTATGGGGCAACATCGTGTGGGCGCACTCGGTGTCGCGAGACCTCATCAACTGGGTGGCGCTAGAGCCGGCGCTCAGACCAAGCATCCCGGGCGACAGGTACGGCTGCTGGTCCGGGTCGGCGACGGTGCTGCCCGACGGCGGCGGCCCGGTGATCATGTACACGGGCGTGGACCACCCGGACATCAACTACCAGGTCCAGAACGTGGCGTACCCGAAGAACGTGTCGGACCCGCTGCTCCGGGAGTGGGTGAAGCCCTCGCACAACCCCGTCATCGTCCCCGAGGGCGGCATCAACGCGACGCAGTTCCGCGACCCGACCACGGCCTGGCGCGGCCCCGGCCCCGAGCAGTGGCGGCTGCTCGTCGGCAGCGCGGCGGGGTCGTCGCCGCCCCGCGGCGTGGCGTACGTGTACCGTAGCCGCGACTTCCGGCGGTGGAGGCGGGTGCGGCGGCCGCTGCACTCGGCGCCCACGGGGATGTGGGAGTGCCCTGACTTCTACCCGGTGAGCAAGGGCGGCGCGCCGCGCGCGGGGCTCGAGACGTCCGTGCCGCCCGGCCCAAGGGTCAAGCACGTGCTCAAGAACAGCCTCGACCTCCGGCGGTACGACTACTACACCGTGGGCACGTACCACCCGAGGGCCGAGCGGTACGTGCCGGACGACCCCGCCGGCGACGAGCACCGCCTGCGCTACGACTACGGCAACTTCTACGCGTCCAAGACGTTCTACGACCCGGCCAAGCGGCGCCGCATCCTGTGGGGCTGGGCTAACGAGTCCGACACCGCCGCCGACGATGTGGCTAAAGGCTGGGCTGGAATCCAGGCGATTCCAAGGACGGTGTGGCTGGACCCCAGTGGGAAGCAGCTGCTGCAGTGGCCTATCGAGGAGGTGGAGGCGCTGAGAGCAAAGTCGGTCACTCTCAGGAACAGGGTAATCAAGGCAGGACATCACGTCGAGGTGACCGGGATACAAACGGCACAGGCTGACGTGGAGGTGAGCTTCGAAGTGTCGCCGGCGGCCCTGGCCGGTGCCGAGACGCTGGACCCGGCGCTGGCCTACGACGCGGAGAGGCTGTGCGGCGTGAAGCGCGCGGACGTGAGGGGCGGCGTGGGGCCGTTCGGGCTGTGGGTGCTGGCCTCCGCCAACCGCAAGGAGAGAACCGCGGTGTTCTTCAGGGTGTTCAAGCCCGCCGCCGGCGACAAGCCCGTGGTGCTCATGTGCACCGACCCTACCAAGTCGTCCCTGAACCCGAACCTGTACCGCCCGACATTTGCAGGATTTGTCGACACGGACATCTCGAACGGCAAGATATCCCTGAGAAGCCTGATCGACCGGTCGGTCGTTGAGAGCTTCGGAGCCGGGGGCAAGACCTGCATCCTCTCCAGGGTCTACCCGTCGCTGGCCATCGGCAAGGACGCTCGCCTCTACGTGTTCAACAACGGGAGGGCGCACGTCAAGGTGTCCCGTCTCACCGCGTGGGAGATGAAGAAGCCGGTCATGAACGGGGCCTGAAGATCTTGAATAAATATATCACTCATGCATGACATATAGTGGCGCCTGAGAAATCTTTCCTTATATATATATATATTTTAGATATATCGTTTAAGAATTCATTTTCTACACTAAAAGGGCGCCCCGTTATGTTACAATGGTACCAGCTGCACTTCTAGTAACAAAGACAATTGACTATTTGTTGTTC

SEQ ID NO: 2683 - DNA, 1181 bp, Zea mays
  misc_feature (1)..(1181): Ceres cDNA ID no. 13622983
  misc_feature (1)..(1181): Ceres CLONE  ID no. 992543
  misc_feature (1)..(1181): Also known as  Ceres CDNA ID no. 23824684
aaacgatacacgccgcgatagaaacactcagacacaccctctccatccgcccctccaccctcctcttcctcctcccgtcgcggcttcccccgattggcatccggggcgggcccatcccccacccggccgccgcgcgcgtccatggacggcctgcacggtacggacgcctgcttctcccccgcgagggccgtctcgccgcaggtgaggctaccggggccgccggacgtgggcagtcagtacctggcggagctgctgcaggagcaccagaagctgggacccttcatgcaggtgctcccaatctgcagcaggctgctgaatcaagagagtaggtgttccgcaaggagctatgggttggcaaggacccccacagagccctgcttcttatatcgtcaagaagattttgcggttggaagtaccgacagaaacataccctaatttcaattttatcggtcgtcttcttggaccaaggggaaattctttaaagaggattgaagcctgtacaggctgtcgtgtattcatcagagggaaaggctcaattaaagattctggcaaggaggaacaactcaagggaagacctggctatgaacacttgagtgaacccctccatatcttgattgaagctgagttacctgctaatgtgattgatgcaagacttgcaaaggcacaagagatccttgaagagttgttgaaaccagtggacgagtcacaagactactacaagagacagcaactccgagaacttgccatgttgaattcgccactccgagaggagagtccacgttcaggcggtgctcctccaagtcccttcagtaagactgtctccggtaggccgaataaaacaggggacacagaattgtagatgacactatttatcactgtttgaagagagaagtttgaaataggggatctactggagatagcctaacggcggcatgaaaagagtgaaacaatgacacccattcctccatcttgatcctccggcaaccccacttagtccatgccttcacatcctattttccatgagcaaagctttcatgatggtgttggtagtgtgtgacatcctttaatgtactagcaggtgaattttgatctcccatcccatgtgacattaaccttgagtgacagatgactatgcgtagtgtatcctctatgactgtataattagaacatttgatttatct

SEQ ID NO: 2684 - protein, 1181 aa, Zea mays
  misc_feature: PFam Name: KH_1; PFam Description: KH domain
  misc_feature: GI Number: 34900448; NR Description: KH domain-like protein [Oryza sativa (japonica cultivar-group)] >gi|24060154|dbj|BAC21599.1| KH domain-like protein [Oryza sativa
  misc_feature: GI Number: 23197752; NR Description: putative RNA-binding protein [Arabidopsis thaliana] >gi|3786011|gb|AAC67357.1| putative RNA-binding protein [Arabidopsis thaliana] >gi|17978787|gb|AAL47387.1| putative RNA-binding protein
  misc_feature: GI Number: 34909270; NR Description: P0454H12.18 [Oryza sativa (japonica cultivar-group)] >gi|15128399|dbj|BAB62585.1|
  misc_feature: GI Number: 56785233; NR Description: QUAKING isoform 5-like [Oryza sativa (japonica cultivar-group)] gi|56784311|dbj|BAD82237.1| QUAKING isoform 5-like [Oryza sativa
  misc_feature: GI Number: 19310523; NR Description: At1g09660/F21M12_5 [Arabidopsis thaliana] >gi|16930473|gb|AAL31922.1|
AAACGATACACGCCGCGATAGAAACACTCAGACACACCCTCTCCATCCGCCCCTCCACCCTCCTCTTCCTCCTCCCGTCGCGGCTTCCCCCGATTGGCATCCGGGGCGGGCCCATCCCCCACCCGGCCGCCGCGCGCGTCCATGGACGGCCTGCACGGTACGGACGCCTGCTTCTCCCCCGCGAGGGCCGTCTCGCCGCAGGTGAGGCTACCGGGGCCGCCGGACGTGGGCAGTCAGTACCTGGCGGAGCTGCTGCAGGAGCACCAGAAGCTGGGACCCTTCATGCAGGTGCTCCCAATCTGCAGCAGGCTGCTGAATCAAGAGAGTAGGTGTTCCGCAAGGAGCTATGGGTTGGCAAGGACCCCCACAGAGCCCTGCTTCTTATATCGTCAAGAAGATTTTGCGGTTGGAAGTACCGACAGAAACATACCCTAATTTCAATTTTATCGGTCGTCTTCTTGGACCAAGGGGAAATTCTTTAAAGAGGATTGAAGCCTGTACAGGCTGTCGTGTATTCATCAGAGGGAAAGGCTCAATTAAAGATTCTGGCAAGGAGGAACAACTCAAGGGAAGACCTGGCTATGAACACTTGAGTGAACCCCTCCATATCTTGATTGAAGCTGAGTTACCTGCTAATGTGATTGATGCAAGACTTGCAAAGGCACAAGAGATCCTTGAAGAGTTGTTGAAACCAGTGGACGAGTCACAAGACTACTACAAGAGACAGCAACTCCGAGAACTTGCCATGTTGAATTCGCCACTCCGAGAGGAGAGTCCACGTTCAGGCGGTGCTCCTCCAAGTCCCTTCAGTAAGACTGTCTCCGGTAGGCCGAATAAAACAGGGGACACAGAATTGTAGATGACACTATTTATCACTGTTTGAAGAGAGAAGTTTGAAATAGGGGATCTACTGGAGATAGCCTAACGGCGGCATGAAAAGAGTGAAACAATGACACCCATTCCTCCATCTTGATCCTCCGGCAACCCCACTTAGTCCATGCCTTCACATCCTATTTTCCATGAGCAAAGCTTTCATGATGGTGTTGGTAGTGTGTGACATCCTTTAATGTACTAGCAGGTGAATTTTGATCTCCCATCCCATGTGACATTAACCTTGAGTGACAGATGACTATGCGTAGTGTATCCTCTATGACTGTATAATTAGAACATTTGATTTATCT

SEQ ID NO: 2685 - DNA, 1604 bp, Zea mays
  misc_feature (1)..(1604): Ceres cDNA ID no. 13623434
  misc_feature (1)..(1604): Ceres CLONE  ID no. 1155756
  misc_feature (1)..(1604): Also known as  Ceres CDNA ID no. 23829328
atttgttttgtagggacttgtttacagactatgctgacttctgttttaagacctacggcgatcgcgtaaagcactggtttacattcaatgagccaaggatagtagcgctacttggctatgacacagggtcaaatcctcctcaaaggtgcaccagatgcgctgctggtgggaattcagcaaccgaaccttacatagttgctcataattttctcttggcacatgctactgcagttgcaagataccgtacgaaatatcaggtatttccatcttgagaacctcagaagttcctctgaaaaataacatcactctagcactcctaggagtggtaaactgatgttattttattcaatgaagtgtgtggtccaggattttatttttaaatgaaatgtgggcagggtctatatatgcttggaagttggaacaatggtcagcatactttcacattaataactctactgttcatgaaatgcattagcttgttctcctaaacgattggacatgtgcctgtcgaatttcattagtttcttggactgaaaactgctgatggaagagtgacatgatgttttaaaaacataggctgctcagaagggtaaggtcggaatagtcctggacttcaactggtacgaggctcttacaaactcacctgatgaccaagcagcagcccaaagagccagggacttccacattggctggtttgttgatccattgataaacggacactatccacagataatgcaagatctcgtgaaggagaggctgcccaggttcactcctgagcaggctaaactggtgaagggctcggcagactacatcggtatcaacgagtacacatccagctacatgaaggggcagaagctggtccagctggcgcccagtagctactctgccgattggcaggttcaatatgtttgtgagtttaatttcttgtgctttaaactcgatatttcgaataaatatgtatttgccttggatatatatttttttcaccaaacctaaacatccgtcccataaattctgtagttgcacgcaatggcaaaccgattggaccacaggcgaattctaagtggctctacatcgccccgacggggatgtacgggtgcgtgaactacctcaaggagaagtatgggaatccaacgatctacataacggagaacggaatggaccagcctggaaacttgacccgagaccagtacctgcgcgacgccacgagggtgcggttctacaggagctacatcggccagctgaagaaggccatagaccagggagcgaacgtggctggctacttcgcctggtctctcctcgacaacttcgagtggctggcagggtactcgtccaagttcggcatcgtctacgtggacttcaacacgctcgaacgccacccgaaggcgtcggcctactggttcagggacatgcttcagaagcattgagatctccagagccgagcctgagcacggaaggtaccattttgttcagcttcgcctagtgtttgggatggcccaatggttcaaatccggctcagtgcctggctaccaaaatgggaacaaaggacagctaccccgatcaattgtgatgttgtgtgtttgtgggtatgttctctctggagt

SEQ ID NO: 2686 - protein, 1604 aa, Zea mays
  misc_feature: PFam Name: Glyco_hydro_1; PFam Description: Glycosyl
  misc_feature: GI Number: 7489456; NR Description: beta-glucosidase (EC
  misc_feature: GI Number: 50918079; NR Description: beta-glucosidase (with alternative splicing) [Oryza sativa (japonica cultivar-group)] >gi|41469453|gb|AAS07254.1| beta-glucosidase (with alternative
  misc_feature: GI Number: 18875458; NR Description: beta-glucosidase [Oryza
  misc_feature: GI Number: 50881477; NR Description: glycosyl hydrolase
  misc_feature: GI Number: 50918083; NR Description: putative beta-glucosidase [Oryza sativa (japonica cultivar-group)] >gi|41469450|gb|AAS07251.1| putative beta-glucosidase [Oryza sativa
ATTTGTTTTGTAGGGACTTGTTTACAGACTATGCTGACTTCTGTTTTAAGACCTACGGCGATCGCGTAAAGCACTGGTTTACATTCAATGAGCCAAGGATAGTAGCGCTACTTGGCTATGACACAGGGTCAAATCCTCCTCAAAGGTGCACCAGATGCGCTGCTGGTGGGAATTCAGCAACCGAACCTTACATAGTTGCTCATAATTTTCTCTTGGCACATGCTACTGCAGTTGCAAGATACCGTACGAAATATCAGGTATTTCCATCTTGAGAACCTCAGAAGTTCCTCTGAAAAATAACATCACTCTAGCACTCCTAGGAGTGGTAAACTGATGTTATTTTATTCAATGAAGTGTGTGGTCCAGGATTTTATTTTTAAATGAAATGTGGGCAGGGTCTATATATGCTTGGAAGTTGGAACAATGGTCAGCATACTTTCACATTAATAACTCTACTGTTCATGAAATGCATTAGCTTGTTCTCCTAAACGATTGGACATGTGCCTGTCGAATTTCATTAGTTTCTTGGACTGAAAACTGCTGATGGAAGAGTGACATGATGTTTTAAAAACATAGGCTGCTCAGAAGGGTAAGGTCGGAATAGTCCTGGACTTCAACTGGTACGAGGCTCTTACAAACTCACCTGATGACCAAGCAGCAGCCCAAAGAGCCAGGGACTTCCACATTGGCTGGTTTGTTGATCCATTGATAAACGGACACTATCCACAGATAATGCAAGATCTCGTGAAGGAGAGGCTGCCCAGGTTCACTCCTGAGCAGGCTAAACTGGTGAAGGGCTCGGCAGACTACATCGGTATCAACGAGTACACATCCAGCTACATGAAGGGGCAGAAGCTGGTCCAGCTGGCGCCCAGTAGCTACTCTGCCGATTGGCAGGTTCAATATGTTTGTGAGTTTAATTTCTTGTGCTTTAAACTCGATATTTCGAATAAATATGTATTTGCCTTGGATATATATTTTTTTCACCAAACCTAAACATCCGTCCCATAAATTCTGTAGTTGCACGCAATGGCAAACCGATTGGACCACAGGCGAATTCTAAGTGGCTCTACATCGCCCCGACGGGGATGTACGGGTGCGTGAACTACCTCAAGGAGAAGTATGGGAATCCAACGATCTACATAACGGAGAACGGAATGGACCAGCCTGGAAACTTGACCCGAGACCAGTACCTGCGCGACGCCACGAGGGTGCGGTTCTACAGGAGCTACATCGGCCAGCTGAAGAAGGCCATAGACCAGGGAGCGAACGTGGCTGGCTACTTCGCCTGGTCTCTCCTCGACAACTTCGAGTGGCTGGCAGGGTACTCGTCCAAGTTCGGCATCGTCTACGTGGACTTCAACACGCTCGAACGCCACCCGAAGGCGTCGGCCTACTGGTTCAGGGACATGCTTCAGAAGCATTGAGATCTCCAGAGCCGAGCCTGAGCACGGAAGGTACCATTTTGTTCAGCTTCGCCTAGTGTTTGGGATGGCCCAATGGTTCAAATCCGGCTCAGTGCCTGGCTACCAAAATGGGAACAAAGGACAGCTACCCCGATCAATTGTGATGTTGTGTGTTTGTGGGTATGTTCTCTCTGGAGT

SEQ ID NO: 2687 - DNA, 1222 bp, Zea mays
  misc_feature (1)..(1222): Ceres cDNA ID no. 13623625
  misc_feature (1)..(1222): Ceres CLONE  ID no. 676964
  misc_feature (1)..(1222): Also known as  Ceres CDNA ID no. 23831291
actaccgctgcgagtggccgctcccgcaggttctgctctccgccttctccatccacaacgagaccctcaacgtctggacgcatcttataggatttttcatctttctcgctctgaccatatacacagcaacacaagttccaaatgcagtagatatccggagcttgcagcatttgccagatgtactgagaaaggctgatattcataagattcaggcagagcttgtgtcatgtcttccgtcgttacctcacctttcagatctacaaaagctgaaggatgagctgaagacctcttggaattctatggaggttcttccatctctgtcccgttggcatctcttggagttactcgcaaattgtctgccacacagatttacccatcccaatgaaacaagtttgtctgttcttcaaagcatgaaggaggatctagcaagcctgattgcaccgcaactgatcagaccaattgcgcggtggccattctatgccttcttgggaggagccatgttctgcctccttgccagcagcacttgccaccttctctcctgccattctcgccgcctagcatacattatgcttcggcttgattacgcaggcatcgcagctctaatcgccacgtccttctaccctccagtatactattctttcatgtgctaccccttcttttgcaacctgtacctcagtttcataaccatcctaggagtggcaactatcgcgttctctctacttccggtcttccagaatccggagttcagaaccatcagagcatgcctcttctttggcatgggtgcatctggcgtgatacctgttcttcacaagctggtcctcttctggcaccaaccggaggcattgcacacgaccggatacgaaattctgatggggctcttctacgggctgggagcattggtatatgcggcacgggtacctgagcgctggatgcctgggaagtttgacatcgccgggcacagccaccagctgttccacgtcttggttgttgccggagcctacacacactaccacgcagggcttgtgtacctcaagtggagagacctgcaaggctgctgaaaggtgctgcatcgttgaggatgtggatagattgtagattccgtgaattcaggctgaaggtcatggtctgttgtaaattgtaacagtaatcatgaaacaattgctacaagtctaccaggtagtcgggcttccattaataatcaattgaagactagtatttatgc

SEQ ID NO: 2688 - protein, 1222 aa, Zea mays
  misc_feature: PFam Name: HlyIII; PFam Description: Haemolysin-III related
  misc_feature: PFam Name: TT_ORF2; PFam Description: TT viral ORF2
  misc_feature: GI Number: 51535508; NR Description: putative adiponectin receptor 1 [Oryza sativa (japonica cultivar-group)] >gi|51535474|dbj|BAD37371.1| putative adiponectin receptor 1 [Oryza
  misc_feature: GI Number: 31209635; NR Description: ENSANGP00000012224 [Anopheles gambiae] >gi|30176836|gb|EAA09141.2| ENSANGP00000012224
  misc_feature: GI Number: 51593696; NR Description: MGC85478 protein
  misc_feature: GI Number: 34858379; NR Description: similar to adiponectin
  misc_feature: GI Number: 51261528; NR Description: MGC84736 protein
ACTACCGCTGCGAGTGGCCGCTCCCGCAGGTTCTGCTCTCCGCCTTCTCCATCCACAACGAGACCCTCAACGTCTGGACGCATCTTATAGGATTTTTCATCTTTCTCGCTCTGACCATATACACAGCAACACAAGTTCCAAATGCAGTAGATATCCGGAGCTTGCAGCATTTGCCAGATGTACTGAGAAAGGCTGATATTCATAAGATTCAGGCAGAGCTTGTGTCATGTCTTCCGTCGTTACCTCACCTTTCAGATCTACAAAAGCTGAAGGATGAGCTGAAGACCTCTTGGAATTCTATGGAGGTTCTTCCATCTCTGTCCCGTTGGCATCTCTTGGAGTTACTCGCAAATTGTCTGCCACACAGATTTACCCATCCCAATGAAACAAGTTTGTCTGTTCTTCAAAGCATGAAGGAGGATCTAGCAAGCCTGATTGCACCGCAACTGATCAGACCAATTGCGCGGTGGCCATTCTATGCCTTCTTGGGAGGAGCCATGTTCTGCCTCCTTGCCAGCAGCACTTGCCACCTTCTCTCCTGCCATTCTCGCCGCCTAGCATACATTATGCTTCGGCTTGATTACGCAGGCATCGCAGCTCTAATCGCCACGTCCTTCTACCCTCCAGTATACTATTCTTTCATGTGCTACCCCTTCTTTTGCAACCTGTACCTCAGTTTCATAACCATCCTAGGAGTGGCAACTATCGCGTTCTCTCTACTTCCGGTCTTCCAGAATCCGGAGTTCAGAACCATCAGAGCATGCCTCTTCTTTGGCATGGGTGCATCTGGCGTGATACCTGTTCTTCACAAGCTGGTCCTCTTCTGGCACCAACCGGAGGCATTGCACACGACCGGATACGAAATTCTGATGGGGCTCTTCTACGGGCTGGGAGCATTGGTATATGCGGCACGGGTACCTGAGCGCTGGATGCCTGGGAAGTTTGACATCGCCGGGCACAGCCACCAGCTGTTCCACGTCTTGGTTGTTGCCGGAGCCTACACACACTACCACGCAGGGCTTGTGTACCTCAAGTGGAGAGACCTGCAAGGCTGCTGAAAGGTGCTGCATCGTTGAGGATGTGGATAGATTGTAGATTCCGTGAATTCAGGCTGAAGGTCATGGTCTGTTGTAAATTGTAACAGTAATCATGAAACAATTGCTACAAGTCTACCAGGTAGTCGGGCTTCCATTAATAATCAATTGAAGACTAGTATTTATGC

SEQ ID NO: 2689 - DNA, 1092 bp, Zea mays
  misc_feature (1)..(1092): Ceres cDNA ID no. 13624427
  misc_feature (1)..(1092): Ceres CLONE  ID no. 491696
  misc_feature (1)..(1092): Also known as  Ceres CDNA ID no. 24361830
atccacctcggctcactccactcactgcaccgagctcactggcaatggctaccagcaccaagctcgtggcccttggctttgccgtcctcctgagcatcggcttctccgatgcagcgagggtagttaggcttggtagccatgcgtctgcgggaggtggaggtggcggcgggggaggcggctccgggtcgactgggggtggctttggcggtgggtcgggcggtggcggtggttacggcataggtaagggtggcggggactggtggaacaatttcgtctctagtatagcaggtggtggaggaggaggacaaggcggaggcggtggcaccaatggtgggtccgggtccggcggtgggtccggttatggttctggcagcagctcgactgcagcctctggccccagcagtggcaactacgccgacgctgagggcaagggcgccggtggaggcatgggcggtggtgccaatggtgcatatggttctggtgctggtggaggcgttggcaagggcgagggtgtgagtggtgtggcactcgcaccatcgtccaacggctactacaatggcggtgccgccgatgctaccggtggcggttccggcgccggcggtggacatggtggtggcgcagccggagctccaagctatggaaccggaggcggcctcggcggaggcaagggtgaggccggcagcgatggatcgtgggggtcaggttatgctcagggaatcggtgctggcacaggcggcggtggcggcggcggatcccaaggcggctctggtggcggtggaggctctgggtccggatccggcagcggtggaatccactgagcttgcacttcagtagctagagcctagagccccgcattagtgtcagtccattctgtggttttttgctgtctttgttacgagaattaatcaggaataaagcgtaatgggcttcgtgattgtagttcgagtaggtagcaaagcatgcaactgatatgaatgcatgtaatggctatctacgagtgtgtgcccctagctgtaatctgtttctcatcgatcgttaaggtcgttgcatccggttttatttatcttctgaaaccaaaatacattggaactc

SEQ ID NO: 2690 - protein, 1092 aa, Zea mays
  misc_feature: PFam Name: Dehydrin; PFam Description: Dehydrin
  misc_feature: PFam Name: GRP; PFam Description: Glycine rich protein family
  misc_feature: PFam Name: S-antigen; PFam Description: S-antigen protein
  misc_feature: PFam Name: Secretin_N; PFam Description: Bacterial type
  misc_feature: PFam Name: Harpin; PFam Description: Harpin protein (HrpN)
  misc_feature: GI Number: 1532071; NR Description: glycine-rich protein [Zea
  misc_feature: GI Number: 51090508; NR Description: putative glycine rich
  misc_feature: GI Number: 7636182; NR Description: glycine-rich protein
  misc_feature: GI Number: 51091828; NR Description: putative glycine rich
  misc_feature: GI Number: 34898126; NR Description: putative glycine-rich cell wall protein precursor [Oryza sativa (japonica cultivar-group)] >gi|24059890|dbj|BAC21356.1| putative glycine-rich cell wall protein precursor [Oryza sativa (japonica
ATCCACCTCGGCTCACTCCACTCACTGCACCGAGCTCACTGGCAATGGCTACCAGCACCAAGCTCGTGGCCCTTGGCTTTGCCGTCCTCCTGAGCATCGGCTTCTCCGATGCAGCGAGGGTAGTTAGGCTTGGTAGCCATGCGTCTGCGGGAGGTGGAGGTGGCGGCGGGGGAGGCGGCTCCGGGTCGACTGGGGGTGGCTTTGGCGGTGGGTCGGGCGGTGGCGGTGGTTACGGCATAGGTAAGGGTGGCGGGGACTGGTGGAACAATTTCGTCTCTAGTATAGCAGGTGGTGGAGGAGGAGGACAAGGCGGAGGCGGTGGCACCAATGGTGGGTCCGGGTCCGGCGGTGGGTCCGGTTATGGTTCTGGCAGCAGCTCGACTGCAGCCTCTGGCCCCAGCAGTGGCAACTACGCCGACGCTGAGGGCAAGGGCGCCGGTGGAGGCATGGGCGGTGGTGCCAATGGTGCATATGGTTCTGGTGCTGGTGGAGGCGTTGGCAAGGGCGAGGGTGTGAGTGGTGTGGCACTCGCACCATCGTCCAACGGCTACTACAATGGCGGTGCCGCCGATGCTACCGGTGGCGGTTCCGGCGCCGGCGGTGGACATGGTGGTGGCGCAGCCGGAGCTCCAAGCTATGGAACCGGAGGCGGCCTCGGCGGAGGCAAGGGTGAGGCCGGCAGCGATGGATCGTGGGGGTCAGGTTATGCTCAGGGAATCGGTGCTGGCACAGGCGGCGGTGGCGGCGGCGGATCCCAAGGCGGCTCTGGTGGCGGTGGAGGCTCTGGGTCCGGATCCGGCAGCGGTGGAATCCACTGAGCTTGCACTTCAGTAGCTAGAGCCTAGAGCCCCGCATTAGTGTCAGTCCATTCTGTGGTTTTTTGCTGTCTTTGTTACGAGAATTAATCAGGAATAAAGCGTAATGGGCTTCGTGATTGTAGTTCGAGTAGGTAGCAAAGCATGCAACTGATATGAATGCATGTAATGGCTATCTACGAGTGTGTGCCCCTAGCTGTAATCTGTTTCTCATCGATCGTTAAGGTCGTTGCATCCGGTTTTATTTATCTTCTGAAACCAAAATACATTGGAACTC

SEQ ID NO: 2691 - DNA, 2628 bp, Zea mays
  misc_feature (1)..(2628): Ceres cDNA ID no. 13627034
  misc_feature (1)..(2628): Ceres CLONE  ID no. 1390744
  misc_feature (1)..(2628): Also known as  Ceres CDNA ID no. 23851895
atcacttgttcttcttcgagctaccagctgcctatcatggtcatcatggtcgagctgctgcccccacttgcctctctaatcctcagtcctctgtagagctggtcctcctacccctcactttgccttgagcaatttggtttctagcatctgtggggtggcttgtgggtggtcgccttggactgctccttcctccacctgccgcgccggcagggcgacgaggtccaaaagcctggtggggctcatcatcaagaacaccgaagcggcgagagtggcatgggatctgatccgaggcggagctcgaggagctgagggctgtacgtgctcttggatccggtagagatcacgtgccctcgtgttcgtccccggccgccgcgatggggaacacgtgcgtcggccccagcatcaccatgaacggcttcttccagtccgtgtccacggcgctgtggaagacgccgcaggaaggcgacgcgctgcccgccgccgccaatggccccggcgggccagccggggccggttcgcagtcggcgctgccgaagccggcgtccgacgtgcaccacgtcgccgtgcagagcgaggcccctgagcccgtcaagatcgccgcctaccactcggagccggcgcccgccgtgcggagcgaggcccctgagcccgtcaagatcgccgcctctcactcggagccggcgcccatggccgccaagcctggtggcgccgccgccaacgccagccccagccccagccccaggccgcgtccgcaggtgaagcgcgtgtcgagcgccgggctgctgctggggtcggtgctgaggcgcaagacggagaacctcaaggacaagtacagcctggggcggcggctcgggcaggggcagttcggcacgacgcacctgtgcgtggagcgcgccacggggaaggagctcgcgtgcaagtcgatcctgaagcgcaagctgggcagcgacgacgacgtggaggacgtgcggcgggagatccagataatgcaccacctggcgggccaccccagcgtggtcggcatccgcggcgcgtacgaggacgccgtggccgtgcacctcgtcatggagctctgcggcggcggcgagctgttcgaccggatcgtgcggaggggccactacaccgagaggaaggccgccgagctcgcccgcgtcatcgtcggcgtcgtggaggcgtgccactccatgggcgtcatgcaccgggacctcaagcccgagaacttcctcttcgctgaccactcggaggaggccgctctcaagaccattgacttcggtctctccatcttctttcgccctggccaaattttcaccgacgtcgtgggcagcccttactacgtggcgccggaggtactgaagaagagatacgggccagaggcggacgtctggagcgctggcgtaatcatctacatcctgctgtgcggagtgccgccattctgggcagagaacgagcagggcatattcgaggaggttctgcacgggaggctggacttcgagtcggagccgtggcccagcatctccgacggcgccaaggatctcgtgaggaggatgcttgtcagggacccgaggaagagactgaccgctcacgaagttctacggcatccgtgggttcaggtcggtggagtggctcctgacaggccgctggactcggccgttctgtctcgcatgaagcagttctcggctatgaataagctgaagaagatggctcttagggtgatcgccgagaacctgtcggaggacgagatcgccgggctgagggagatgttcaagatgatcgacgcggacaacagcgggcagatcacgttcgaggagctcaaggttggcctggagaaggtgggcgccaacctgcaggagtcggagatctacgcgctcatgcaagccgcggacgtggacaacaacggcacgatcgactacggcgagttcatcgcggccacgctgcacctgaacaaggtggagcgggaggaccacctgttcgcggcgttccagtacttcgacaaggacggcagcggctacatcaccgccgacgagctgcaggtggcgtgcgaggagttcggcctgggcgacgtccagctggaggacttgatcggggaagtcgaccaggacaacgacgggcgcatagactacaacgagttcgtggcgatgatgcagaagccgacggtggggggatcccgaagaaggccgatctgcagaacagcttcagcatcgggttcagcatcgggttcagggaggcgctcaggatggcctagacctctgtgtctctggcttccctgctgcctgcgtgtaggtgtagatgattgaattgagtgggtgtcagtgcagttgctgtagagaccaccgtagcatagagatctgatgagatgcgagttgaggcgggccaggagacgtgtacatgtgccatagccatacaggcggccctgcatcggtttgatttgattgcttggttccaaacggtcctgtgtttcatgtcgcgtgcacatgtgccatatctgcctgctgctgctactactgctatatgccgtgcacgtgcacgtcggtgacctgaaacttggctgtccggcggtccggccaccgagctctaaggctatccatagcggtttttctaaatttttatccttatatcattttttgcgtc

SEQ ID NO: 2692 - protein, 2628 aa, Zea mays
  misc_feature: PFam Name: Pkinase; PFam Description: Protein kinase domain
  misc_feature: GI Number: 50948895; NR Description: ESTs C22369(C12239),C22370(C12239), AU057852(S21844),AU057853(S21844) correspond to a region of the predicted gene.~similar to calcium dependent protein kinase. (AF048691) [Oryza sativa (japonica
  misc_feature: GI Number: 62732966; NR Description: Protein kinase domain,
  misc_feature: GI Number: 23306121; NR Description: Putative calcium
  misc_feature: GI Number: 6721111; NR Description: T4O12.25 [Arabidopsis thaliana]
  misc_feature: GI Number: 23491794; NR Description: calcium dependent
ATCACTTGTTCTTCTTCGAGCTACCAGCTGCCTATCATGGTCATCATGGTCGAGCTGCTGCCCCCACTTGCCTCTCTAATCCTCAGTCCTCTGTAGAGCTGGTCCTCCTACCCCTCACTTTGCCTTGAGCAATTTGGTTTCTAGCATCTGTGGGGTGGCTTGTGGGTGGTCGCCTTGGACTGCTCCTTCCTCCACCTGCCGCGCCGGCAGGGCGACGAGGTCCAAAAGCCTGGTGGGGCTCATCATCAAGAACACCGAAGCGGCGAGAGTGGCATGGGATCTGATCCGAGGCGGAGCTCGAGGAGCTGAGGGCTGTACGTGCTCTTGGATCCGGTAGAGATCACGTGCCCTCGTGTTCGTCCCCGGCCGCCGCGATGGGGAACACGTGCGTCGGCCCCAGCATCACCATGAACGGCTTCTTCCAGTCCGTGTCCACGGCGCTGTGGAAGACGCCGCAGGAAGGCGACGCGCTGCCCGCCGCCGCCAATGGCCCCGGCGGGCCAGCCGGGGCCGGTTCGCAGTCGGCGCTGCCGAAGCCGGCGTCCGACGTGCACCACGTCGCCGTGCAGAGCGAGGCCCCTGAGCCCGTCAAGATCGCCGCCTACCACTCGGAGCCGGCGCCCGCCGTGCGGAGCGAGGCCCCTGAGCCCGTCAAGATCGCCGCCTCTCACTCGGAGCCGGCGCCCATGGCCGCCAAGCCTGGTGGCGCCGCCGCCAACGCCAGCCCCAGCCCCAGCCCCAGGCCGCGTCCGCAGGTGAAGCGCGTGTCGAGCGCCGGGCTGCTGCTGGGGTCGGTGCTGAGGCGCAAGACGGAGAACCTCAAGGACAAGTACAGCCTGGGGCGGCGGCTCGGGCAGGGGCAGTTCGGCACGACGCACCTGTGCGTGGAGCGCGCCACGGGGAAGGAGCTCGCGTGCAAGTCGATCCTGAAGCGCAAGCTGGGCAGCGACGACGACGTGGAGGACGTGCGGCGGGAGATCCAGATAATGCACCACCTGGCGGGCCACCCCAGCGTGGTCGGCATCCGCGGCGCGTACGAGGACGCCGTGGCCGTGCACCTCGTCATGGAGCTCTGCGGCGGCGGCGAGCTGTTCGACCGGATCGTGCGGAGGGGCCACTACACCGAGAGGAAGGCCGCCGAGCTCGCCCGCGTCATCGTCGGCGTCGTGGAGGCGTGCCACTCCATGGGCGTCATGCACCGGGACCTCAAGCCCGAGAACTTCCTCTTCGCTGACCACTCGGAGGAGGCCGCTCTCAAGACCATTGACTTCGGTCTCTCCATCTTCTTTCGCCCTGGCCAAATTTTCACCGACGTCGTGGGCAGCCCTTACTACGTGGCGCCGGAGGTACTGAAGAAGAGATACGGGCCAGAGGCGGACGTCTGGAGCGCTGGCGTAATCATCTACATCCTGCTGTGCGGAGTGCCGCCATTCTGGGCAGAGAACGAGCAGGGCATATTCGAGGAGGTTCTGCACGGGAGGCTGGACTTCGAGTCGGAGCCGTGGCCCAGCATCTCCGACGGCGCCAAGGATCTCGTGAGGAGGATGCTTGTCAGGGACCCGAGGAAGAGACTGACCGCTCACGAAGTTCTACGGCATCCGTGGGTTCAGGTCGGTGGAGTGGCTCCTGACAGGCCGCTGGACTCGGCCGTTCTGTCTCGCATGAAGCAGTTCTCGGCTATGAATAAGCTGAAGAAGATGGCTCTTAGGGTGATCGCCGAGAACCTGTCGGAGGACGAGATCGCCGGGCTGAGGGAGATGTTCAAGATGATCGACGCGGACAACAGCGGGCAGATCACGTTCGAGGAGCTCAAGGTTGGCCTGGAGAAGGTGGGCGCCAACCTGCAGGAGTCGGAGATCTACGCGCTCATGCAAGCCGCGGACGTGGACAACAACGGCACGATCGACTACGGCGAGTTCATCGCGGCCACGCTGCACCTGAACAAGGTGGAGCGGGAGGACCACCTGTTCGCGGCGTTCCAGTACTTCGACAAGGACGGCAGCGGCTACATCACCGCCGACGAGCTGCAGGTGGCGTGCGAGGAGTTCGGCCTGGGCGACGTCCAGCTGGAGGACTTGATCGGGGAAGTCGACCAGGACAACGACGGGCGCATAGACTACAACGAGTTCGTGGCGATGATGCAGAAGCCGACGGTGGGGGGATCCCGAAGAAGGCCGATCTGCAGAACAGCTTCAGCATCGGGTTCAGCATCGGGTTCAGGGAGGCGCTCAGGATGGCCTAGACCTCTGTGTCTCTGGCTTCCCTGCTGCCTGCGTGTAGGTGTAGATGATTGAATTGAGTGGGTGTCAGTGCAGTTGCTGTAGAGACCACCGTAGCATAGAGATCTGATGAGATGCGAGTTGAGGCGGGCCAGGAGACGTGTACATGTGCCATAGCCATACAGGCGGCCCTGCATCGGTTTGATTTGATTGCTTGGTTCCAAACGGTCCTGTGTTTCATGTCGCGTGCACATGTGCCATATCTGCCTGCTGCTGCTACTACTGCTATATGCCGTGCACGTGCACGTCGGTGACCTGAAACTTGGCTGTCCGGCGGTCCGGCCACCGAGCTCTAAGGCTATCCATAGCGGTTTTTCTAAATTTTTATCCTTATATCATTTTTTGCGTC

SEQ ID NO: 2693 - DNA, 1527 bp, Zea mays
  misc_feature (1)..(1527): Ceres cDNA ID no. 13633315
  misc_feature (1)..(1527): Ceres CLONE  ID no. 701852
  misc_feature (1)..(1527): Also known as  Ceres CDNA ID no. 24385221
agatcagatccccctttcgctggtttctttccccttggccaagcccaaaccgtctttaaatacacccgtcgtcgtccgcatcccccgcctgccttaaccattcctcccaacaccacctcgcctgcgatcttcgtagcctccgtcgcgtcgagcatcgatcatgtcggcctactgcggaaagtacaaggatgagctcatcaagaatgctgcctacattggcacccccggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaggagggaggcgtcctccctggcatcaaggttgacaagggcaccattgaggttgttggcactgataaggagaccaccacccaaggccatgacgaccttggcaagcgttgcgccaagtactacgaggccggtgcccgctttgccaagtggcgcgctgttctcaagattggccccaatgagccatcacagcttgccatcgacctgaacgctcagggtctggctcgctatgccatcatctgccaggagaatggtctggtgccaattgttgagcctgagatccttgttgatggccctcatgacattgatcgctgcgcttacgtcactgagaccgtccttgctgcctgctacaaggcgctcaacgagcaccatgtcctcctggagggtaccctcctgaagcccaacatggtgactccaggctccgactccaagaaggtgactcctgaggtgattgctgagtacaccgtccgtaccctccagaggaccgtccctgctgctgtgcctgctgttctcttcctctctggtggacagagcgaggaggaggccacccgcaacctcaatgccatgaacaagctcagcaccaagaagccgtggtccctgtctttctccttcggccgtgccctccaggcgagcaccctcaaggcctgggctggcaaggtggagaacttggagaaggctagagctgccttcctcgccaggtgcaaggccaactctgaggctaccctcggcacctacaagggtgatgctgccgccgacaccgagagcctccacgtcaaggactacaagtactgagttgcttctctttgcgtgcccgttttggaactcctgcctacgagctaggttgcggagtgtggtttgctcgttagagcttattttcggacatccaaaaaacatgcttcctatgtgggatgatggttatctttatatttgtatgttaattagtctctttgctgttaaatttcgtgtaagttggtcctgccgatggagaatcgagcagccccctttttttgttctatcaactatgctgtaatgctggctatgtatcggcaaaaacaattctatatgctgagttggagtcggcaaaaattcat

SEQ ID NO: 2694 - protein, 1527 aa, Zea mays
  misc_feature: PFam Name: Glycolytic; PFam Description:
  misc_feature: GI Number: 218157; NR Description: cytoplasmic aldolase
  misc_feature: GI Number: 10645188; NR Description: cytosolic aldolase
  misc_feature: GI Number: 295850; NR Description: fructose bisphosphate aldolase [Zea mays] >gi|68196|pir||ADZM fructose-bisphosphate aldolase (EC 4.1.2.13), cytosolic - maize >gi|113621|sp|P08440|ALF_MAIZE Fructose-bisphosphate aldolase,
  misc_feature: GI Number: 21592946; NR Description: fructose bisphosphate aldolase-like protein [Arabidopsis thaliana] >gi|7529717|emb|CAB86897.1| fructose bisphosphate aldolase-like protein [Arabidopsis thaliana] >gi|17380610|gb|AAL36068.1|
  misc_feature: GI Number: 2213867; NR Description: fructose-biphosphate aldolase [Mesembryanthemum crystallinum] >gi|7436609|pir||T12416 fructose-bisphosphate aldolase (EC 4.1.2.13), cytosolic - common
AGATCAGATCCCCCTTTCGCTGGTTTCTTTCCCCTTGGCCAAGCCCAAACCGTCTTTAAATACACCCGTCGTCGTCCGCATCCCCCGCCTGCCTTAACCATTCCTCCCAACACCACCTCGCCTGCGATCTTCGTAGCCTCCGTCGCGTCGAGCATCGATCATGTCGGCCTACTGCGGAAAGTACAAGGATGAGCTCATCAAGAATGCTGCCTACATTGGCACCCCCGGCAAGGGTATCCTTGCTGCTGATGAGTCCACTGGCACCATTGGCAAGCGCCTTTCCAGCATCAATGTCGAGAACGTTGAGGAGAACCGCCGTGCCCTCCGTGAGCTCCTATTCTGCTGCCCTGGTGCTCTCCAGTACATCAGCGGTGTGATCCTCTTCGAGGAGACCCTGTACCAGAAGACCAAGGATGGCAAGCCTTTTGTTGATGTCCTCAAGGAGGGAGGCGTCCTCCCTGGCATCAAGGTTGACAAGGGCACCATTGAGGTTGTTGGCACTGATAAGGAGACCACCACCCAAGGCCATGACGACCTTGGCAAGCGTTGCGCCAAGTACTACGAGGCCGGTGCCCGCTTTGCCAAGTGGCGCGCTGTTCTCAAGATTGGCCCCAATGAGCCATCACAGCTTGCCATCGACCTGAACGCTCAGGGTCTGGCTCGCTATGCCATCATCTGCCAGGAGAATGGTCTGGTGCCAATTGTTGAGCCTGAGATCCTTGTTGATGGCCCTCATGACATTGATCGCTGCGCTTACGTCACTGAGACCGTCCTTGCTGCCTGCTACAAGGCGCTCAACGAGCACCATGTCCTCCTGGAGGGTACCCTCCTGAAGCCCAACATGGTGACTCCAGGCTCCGACTCCAAGAAGGTGACTCCTGAGGTGATTGCTGAGTACACCGTCCGTACCCTCCAGAGGACCGTCCCTGCTGCTGTGCCTGCTGTTCTCTTCCTCTCTGGTGGACAGAGCGAGGAGGAGGCCACCCGCAACCTCAATGCCATGAACAAGCTCAGCACCAAGAAGCCGTGGTCCCTGTCTTTCTCCTTCGGCCGTGCCCTCCAGGCGAGCACCCTCAAGGCCTGGGCTGGCAAGGTGGAGAACTTGGAGAAGGCTAGAGCTGCCTTCCTCGCCAGGTGCAAGGCCAACTCTGAGGCTACCCTCGGCACCTACAAGGGTGATGCTGCCGCCGACACCGAGAGCCTCCACGTCAAGGACTACAAGTACTGAGTTGCTTCTCTTTGCGTGCCCGTTTTGGAACTCCTGCCTACGAGCTAGGTTGCGGAGTGTGGTTTGCTCGTTAGAGCTTATTTTCGGACATCCAAAAAACATGCTTCCTATGTGGGATGATGGTTATCTTTATATTTGTATGTTAATTAGTCTCTTTGCTGTTAAATTTCGTGTAAGTTGGTCCTGCCGATGGAGAATCGAGCAGCCCCCTTTTTTTGTTCTATCAACTATGCTGTAATGCTGGCTATGTATCGGCAAAAACAATTCTATATGCTGAGTTGGAGTCGGCAAAAATTCAT

SEQ ID NO: 2695 - DNA, 1665 bp, Zea mays
  misc_feature (1)..(1665): Ceres cDNA ID no. 13633473
  misc_feature (1)..(1665): Ceres CLONE  ID no. 221069
  misc_feature (1)..(1665): Also known as  Ceres CDNA ID no. 23873730
attaaccgcctctccctcgctcctctcgctcgctcggctcactccctctccaaagcggcagcctcacgcagtcacgcgctccaccacgccacctccctctactcactcatgttgttttccgtccatccgcccaccggttcgtagcccgcgccgcaaaaccctagccccgggaggatcgcggggcgcctccgcggtgccagcgacgtggctcgtttgatccgattgctggtcgagccccgcccctcgctgccgcgcttcgctccggctgtgcagcggcgtgagcaccgagcacactcgcgaatggggaactgctggggtgcgcggatcaaggatgggagccctcaccctggcgcctcaggaatgttctcaaagagtagtggcaaggatgggagtaggcttagcggctgtagtagtcgagcctcttcagcttctatgccaccaagtgcgaagactgaatgtgaaatcctgcaatccgccaatgttaagatcttcaccttcaataatctcaaggcagccacaaggaatttccgtcctgatagtgttctaggtgaaggagggtttggatctgtctataaaggatggatagatgagaacacattatcaccttgcagacctggcactggaatcgctgttgctgtgaaaagactcaaccatgagggtttgcaagggcaccgagagtggttggcggaagttaattacctaggtcagttctgtcatcccaaccttgtcaagctgattggatactgcttagaggatgagcaccgactgctagtatacgagttcatgccccgtgggaacatggaaaaccatctgtttaggagaggctcatacttccaacctctgtcatggaaccttagaatgaaggttgcactgggagcagcaaaaggactagcttaccttcatagtgcagaggcaaaagttatttaccgagattttaagacttcgaacatcctccttgacacagattattctgcgaagctttctgattttggattggctaaggatggtcctgtcggtgagaagagccatgtgtccacaagagttatgggaacatatggttatgcagctcctgagtatctttcaacaggtcacctaactgcaaagagcgacatctatagctttggggtagtgcttctggagatgctgtcaggccgccgcgccatcgacaagaaccgcccccagggtgagcacaatcttgtggagtgggctcgaccttacctcacacataagcgcaagatattccggatcctggatacgaggctggaaggtcaatacaatctgaacggtgcacaaacaattgctgcccttgctctcgaatgcctatcctacgaagctaagatgaggccgactatggacgctgtggttgctattctagaagagctccagggctctggtgaagccgagaagaagcttcaagaacccaaggccggaaccaaacaggcacctgctgctgtgagtgctagcatgagcagcagccgcaagcctcgccggaaaagtctgggagacacaaaggagactgttggtggtccagatcccaaaccattggcccattctcgttagcaagggaaagcattgcctggtcattgtcgttagttagactgtagctcgcttgtgaatatgctatggtctgtgtatgtatgttcagagggtaatcgggcttttggc

SEQ ID NO: 2696 - protein, 1665 aa, Zea mays
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 8778537; NR Description: F22G5.5 [Arabidopsis thaliana]
  misc_feature: GI Number: 166809; NR Description: protein kinase
  misc_feature: GI Number: 42569425; NR Description: protein kinase (APK1b)
  misc_feature: GI Number: 34906046; NR Description: putative serine/threonine-specific protein kinase [Oryza sativa (japonica cultivar-group)] >gi|15290002|dbj|BAB63697.1| putative serine/threonine-specific protein kinase [Oryza sativa (japonica
  misc_feature: GI Number: 21555255; NR Description: serine/threonine-specific protein kinase NAK [Arabidopsis thaliana] >gi|7406425|emb|CAB85534.1| serine/threonine-specific protein kinase NAK [Arabidopsis thaliana]
ATTAACCGCCTCTCCCTCGCTCCTCTCGCTCGCTCGGCTCACTCCCTCTCCAAAGCGGCAGCCTCACGCAGTCACGCGCTCCACCACGCCACCTCCCTCTACTCACTCATGTTGTTTTCCGTCCATCCGCCCACCGGTTCGTAGCCCGCGCCGCAAAACCCTAGCCCCGGGAGGATCGCGGGGCGCCTCCGCGGTGCCAGCGACGTGGCTCGTTTGATCCGATTGCTGGTCGAGCCCCGCCCCTCGCTGCCGCGCTTCGCTCCGGCTGTGCAGCGGCGTGAGCACCGAGCACACTCGCGAATGGGGAACTGCTGGGGTGCGCGGATCAAGGATGGGAGCCCTCACCCTGGCGCCTCAGGAATGTTCTCAAAGAGTAGTGGCAAGGATGGGAGTAGGCTTAGCGGCTGTAGTAGTCGAGCCTCTTCAGCTTCTATGCCACCAAGTGCGAAGACTGAATGTGAAATCCTGCAATCCGCCAATGTTAAGATCTTCACCTTCAATAATCTCAAGGCAGCCACAAGGAATTTCCGTCCTGATAGTGTTCTAGGTGAAGGAGGGTTTGGATCTGTCTATAAAGGATGGATAGATGAGAACACATTATCACCTTGCAGACCTGGCACTGGAATCGCTGTTGCTGTGAAAAGACTCAACCATGAGGGTTTGCAAGGGCACCGAGAGTGGTTGGCGGAAGTTAATTACCTAGGTCAGTTCTGTCATCCCAACCTTGTCAAGCTGATTGGATACTGCTTAGAGGATGAGCACCGACTGCTAGTATACGAGTTCATGCCCCGTGGGAACATGGAAAACCATCTGTTTAGGAGAGGCTCATACTTCCAACCTCTGTCATGGAACCTTAGAATGAAGGTTGCACTGGGAGCAGCAAAAGGACTAGCTTACCTTCATAGTGCAGAGGCAAAAGTTATTTACCGAGATTTTAAGACTTCGAACATCCTCCTTGACACAGATTATTCTGCGAAGCTTTCTGATTTTGGATTGGCTAAGGATGGTCCTGTCGGTGAGAAGAGCCATGTGTCCACAAGAGTTATGGGAACATATGGTTATGCAGCTCCTGAGTATCTTTCAACAGGTCACCTAACTGCAAAGAGCGACATCTATAGCTTTGGGGTAGTGCTTCTGGAGATGCTGTCAGGCCGCCGCGCCATCGACAAGAACCGCCCCCAGGGTGAGCACAATCTTGTGGAGTGGGCTCGACCTTACCTCACACATAAGCGCAAGATATTCCGGATCCTGGATACGAGGCTGGAAGGTCAATACAATCTGAACGGTGCACAAACAATTGCTGCCCTTGCTCTCGAATGCCTATCCTACGAAGCTAAGATGAGGCCGACTATGGACGCTGTGGTTGCTATTCTAGAAGAGCTCCAGGGCTCTGGTGAAGCCGAGAAGAAGCTTCAAGAACCCAAGGCCGGAACCAAACAGGCACCTGCTGCTGTGAGTGCTAGCATGAGCAGCAGCCGCAAGCCTCGCCGGAAAAGTCTGGGAGACACAAAGGAGACTGTTGGTGGTCCAGATCCCAAACCATTGGCCCATTCTCGTTAGCAAGGGAAAGCATTGCCTGGTCATTGTCGTTAGTTAGACTGTAGCTCGCTTGTGAATATGCTATGGTCTGTGTATGTATGTTCAGAGGGTAATCGGGCTTTTGGC

SEQ ID NO: 2697 - DNA, 1396 bp, Zea mays
  misc_feature (1)..(1396): Ceres cDNA ID no. 13636262
  misc_feature (1)..(1396): Ceres CLONE  ID no. 331385
  misc_feature (1)..(1396): Also known as  Ceres CDNA ID no. 23849767
caattaaccctcactaaagggaacaaaagctggagctccaccgcggtggcggccgctctagaactagtggatcccccgggctgcaggaattcgcacgagaccattacctagaacatcctaatcgaaaaaagttccatatccaacacacacagcaacgctcgctcggcactgtcactagctagttgctctactagagggcgggtatagagctgcctgcaatccgccgctgagaagggaggatcggaagcgacgatgaggtcgtttgctcctgtctttctgtcggcggtcgtggcctggctggagctggcgggcaccgcgcagggcggcaacttctaccaggacacagagatgacctggggcgatggccgcggcaaggtagtggacggcgggcgcgggctggacctgacgctggaccgcacgtccggctccgggttccagtccaagagcgagtacctgttcggcaagatcgacatgcagatcaagctggtgccaggcaactccgctggcacggtcaccaccttctacctgtcgtccccagggcgacgcgcacgacgagatcgacttcgagttcctgggcaacgtgagcggggagccctacacgctgcacaccaacgtgttcacgcgcggacagggccagcgggagcagcagttccgcctctggttcgaccctaccactgccttccacacctactccatcctgtggaacccgcagcacgtgatcttcgcggtggacggcaccccggtgcgggacttcaagaaccacgaggcgcgcggggtggcgttcccgaggatgcagcccatgaggctgtacgccagcctgtggaacgccgacgactgggccacgcagggcgggcgcgtcaaggcggactggtccaaggcccccttcgtcgcctccttccgcggtttcagcgccgacgcctgcgtctgggacggcggcaggcagcgctgccctgagggcaccatggaggccgccgccgtcgcgggtgccggctccggccgcggctggtggaaccagcagctcagcgacatgagctaccgccgcatgcgctgggtgcagcgcaagttcatgatctacaactactgcgccgacgccaagcgcttcccgcagggcgtgcccgccgagtgcaagctccggtgagggagcgaggtttgttgggacgtccgtggggcatcaaaaccaagcacgatccctagtcgtggaaagtagaaaccaggcatcgattcgatcgtcgtcgacggtcttagtagtagctacttatttcgcagtgggcgatgaaagaatggtgtcatgtaaatgtagctctagtcgtgtcgcattctttgatttgttgtttcagcagcaccggatgtacaagtattgagtttgggctagcaagaataagtaatctttttcggc

SEQ ID NO: 2698 - protein, 1396 aa, Zea mays
  misc_feature: PFam Name: Glyco_hydro_16; PFam Description: Glycosyl
  misc_feature: PFam Name: XET_C; PFam Description: Xyloglucan
  misc_feature: PFam Name: MAGE; PFam Description: MAGE family
  misc_feature: PFam Name: Podocalyxin; PFam Description: Podocalyxin
  misc_feature: GI Number: 51039064; NR Description:
  misc_feature: GI Number: 53793221; NR Description: putative xyloglucan endotransglycosylase [Oryza sativa (japonica cultivar-group)] >gi|53791844|dbj|BAD53910.1| putative xyloglucan
  misc_feature: GI Number: 1890577; NR Description: xyloglucan endotransglycosylase (XET) [Hordeum vulgare subsp. vulgare] >gi|7447413|pir||T06202 xyloglucan endo-1,4-beta-D-glucanase (EC
  misc_feature: GI Number: 14330332; NR Description: Xet1 protein
  misc_feature: GI Number: 53793227; NR Description: putative xyloglucan
CAATTAACCCTCACTAAAGGGAACAAAAGCTGGAGCTCCACCGCGGTGGCGGCCGCTCTAGAACTAGTGGATCCCCCGGGCTGCAGGAATTCGCACGAGACCATTACCTAGAACATCCTAATCGAAAAAAGTTCCATATCCAACACACACAGCAACGCTCGCTCGGCACTGTCACTAGCTAGTTGCTCTACTAGAGGGCGGGTATAGAGCTGCCTGCAATCCGCCGCTGAGAAGGGAGGATCGGAAGCGACGATGAGGTCGTTTGCTCCTGTCTTTCTGTCGGCGGTCGTGGCCTGGCTGGAGCTGGCGGGCACCGCGCAGGGCGGCAACTTCTACCAGGACACAGAGATGACCTGGGGCGATGGCCGCGGCAAGGTAGTGGACGGCGGGCGCGGGCTGGACCTGACGCTGGACCGCACGTCCGGCTCCGGGTTCCAGTCCAAGAGCGAGTACCTGTTCGGCAAGATCGACATGCAGATCAAGCTGGTGCCAGGCAACTCCGCTGGCACGGTCACCACCTTCTACCTGTCGTCCCCAGGGCGACGCGCACGACGAGATCGACTTCGAGTTCCTGGGCAACGTGAGCGGGGAGCCCTACACGCTGCACACCAACGTGTTCACGCGCGGACAGGGCCAGCGGGAGCAGCAGTTCCGCCTCTGGTTCGACCCTACCACTGCCTTCCACACCTACTCCATCCTGTGGAACCCGCAGCACGTGATCTTCGCGGTGGACGGCACCCCGGTGCGGGACTTCAAGAACCACGAGGCGCGCGGGGTGGCGTTCCCGAGGATGCAGCCCATGAGGCTGTACGCCAGCCTGTGGAACGCCGACGACTGGGCCACGCAGGGCGGGCGCGTCAAGGCGGACTGGTCCAAGGCCCCCTTCGTCGCCTCCTTCCGCGGTTTCAGCGCCGACGCCTGCGTCTGGGACGGCGGCAGGCAGCGCTGCCCTGAGGGCACCATGGAGGCCGCCGCCGTCGCGGGTGCCGGCTCCGGCCGCGGCTGGTGGAACCAGCAGCTCAGCGACATGAGCTACCGCCGCATGCGCTGGGTGCAGCGCAAGTTCATGATCTACAACTACTGCGCCGACGCCAAGCGCTTCCCGCAGGGCGTGCCCGCCGAGTGCAAGCTCCGGTGAGGGAGCGAGGTTTGTTGGGACGTCCGTGGGGCATCAAAACCAAGCACGATCCCTAGTCGTGGAAAGTAGAAACCAGGCATCGATTCGATCGTCGTCGACGGTCTTAGTAGTAGCTACTTATTTCGCAGTGGGCGATGAAAGAATGGTGTCATGTAAATGTAGCTCTAGTCGTGTCGCATTCTTTGATTTGTTGTTTCAGCAGCACCGGATGTACAAGTATTGAGTTTGGGCTAGCAAGAATAAGTAATCTTTTTCGGC

SEQ ID NO: 2699 - DNA, 1747 bp, Zea mays
  misc_feature (1)..(1747): Ceres cDNA ID no. 13637284
  misc_feature (1)..(1747): Ceres CLONE  ID no. 236717
  misc_feature (1)..(1747): Also known as  Ceres CDNA ID no. 23855611
ggattgggctttcccctccgcctccctcccctcacaaaaaggcggcagcacagcgccacccctcctgtcccgccgagttcggagcgcagcgcaaggcggggggaggagcaagaagccgccggcctccctcctccggctcaccaccaggcttactccgcaccgcgctgccacgggtaggagcggcgtcaaattcgggattcccaagcggcttcagcccggaggttgagccaaagctattttctaagaaaaatggcggcaatgatggtggcgatgactgcgaggagcaagaacagcatattaaccgtggagaagaagcagggctggtctattcagctaccagagctccggttcccttgggattcacatgaagacaagggtttctctctaagtctgcaaggctctggaccttctcatggcggcctgtttgctagtgtgggtcttaaagtgtcgacaggtgcgccagcagtggcgcccggaccggggtgacaaggatattaagattccattcactgatcattgtatgaagtacgtgtccgaggcagttgggtaccaggttattagcactgaagctgagccagtggaggaggtggtggatgctaaggcaaagaaggcagccaagaaacgtgggctgcagctgaaaattaagattgggaacccacatttgaggaggctggttagtggagctattgcaggtgctgtttccaggacttgtgtggcaccactggagacgatcaggactcacttgatggttgggagcaacggtgactccatgacagaggtgttccagtcaatcatgaacactgaggggtggactgggcttttccgtgggaattttgtcaatgttatccgagttgcgccaagcaaagcaattgagctttttgcttttgatactgccaagaaattcttgactccaaaggctgatgagtctccaaagaccttcctacctccatcacttattgctggagcacttgcaggagtcagctcaaccctgtgcacatatcctttggagttgattaagaccagattgacgatagagaaagatgtctataacaacttcctccatgctttcgtcaagattttacgagaagaaggtccatcagagctctaccgtggtctgacaccaagtctgataggagtggtgccatatgccgcgactaattactacgcctatgacaccctaaagaagctctataggaagacgttcaagcaggaggagatcagcaacatcgcaactctcctaattggttcagccgctggcgccatctccagcactgccacattccctctcgaggtggcccgcaagcaaatgcaggtaggagcagtaggagggaggcaggtctacaagaatgtgttccatgcgctctactgcataatggagaaggaaggggttggcggcctgtacaaggggctcggaccgagctgcatcaagttgatgcctgcagcaggcatctcgttcatgtgctacgaggcctgtaagaagatcctggtcgaagacaatgaggatagtgagtgaagctgaagcatgtatgcccctgaggaggggtatgactgatgtgccaggctagaagaggtttgggttgggttgggttggggagtataccctagtattatcaactgatgaaaatgtagatccaagatatttgaacgccctttagatcataatttggttcagttttgtgctgaaatccataaacaatacactcacttgatggtgcatgttgcaaaggggcaattttgtcatgtggcc

SEQ ID NO: 2700 - protein, 1747 aa, Zea mays
  misc_feature: PFam Name: Mito_carr; PFam Description: Mitochondrial
  misc_feature: GI Number: 52353768; NR Description: putative adenylate translocator (Brittle-1) protein [Oryza sativa (japonica
  misc_feature: GI Number: 51090886; NR Description: putative mitochondrial
  misc_feature: GI Number: 4138581; NR Description: mitochondrial energy
  misc_feature: GI Number: 47156872; NR Description: plastidial ADP-glucose
  misc_feature: GI Number: 231654; NR Description: Brittle-1 protein, chloroplast precursor >gi|82676|pir||JQ1459 Bt1 protein precursor -
GGATTGGGCTTTCCCCTCCGCCTCCCTCCCCTCACAAAAAGGCGGCAGCACAGCGCCACCCCTCCTGTCCCGCCGAGTTCGGAGCGCAGCGCAAGGCGGGGGGAGGAGCAAGAAGCCGCCGGCCTCCCTCCTCCGGCTCACCACCAGGCTTACTCCGCACCGCGCTGCCACGGGTAGGAGCGGCGTCAAATTCGGGATTCCCAAGCGGCTTCAGCCCGGAGGTTGAGCCAAAGCTATTTTCTAAGAAAAATGGCGGCAATGATGGTGGCGATGACTGCGAGGAGCAAGAACAGCATATTAACCGTGGAGAAGAAGCAGGGCTGGTCTATTCAGCTACCAGAGCTCCGGTTCCCTTGGGATTCACATGAAGACAAGGGTTTCTCTCTAAGTCTGCAAGGCTCTGGACCTTCTCATGGCGGCCTGTTTGCTAGTGTGGGTCTTAAAGTGTCGACAGGTGCGCCAGCAGTGGCGCCCGGACCGGGGTGACAAGGATATTAAGATTCCATTCACTGATCATTGTATGAAGTACGTGTCCGAGGCAGTTGGGTACCAGGTTATTAGCACTGAAGCTGAGCCAGTGGAGGAGGTGGTGGATGCTAAGGCAAAGAAGGCAGCCAAGAAACGTGGGCTGCAGCTGAAAATTAAGATTGGGAACCCACATTTGAGGAGGCTGGTTAGTGGAGCTATTGCAGGTGCTGTTTCCAGGACTTGTGTGGCACCACTGGAGACGATCAGGACTCACTTGATGGTTGGGAGCAACGGTGACTCCATGACAGAGGTGTTCCAGTCAATCATGAACACTGAGGGGTGGACTGGGCTTTTCCGTGGGAATTTTGTCAATGTTATCCGAGTTGCGCCAAGCAAAGCAATTGAGCTTTTTGCTTTTGATACTGCCAAGAAATTCTTGACTCCAAAGGCTGATGAGTCTCCAAAGACCTTCCTACCTCCATCACTTATTGCTGGAGCACTTGCAGGAGTCAGCTCAACCCTGTGCACATATCCTTTGGAGTTGATTAAGACCAGATTGACGATAGAGAAAGATGTCTATAACAACTTCCTCCATGCTTTCGTCAAGATTTTACGAGAAGAAGGTCCATCAGAGCTCTACCGTGGTCTGACACCAAGTCTGATAGGAGTGGTGCCATATGCCGCGACTAATTACTACGCCTATGACACCCTAAAGAAGCTCTATAGGAAGACGTTCAAGCAGGAGGAGATCAGCAACATCGCAACTCTCCTAATTGGTTCAGCCGCTGGCGCCATCTCCAGCACTGCCACATTCCCTCTCGAGGTGGCCCGCAAGCAAATGCAGGTAGGAGCAGTAGGAGGGAGGCAGGTCTACAAGAATGTGTTCCATGCGCTCTACTGCATAATGGAGAAGGAAGGGGTTGGCGGCCTGTACAAGGGGCTCGGACCGAGCTGCATCAAGTTGATGCCTGCAGCAGGCATCTCGTTCATGTGCTACGAGGCCTGTAAGAAGATCCTGGTCGAAGACAATGAGGATAGTGAGTGAAGCTGAAGCATGTATGCCCCTGAGGAGGGGTATGACTGATGTGCCAGGCTAGAAGAGGTTTGGGTTGGGTTGGGTTGGGGAGTATACCCTAGTATTATCAACTGATGAAAATGTAGATCCAAGATATTTGAACGCCCTTTAGATCATAATTTGGTTCAGTTTTGTGCTGAAATCCATAAACAATACACTCACTTGATGGTGCATGTTGCAAAGGGGCAATTTTGTCATGTGGCC

SEQ ID NO: 2701 - DNA, 1948 bp, Arabidopsis thaliana
  misc_feature (1)..(1948): Ceres cDNA ID no. 13645793
  misc_feature (1)..(1948): Ceres CLONE  ID no. 125669
  misc_feature (1)..(1948): Also known as  Ceres CDNA ID no. 23648388
ttggaggtaacgattgagaagaatctctcttttctccactgagagaatcacattctgagagatcagacaagaagaaacaatggtggaaggaggaattgcgaaagcagacaaaacagagttcacagagtgttggagaacaacatggaagacaccttacatcatgcgacttgctctctccgccggaatcggaggtcttctcttcggttacgataccggagtcatttccggagctcttcttttcatcaaagaagattttgatgaagttgataagaaaacatggcttcagtcaactattgttagtatggcagtggctggagccatcgtcggagcagcagtcggaggttggatcaatgataagtttggtaggaggatgtcgattcttatcgccgatgttcttttcttgatcggtgcgattgtgatggcatttgctccggctccttgggttatcatcgttggaagaatctttgttgggtttggtgttggtatggcttcgatgacgtctccgttgtatatctctgaagcttctccggcgaggattagaggtgcacttgttagtaccaatggtcttctcatcactggtggacaattcttctcgtacctcatcaatcttgcttttgtccatactccgggaacatggagatggatgttgggtgttgcgggagttccagctattgttcagtttgtgcttatgttgtcgctacctgagtctccaaggtggttatatagaaaggacaggattgcggaatccagagcgattcttgagaggatttacccggctgacgaagtggaggcggagatggaagctttgaaactgtcagtggaggcagagaaagcagacgaggcaatcattggagatagcttctctgcaaagctgaaaggagctttcgggaatcccgttgttcgacgtggactcgctgctggtatcacggtgcaagtggctcagcagtttgtggggatcaacactgtcatgtactacagtccttctattgtgcaatttgctggttacgcctctaacaagacagctatggccttgtctcttattacttccggtttgaatgctttgggttctattgtgagcatgatgtttgtcgatcggtacgggagaaggaagctcatgatcatctctatgtttgggatcatagcatgtcttatcatcttagccacggtgttctcacaagcggccatccacgcccccaagatcgatgcgtttgagtcaaggacgtttgcaccaaatgctacttgttcagcatatgcccctctcgcagccgaaaatgctcctccctcgaggtggaactgcatgaagtgtctcaggtccgaatgtggattctgcgccagcggggtacagccgtacgcaccaggagcatgtgtggtgttgtcagatgacatgaaagcaacttgcagctcaagaggaagaacattcttcaaagatggatgtccaagcaagtttgggttcttagctatagtgtttttggggctttacatcgtagtctacgcaccaggtatgggcactgtcccgtggatcgtcaactctgagatctatccgctcagatacagaggtcttggtggaggaatagccgccgtctcgaattgggtctccaacctgatagtgagtgagagcttcctctcactcacccatgctctcggctcctctggtaccttccttctctttgctggcttctccacgatcgggctcttcttcatttggttgctcgttcctgagaccaaagggcttcagtttgaggaggtcgagaagttgctcgaggtcggcttcaagcccagtctcttgcggcggagggagaagaagggcaaagaagtcgatgctgcttaagacgatgatgatcacttatctctctctttctatttttattattgtcgctgtctgttcctaattctataatgtatgacaccggatttggaatacgtatttttcaacaccttttaaaacctc

SEQ ID NO: 2702 - protein, 1948 aa, Arabidopsis thaliana
  misc_feature: PFam Name: Sugar_tr; PFam Description: Sugar (and other)
  misc_feature: PFam Name: MFS_1; PFam Description: Major Facilitator Superfamily
  misc_feature: GI Number: 9652184; NR Description: putative Na+/myo-inositol
  misc_feature: GI Number: 9652186; NR Description: putative Na+/myo-inositol
  misc_feature: GI Number: 28973605; NR Description: putative membrane transporter [Arabidopsis thaliana] >gi|7268398|emb|CAB78690.1| membrane transporter like protein [Arabidopsis thaliana] >gi|2245004|emb|CAB10424.1| membrane transporter like protein
  misc_feature: GI Number: 50934251; NR Description: putative proton myo-inositol transporter [Oryza sativa (japonica cultivar-group)] >gi|33146705|dbj|BAC79509.1| putative proton myo-inositol transporter [Oryza sativa (japonica cultivar-group)]
  misc_feature: GI Number: 4263781; NR Description: putative sugar transporter [Arabidopsis thaliana] >gi|15227479|ref|NP_181117.1| sugar transporter family protein [Arabidopsis thaliana] >gi|25309025|pir||D84772 probable sugar transporter [imported] -
TTGGAGGTAACGATTGAGAAGAATCTCTCTTTTCTCCACTGAGAGAATCACATTCTGAGAGATCAGACAAGAAGAAACAATGGTGGAAGGAGGAATTGCGAAAGCAGACAAAACAGAGTTCACAGAGTGTTGGAGAACAACATGGAAGACACCTTACATCATGCGACTTGCTCTCTCCGCCGGAATCGGAGGTCTTCTCTTCGGTTACGATACCGGAGTCATTTCCGGAGCTCTTCTTTTCATCAAAGAAGATTTTGATGAAGTTGATAAGAAAACATGGCTTCAGTCAACTATTGTTAGTATGGCAGTGGCTGGAGCCATCGTCGGAGCAGCAGTCGGAGGTTGGATCAATGATAAGTTTGGTAGGAGGATGTCGATTCTTATCGCCGATGTTCTTTTCTTGATCGGTGCGATTGTGATGGCATTTGCTCCGGCTCCTTGGGTTATCATCGTTGGAAGAATCTTTGTTGGGTTTGGTGTTGGTATGGCTTCGATGACGTCTCCGTTGTATATCTCTGAAGCTTCTCCGGCGAGGATTAGAGGTGCACTTGTTAGTACCAATGGTCTTCTCATCACTGGTGGACAATTCTTCTCGTACCTCATCAATCTTGCTTTTGTCCATACTCCGGGAACATGGAGATGGATGTTGGGTGTTGCGGGAGTTCCAGCTATTGTTCAGTTTGTGCTTATGTTGTCGCTACCTGAGTCTCCAAGGTGGTTATATAGAAAGGACAGGATTGCGGAATCCAGAGCGATTCTTGAGAGGATTTACCCGGCTGACGAAGTGGAGGCGGAGATGGAAGCTTTGAAACTGTCAGTGGAGGCAGAGAAAGCAGACGAGGCAATCATTGGAGATAGCTTCTCTGCAAAGCTGAAAGGAGCTTTCGGGAATCCCGTTGTTCGACGTGGACTCGCTGCTGGTATCACGGTGCAAGTGGCTCAGCAGTTTGTGGGGATCAACACTGTCATGTACTACAGTCCTTCTATTGTGCAATTTGCTGGTTACGCCTCTAACAAGACAGCTATGGCCTTGTCTCTTATTACTTCCGGTTTGAATGCTTTGGGTTCTATTGTGAGCATGATGTTTGTCGATCGGTACGGGAGAAGGAAGCTCATGATCATCTCTATGTTTGGGATCATAGCATGTCTTATCATCTTAGCCACGGTGTTCTCACAAGCGGCCATCCACGCCCCCAAGATCGATGCGTTTGAGTCAAGGACGTTTGCACCAAATGCTACTTGTTCAGCATATGCCCCTCTCGCAGCCGAAAATGCTCCTCCCTCGAGGTGGAACTGCATGAAGTGTCTCAGGTCCGAATGTGGATTCTGCGCCAGCGGGGTACAGCCGTACGCACCAGGAGCATGTGTGGTGTTGTCAGATGACATGAAAGCAACTTGCAGCTCAAGAGGAAGAACATTCTTCAAAGATGGATGTCCAAGCAAGTTTGGGTTCTTAGCTATAGTGTTTTTGGGGCTTTACATCGTAGTCTACGCACCAGGTATGGGCACTGTCCCGTGGATCGTCAACTCTGAGATCTATCCGCTCAGATACAGAGGTCTTGGTGGAGGAATAGCCGCCGTCTCGAATTGGGTCTCCAACCTGATAGTGAGTGAGAGCTTCCTCTCACTCACCCATGCTCTCGGCTCCTCTGGTACCTTCCTTCTCTTTGCTGGCTTCTCCACGATCGGGCTCTTCTTCATTTGGTTGCTCGTTCCTGAGACCAAAGGGCTTCAGTTTGAGGAGGTCGAGAAGTTGCTCGAGGTCGGCTTCAAGCCCAGTCTCTTGCGGCGGAGGGAGAAGAAGGGCAAAGAAGTCGATGCTGCTTAAGACGATGATGATCACTTATCTCTCTCTTTCTATTTTTATTATTGTCGCTGTCTGTTCCTAATTCTATAATGTATGACACCGGATTTGGAATACGTATTTTTCAACACCTTTTAAAACCTC

SEQ ID NO: 2703 - DNA, 1633 bp, Arabidopsis thaliana
  misc_feature (1)..(1633): Ceres cDNA ID no. 13645815
  misc_feature (1)..(1633): Ceres CLONE  ID no. 124281
  misc_feature (1)..(1633): Also known as  Ceres CDNA ID no. 23557445
ttttttcacactttttctgtctgttacgattcttgcttgatttctttctaaacaaagcaaaagttgtctttttggagttgtgagcaactaattctctgaaattgaggaagagaaagcgagaaggtttttttggagtcagagacagaagaagaatttaacagattcttgtcggaaacatggatacgagtgaagcaaggaaccgtaaagttgttgcagttgaacaattcgatctcgaagtccctgagactgctcatcagattagcagcgattcatggtttcaggtagcttttgttctaacgaccggtataaacagtgcctatgtgttgggatattccgggacagtcatggttcctttgggttggattggtggtgtggttggtctcattcttgctaccgcaatctctctttacgcaaacactcttatcgccaaacttcatgagtttggtggcaaaagacacattcgttatagagatcttgcaggcttcatctatggtaaaaagatgtatcgtgttacatggggattgcaatatgtcaatcttttcatgattaattgtggcttcatcatacttgctggttcggccttaaaggctgtttatgtactttttagagatgatagtctcatgaaactgcctcacttcatcgccatcgcgggtgttgtatgcgcgattttcgcaatcggtattcctcatttatcagctcttggaatctggctaggagtttcaacaatcctcagcataatctacattattgttgcaatagttctatcagctaaagatggagtaaacaagcctgaaagagattacaacatacaaggatcatcaataaacaaactctttaccataacaggagcagctgcaaatctagttttcgcattcaacacgggaatgctcccggaaatacaggcgacggtgaagcaaccggtcgttaaaaacatgatgaaggctctgtattttcaattcactgttggtgttttacctatgtacgcggttacattcatcggatattgggcttacgggtcctcgacatcgacttatctcttaaacagcgtcagtggacctgtttgggtcaaagcactcgctaacatttcagcttttctccaatctgttatctctttacatatttttgcaagtccgacttatgagtatatggacacaaagtatggagtcaaaggaagtccattggcaatgaagaatctgttgtttagaacagtagcaagaggaagctacattgcggtgagcactcttctctctgcgcttttaccgtttctcggagatttcatgagccttaccggagcgataagcacgttccctctcacattcatattagcgaatcacatgtatcttgttgctatgaatgatgagcttagtcttgtgcaaaagctatggcattggctcaatgtttgcttctttggattaatgtctcttgctgctgctattgctgctgttagactcatctctgttgactccaagaacttccatgtttttgctgatgtttgattaaaatgtcttcgacatttttaacgatgtaatctttataccaattagaaaaaattgtaatccttttgttgttacttttattatttcaaatgaaagaaattttttataacataatatatatatttatttttcggttc

SEQ ID NO: 2704 - protein, 1633 aa, Arabidopsis thaliana
  misc_feature: PFam Name: Aa_trans; PFam Description: Transmembrane amino
  misc_feature: GI Number: 31376371; NR Description: At3g55740 [Arabidopsis thaliana] >gi|7263562|emb|CAB81599.1| proline transporter 2 [Arabidopsis thaliana] >gi|1769903|emb|CAA65053.1| proline transporter 2 [Arabidopsis thaliana] >gi|19698891|gb|AAL91181.1|
  misc_feature: GI Number: 21069018; NR Description: betaine/proline
  misc_feature: GI Number: 21069020; NR Description: betaine/proline
  misc_feature: GI Number: 21593453; NR Description: proline transporter 1
  misc_feature: GI Number: 42572697; NR Description: proline transporter 2
TTTTTTCACACTTTTTCTGTCTGTTACGATTCTTGCTTGATTTCTTTCTAAACAAAGCAAAAGTTGTCTTTTTGGAGTTGTGAGCAACTAATTCTCTGAAATTGAGGAAGAGAAAGCGAGAAGGTTTTTTTGGAGTCAGAGACAGAAGAAGAATTTAACAGATTCTTGTCGGAAACATGGATACGAGTGAAGCAAGGAACCGTAAAGTTGTTGCAGTTGAACAATTCGATCTCGAAGTCCCTGAGACTGCTCATCAGATTAGCAGCGATTCATGGTTTCAGGTAGCTTTTGTTCTAACGACCGGTATAAACAGTGCCTATGTGTTGGGATATTCCGGGACAGTCATGGTTCCTTTGGGTTGGATTGGTGGTGTGGTTGGTCTCATTCTTGCTACCGCAATCTCTCTTTACGCAAACACTCTTATCGCCAAACTTCATGAGTTTGGTGGCAAAAGACACATTCGTTATAGAGATCTTGCAGGCTTCATCTATGGTAAAAAGATGTATCGTGTTACATGGGGATTGCAATATGTCAATCTTTTCATGATTAATTGTGGCTTCATCATACTTGCTGGTTCGGCCTTAAAGGCTGTTTATGTACTTTTTAGAGATGATAGTCTCATGAAACTGCCTCACTTCATCGCCATCGCGGGTGTTGTATGCGCGATTTTCGCAATCGGTATTCCTCATTTATCAGCTCTTGGAATCTGGCTAGGAGTTTCAACAATCCTCAGCATAATCTACATTATTGTTGCAATAGTTCTATCAGCTAAAGATGGAGTAAACAAGCCTGAAAGAGATTACAACATACAAGGATCATCAATAAACAAACTCTTTACCATAACAGGAGCAGCTGCAAATCTAGTTTTCGCATTCAACACGGGAATGCTCCCGGAAATACAGGCGACGGTGAAGCAACCGGTCGTTAAAAACATGATGAAGGCTCTGTATTTTCAATTCACTGTTGGTGTTTTACCTATGTACGCGGTTACATTCATCGGATATTGGGCTTACGGGTCCTCGACATCGACTTATCTCTTAAACAGCGTCAGTGGACCTGTTTGGGTCAAAGCACTCGCTAACATTTCAGCTTTTCTCCAATCTGTTATCTCTTTACATATTTTTGCAAGTCCGACTTATGAGTATATGGACACAAAGTATGGAGTCAAAGGAAGTCCATTGGCAATGAAGAATCTGTTGTTTAGAACAGTAGCAAGAGGAAGCTACATTGCGGTGAGCACTCTTCTCTCTGCGCTTTTACCGTTTCTCGGAGATTTCATGAGCCTTACCGGAGCGATAAGCACGTTCCCTCTCACATTCATATTAGCGAATCACATGTATCTTGTTGCTATGAATGATGAGCTTAGTCTTGTGCAAAAGCTATGGCATTGGCTCAATGTTTGCTTCTTTGGATTAATGTCTCTTGCTGCTGCTATTGCTGCTGTTAGACTCATCTCTGTTGACTCCAAGAACTTCCATGTTTTTGCTGATGTTTGATTAAAATGTCTTCGACATTTTTAACGATGTAATCTTTATACCAATTAGAAAAAATTGTAATCCTTTTGTTGTTACTTTTATTATTTCAAATGAAAGAAATTTTTTATAACATAATATATATATTTATTTTTCGGTTC

SEQ ID NO: 2705 - DNA, 1166 bp, Arabidopsis thaliana
  misc_feature (1)..(1166): Ceres cDNA ID no. 13645869
  misc_feature (1)..(1166): Ceres CLONE  ID no. 112866
  misc_feature (1)..(1166): Also known as  Ceres CDNA ID no. 23646945
acagattcgccgcagctagagagaaaacgaaactaaccggagcatgaagagacgaagatcggcgaagaaatctccggcgatggtgacggttaccgattggaaagggttagattgcggcgaagagacgagaatcgtaaggagattgatgaagttcgaagacttgcctgagtatttgaaggacaacgagtttatacacaaccattatcgatgtcaatggtctctcaaagatacttttctcagtgctttctcttggcacaacgagactctcaacatttggacgcatttaattggatttggtatatttctgtggatgacggtggtgagttgcttggagacgacggagattagtctcgccggcgtttttaacggcatggccggagtgaggatttgcctctcaagcaatcagactctgcttcatgattcgaacgtgacacatcacatctcatgtcttacctcacaaggagaagctattccaaaatggccgtggctcgtgtacttagtcggagcaatgggttgtttaatctgcagctctgtttcacacctccttgcttgtcactcaaaacgtttcaacgtcttcttctggcgtttggactacgcaggaatatcacttatgatcgtcgcttctttctttgcaccaatctactacgcattctcctgccaccctaacttccgtttactctacttatcctcgatctcgatcctcggtctcctcgctatcatcactctcctctctcccgctctctctacgccgcgttttagacctttcagagctaatcttttccttgcaatgggatcatctgctgtgatacctgctacacatgtgctttgcctttactgggatcaccctaatgtcttcatcgccctcggttacgagattgccacggctttgtcgtattttgtgggagcaacgttttatgtcagccgtgtgcctgagagatggaagcctggagcgtttgatatggcgggacatagccatcagattttccatgtgtttgtagttatgggtgctcttgctcattgtgttaccactcttctcatcattgatttttcacgggcttccccttcttgtgggttttagcaagaagatattgtttagtaagcttctgtgatcttgcgtttcgatgtatgtgatcttgatttgctttggacaatccatggctatttcc

SEQ ID NO: 2706 - protein, 1166 aa, Arabidopsis thaliana
  misc_feature: PFam Name: HlyIII; PFam Description: Haemolysin-III related
  misc_feature: GI Number: 51535508; NR Description: putative adiponectin receptor 1 [Oryza sativa (japonica cultivar-group)] >gi|51535474|dbj|BAD37371.1| putative adiponectin receptor 1 [Oryza
  misc_feature: GI Number: 25396071; NR Description: protein C43G2.1
  misc_feature: GI Number: 31209635; NR Description: ENSANGP00000012224 [Anopheles gambiae] >gi|30176836|gb|EAA09141.2| ENSANGP00000012224
  misc_feature: GI Number: 56753559; NR Description: unknown [Schistosoma
  misc_feature: GI Number: 27696972; NR Description: Adipor1-prov protein
ACAGATTCGCCGCAGCTAGAGAGAAAACGAAACTAACCGGAGCATGAAGAGACGAAGATCGGCGAAGAAATCTCCGGCGATGGTGACGGTTACCGATTGGAAAGGGTTAGATTGCGGCGAAGAGACGAGAATCGTAAGGAGATTGATGAAGTTCGAAGACTTGCCTGAGTATTTGAAGGACAACGAGTTTATACACAACCATTATCGATGTCAATGGTCTCTCAAAGATACTTTTCTCAGTGCTTTCTCTTGGCACAACGAGACTCTCAACATTTGGACGCATTTAATTGGATTTGGTATATTTCTGTGGATGACGGTGGTGAGTTGCTTGGAGACGACGGAGATTAGTCTCGCCGGCGTTTTTAACGGCATGGCCGGAGTGAGGATTTGCCTCTCAAGCAATCAGACTCTGCTTCATGATTCGAACGTGACACATCACATCTCATGTCTTACCTCACAAGGAGAAGCTATTCCAAAATGGCCGTGGCTCGTGTACTTAGTCGGAGCAATGGGTTGTTTAATCTGCAGCTCTGTTTCACACCTCCTTGCTTGTCACTCAAAACGTTTCAACGTCTTCTTCTGGCGTTTGGACTACGCAGGAATATCACTTATGATCGTCGCTTCTTTCTTTGCACCAATCTACTACGCATTCTCCTGCCACCCTAACTTCCGTTTACTCTACTTATCCTCGATCTCGATCCTCGGTCTCCTCGCTATCATCACTCTCCTCTCTCCCGCTCTCTCTACGCCGCGTTTTAGACCTTTCAGAGCTAATCTTTTCCTTGCAATGGGATCATCTGCTGTGATACCTGCTACACATGTGCTTTGCCTTTACTGGGATCACCCTAATGTCTTCATCGCCCTCGGTTACGAGATTGCCACGGCTTTGTCGTATTTTGTGGGAGCAACGTTTTATGTCAGCCGTGTGCCTGAGAGATGGAAGCCTGGAGCGTTTGATATGGCGGGACATAGCCATCAGATTTTCCATGTGTTTGTAGTTATGGGTGCTCTTGCTCATTGTGTTACCACTCTTCTCATCATTGATTTTTCACGGGCTTCCCCTTCTTGTGGGTTTTAGCAAGAAGATATTGTTTAGTAAGCTTCTGTGATCTTGCGTTTCGATGTATGTGATCTTGATTTGCTTTGGACAATCCATGGCTATTTCC

SEQ ID NO: 2707 - DNA, 1324 bp, Arabidopsis thaliana
  misc_feature (1)..(1324): Ceres cDNA ID no. 13645934
  misc_feature (1)..(1324): Ceres CLONE  ID no. 21688
  misc_feature (1)..(1324): Also known as  Ceres CDNA ID no. 23486843
cattattcacttaagtatatagtagcttccataagagtcttagttctaactataaatacacatatctcactctctctgatctccgcttctcttcgccaacaaatgtcgaccgctcctctctccggcttctttctcacttcactttctccttctcaatcttctctccagaaactctctcttcgtacttcttccaccgtcgcttgcctcccacccgcctcttcttcttcctcatcttcctcctcctcgtcttcccgttccgttccaacgcttatccgtaacgagccagtttttgccgctcctgctcctatcattgccccttattggagtgaagagatgggaaccgaagcatacgacgaggctattgaagctctcaagaagcttctcatcgagaaggaagagctaaagacggttgcagcggcaaaggtggagcagatcacagcggctcttcagacaggtacttcatccgacaagaaagctttcgaccccgtcgaaaccattaagcagggcttcatcaaattcaagaaggagaaatacgaaaccaaccctgctttgtacggtgagctcgcaaagggtcaaagtcctaagtacatggtgtttgcttgttcagactcacgtgtgtgtccatcacacgttctggactttcagccaggagatgccttcgtggtccgtaacatagccaacatggttcctcctttcgacaaggtcaaatacggtggcgttggagcagccattgaatacgcggtcttgcaccttaaggtggagaacattgtggtgataggacacagtgcatgtggtgggatcaaagggcttatgtctttccccttagatggaaacaactccactgactttatagaggactgggtcaaaatctgtttaccagccaagtcaaaggttatatcagaacttggagattcagcctttgaagatcaatgtggccgatgtgaaagggaggcagtgaatgtttcactagcaaacctattgacatatccatttgtgagagaaggacttgtgaagggaacacttgctttgaagggaggctactatgacttcgtcaagggtgcttttgagctttggggacttgaatttggcctctccgaaactagctctgtatgaaccaatccatcatcatcatcatcatcatgaccatccatcatcatcatcattattatcatcgtatataatatatatctaccccatatgtaatttgtaatgtgcctttgactgtgatgagttatctctccctctctaccaactttcttcatatatataaaacaaaaaggaaaagcagatgatatagaccaaaaaaaaaaaaaaaaaatatcga

SEQ ID NO: 2708 - protein, 1324 aa, Arabidopsis thaliana
  misc_feature: PFam Name: Pro_CA; PFam Description: Carbonic anhydrase
  misc_feature: GI Number: 6016709; NR Description: carbonic anhydrase, chloroplast precursor [Arabidopsis thaliana] >gi|15810273|gb|AAL07024.1| putative carbonic anhydrase, chloroplast precursor [Arabidopsis thaliana]
  misc_feature: GI Number: 45451864; NR Description: chloroplast carbonic
  misc_feature: GI Number: 23397049; NR Description: putative carbonic anhydrase [Arabidopsis thaliana] >gi|23397027|gb|AAN31799.1| putative carbonic anhydrase [Arabidopsis thaliana] >gi|12642852|gb|AAK00368.1| putative carbonic anhydrase 2
  misc_feature: GI Number: 438449; NR Description: carbonic anhydrase
  misc_feature: GI Number: 20259533; NR Description: putative carbonic anhydrase, chloroplast precursor [Arabidopsis thaliana] >gi|30678347|ref|NP_850490.1| carbonic anhydrase 1, chloroplast /
CATTATTCACTTAAGTATATAGTAGCTTCCATAAGAGTCTTAGTTCTAACTATAAATACACATATCTCACTCTCTCTGATCTCCGCTTCTCTTCGCCAACAAATGTCGACCGCTCCTCTCTCCGGCTTCTTTCTCACTTCACTTTCTCCTTCTCAATCTTCTCTCCAGAAACTCTCTCTTCGTACTTCTTCCACCGTCGCTTGCCTCCCACCCGCCTCTTCTTCTTCCTCATCTTCCTCCTCCTCGTCTTCCCGTTCCGTTCCAACGCTTATCCGTAACGAGCCAGTTTTTGCCGCTCCTGCTCCTATCATTGCCCCTTATTGGAGTGAAGAGATGGGAACCGAAGCATACGACGAGGCTATTGAAGCTCTCAAGAAGCTTCTCATCGAGAAGGAAGAGCTAAAGACGGTTGCAGCGGCAAAGGTGGAGCAGATCACAGCGGCTCTTCAGACAGGTACTTCATCCGACAAGAAAGCTTTCGACCCCGTCGAAACCATTAAGCAGGGCTTCATCAAATTCAAGAAGGAGAAATACGAAACCAACCCTGCTTTGTACGGTGAGCTCGCAAAGGGTCAAAGTCCTAAGTACATGGTGTTTGCTTGTTCAGACTCACGTGTGTGTCCATCACACGTTCTGGACTTTCAGCCAGGAGATGCCTTCGTGGTCCGTAACATAGCCAACATGGTTCCTCCTTTCGACAAGGTCAAATACGGTGGCGTTGGAGCAGCCATTGAATACGCGGTCTTGCACCTTAAGGTGGAGAACATTGTGGTGATAGGACACAGTGCATGTGGTGGGATCAAAGGGCTTATGTCTTTCCCCTTAGATGGAAACAACTCCACTGACTTTATAGAGGACTGGGTCAAAATCTGTTTACCAGCCAAGTCAAAGGTTATATCAGAACTTGGAGATTCAGCCTTTGAAGATCAATGTGGCCGATGTGAAAGGGAGGCAGTGAATGTTTCACTAGCAAACCTATTGACATATCCATTTGTGAGAGAAGGACTTGTGAAGGGAACACTTGCTTTGAAGGGAGGCTACTATGACTTCGTCAAGGGTGCTTTTGAGCTTTGGGGACTTGAATTTGGCCTCTCCGAAACTAGCTCTGTATGAACCAATCCATCATCATCATCATCATCATGACCATCCATCATCATCATCATTATTATCATCGTATATAATATATATCTACCCCATATGTAATTTGTAATGTGCCTTTGACTGTGATGAGTTATCTCTCCCTCTCTACCAACTTTCTTCATATATATAAAACAAAAAGGAAAAGCAGATGATATAGACCAAAAAAAAAAAAAAAAAATATCGA

SEQ ID NO: 2709 - DNA, 1258 bp, Arabidopsis thaliana
  misc_feature (1)..(1258): Ceres cDNA ID no. 13645975
  misc_feature (1)..(1258): Ceres CLONE  ID no. 151520
  misc_feature (1)..(1258): Also known as  Ceres CDNA ID no. 13645975
gaaatatcatcaaaaaggccaaaacagaggacaacaaaaacagcaagcagcaagaagaagatgaagaatggtttgataatcataaactgtattatcctcactataggaacatgtggaggtcctttgttaactcgtctctacttcaccaatggcggaaaacgaatctggttcatgagcttcctatcaaccgctggttttccaatcatcctcatccctctcttggtctccttcctcagccgtcgccgcagcaaccgcaaccctaacaacgcggaaaacaagcggaaaacaaagctcttcctcatggaaactcctctgtttatcgcctccattgtcatagggttgctcacaggacttgacaactacttatattcttacggattagcatatctgccagtttcaacttcatcgctcataatcggaactcaactagctttcaacgctctcttcgctttcttgttagtcaagcaaaagttcactccgttctccataaacgccgtcgttttgttgacggttggtatcgggatccttgcgttacacagtgatggagacaaaccggctaaggagagcaagaaagagtatgtggttgggttcttgatgactgtggttgcagctcttctctatgcttttatattaccgctcgttgagctaacttacaagaaagctcgtcaagaaatcactttcccacttgtgcttgagattcagatggtcatgtgccttgctgctacttttttctgtgtcattggcatgttcatcgttggagattttaaggtgatagcaagagaagcaagagagttcaagattggaggatcagtgttttactatgcattgatagtgatcacaggaataatatggcaaggtttcttcttaggagccatagggattgtgttttgtgcatcatcactagcttctggtgttctgataagtgttctgcttccggtgactgaagttttcgccgtcgtttgtttccgggagaagtttcaggcagagaaaggtgtctctctacttctttctctttggggatttgtctcttacttctacggcgagtttaaatccggcaagaaagttgttgataaacctcaaccgccggagacagaactgcctattcttcctgttagtgattatgttgcttaatttctataactctataggattataacagagcattactgttatgttttgttcctaatattatgtgtgattgtgtgttttgttattgttcttgtgtataagtatgaataaatttgaaagatattgagct

SEQ ID NO: 2710 - protein, 1258 aa, Arabidopsis thaliana
GAAATATCATCAAAAAGGCCAAAACAGAGGACAACAAAAACAGCAAGCAGCAAGAAGAAGATGAAGAATGGTTTGATAATCATAAACTGTATTATCCTCACTATAGGAACATGTGGAGGTCCTTTGTTAACTCGTCTCTACTTCACCAATGGCGGAAAACGAATCTGGTTCATGAGCTTCCTATCAACCGCTGGTTTTCCAATCATCCTCATCCCTCTCTTGGTCTCCTTCCTCAGCCGTCGCCGCAGCAACCGCAACCCTAACAACGCGGAAAACAAGCGGAAAACAAAGCTCTTCCTCATGGAAACTCCTCTGTTTATCGCCTCCATTGTCATAGGGTTGCTCACAGGACTTGACAACTACTTATATTCTTACGGATTAGCATATCTGCCAGTTTCAACTTCATCGCTCATAATCGGAACTCAACTAGCTTTCAACGCTCTCTTCGCTTTCTTGTTAGTCAAGCAAAAGTTCACTCCGTTCTCCATAAACGCCGTCGTTTTGTTGACGGTTGGTATCGGGATCCTTGCGTTACACAGTGATGGAGACAAACCGGCTAAGGAGAGCAAGAAAGAGTATGTGGTTGGGTTCTTGATGACTGTGGTTGCAGCTCTTCTCTATGCTTTTATATTACCGCTCGTTGAGCTAACTTACAAGAAAGCTCGTCAAGAAATCACTTTCCCACTTGTGCTTGAGATTCAGATGGTCATGTGCCTTGCTGCTACTTTTTTCTGTGTCATTGGCATGTTCATCGTTGGAGATTTTAAGGTGATAGCAAGAGAAGCAAGAGAGTTCAAGATTGGAGGATCAGTGTTTTACTATGCATTGATAGTGATCACAGGAATAATATGGCAAGGTTTCTTCTTAGGAGCCATAGGGATTGTGTTTTGTGCATCATCACTAGCTTCTGGTGTTCTGATAAGTGTTCTGCTTCCGGTGACTGAAGTTTTCGCCGTCGTTTGTTTCCGGGAGAAGTTTCAGGCAGAGAAAGGTGTCTCTCTACTTCTTTCTCTTTGGGGATTTGTCTCTTACTTCTACGGCGAGTTTAAATCCGGCAAGAAAGTTGTTGATAAACCTCAACCGCCGGAGACAGAACTGCCTATTCTTCCTGTTAGTGATTATGTTGCTTAATTTCTATAACTCTATAGGATTATAACAGAGCATTACTGTTATGTTTTGTTCCTAATATTATGTGTGATTGTGTGTTTTGTTATTGTTCTTGTGTATAAGTATGAATAAATTTGAAAGATATTGAGCT

SEQ ID NO: 2711 - DNA, 1152 bp, Arabidopsis thaliana
  misc_feature (1)..(1152): Ceres cDNA ID no. 13645999
  misc_feature (1)..(1152): Ceres CLONE  ID no. 154882
  misc_feature (1)..(1152): Also known as  Ceres CDNA ID no. 23648630
actcatctctaacgtttctttctatctctaatccaagcaacaatatggattccgtaatcgctttcgacagatctccgatgtttcgagtctacaagagtggccgcattgagcgtctcttaggagaaacaaccgtcccaccatctcttacaccacaaaacggtgtcgtctccaaagatatcatccattcaccggagaaaaacctctccctccgcatctacctaccggagaaagtcactgttaaaaagctcccaatcctcatctacttccacggtggtggtttcatcatagaaacagctttttctccaccctaccacactttcctcacatccgccgtcgcggccgctaactgcttagcaatatcagtaaactatcgccgtgcaccggagtttccggtacctattccgtacgaagattcatgggattcactcaaatgggtgttaactcatatcacaggaaccggaccggaaacttggataaacaaacacggcgatttcggaaaagtgtttctcgccggagatagcgccggtggaaacatatctcatcatctaacgatgcgagcgaaaaaagagaagctttgtgattctttaatatcagggataatcttgattcatccatatttttggagtaagactccaattgatgagtttgaggttagagacgtggggaagacgaaaggtgttgaaggaagttggagagtcgcaagtccgaatagtaaacaaggagttgatgatccatggctcaacgttgtcggatcggatccatccggattaggttgcgggcgggttttggtaatggtagctggagatgatctgtttgtgagacaaggttggtgttacgcggagaagctgaagaagagtggatgggaaggtgaagttgaggtaatggagactaaaaatgaaggtcatgtttttcatttgaagaatcctaatagtgataatgctcgtcaagtcgtgaagaaacttgaagagtttattaataagtaatattaatgagtacgtttgtcgaaggagataacaataactaaagaataaattggtgtatttgtcactgattacatatagaattatgctatcacatttagggttaaagccaagaggagtcagttaaagtttcagttattttctttcaagtaactgatagaaagacgattaa

SEQ ID NO: 2712 - protein, 1152 aa, Arabidopsis thaliana
  misc_feature: PFam Name: Abhydrolase_3; PFam Description: alpha/beta
  misc_feature: PFam Name: COesterase; PFam Description: Carboxylesterase
  misc_feature: GI Number: 50198965; NR Description: At2g03550 [Arabidopsis
  misc_feature: GI Number: 28393060; NR Description: putative esterase
  misc_feature: GI Number: 18086341; NR Description: AT3g48690/T8P19_200
  misc_feature: GI Number: 21537287; NR Description: putative esterase
  misc_feature: GI Number: 51535285; NR Description: putative PrMC3 [Oryza
ACTCATCTCTAACGTTTCTTTCTATCTCTAATCCAAGCAACAATATGGATTCCGTAATCGCTTTCGACAGATCTCCGATGTTTCGAGTCTACAAGAGTGGCCGCATTGAGCGTCTCTTAGGAGAAACAACCGTCCCACCATCTCTTACACCACAAAACGGTGTCGTCTCCAAAGATATCATCCATTCACCGGAGAAAAACCTCTCCCTCCGCATCTACCTACCGGAGAAAGTCACTGTTAAAAAGCTCCCAATCCTCATCTACTTCCACGGTGGTGGTTTCATCATAGAAACAGCTTTTTCTCCACCCTACCACACTTTCCTCACATCCGCCGTCGCGGCCGCTAACTGCTTAGCAATATCAGTAAACTATCGCCGTGCACCGGAGTTTCCGGTACCTATTCCGTACGAAGATTCATGGGATTCACTCAAATGGGTGTTAACTCATATCACAGGAACCGGACCGGAAACTTGGATAAACAAACACGGCGATTTCGGAAAAGTGTTTCTCGCCGGAGATAGCGCCGGTGGAAACATATCTCATCATCTAACGATGCGAGCGAAAAAAGAGAAGCTTTGTGATTCTTTAATATCAGGGATAATCTTGATTCATCCATATTTTTGGAGTAAGACTCCAATTGATGAGTTTGAGGTTAGAGACGTGGGGAAGACGAAAGGTGTTGAAGGAAGTTGGAGAGTCGCAAGTCCGAATAGTAAACAAGGAGTTGATGATCCATGGCTCAACGTTGTCGGATCGGATCCATCCGGATTAGGTTGCGGGCGGGTTTTGGTAATGGTAGCTGGAGATGATCTGTTTGTGAGACAAGGTTGGTGTTACGCGGAGAAGCTGAAGAAGAGTGGATGGGAAGGTGAAGTTGAGGTAATGGAGACTAAAAATGAAGGTCATGTTTTTCATTTGAAGAATCCTAATAGTGATAATGCTCGTCAAGTCGTGAAGAAACTTGAAGAGTTTATTAATAAGTAATATTAATGAGTACGTTTGTCGAAGGAGATAACAATAACTAAAGAATAAATTGGTGTATTTGTCACTGATTACATATAGAATTATGCTATCACATTTAGGGTTAAAGCCAAGAGGAGTCAGTTAAAGTTTCAGTTATTTTCTTTCAAGTAACTGATAGAAAGACGATTAA

SEQ ID NO: 2713 - DNA, 1289 bp, Arabidopsis thaliana
  misc_feature (1)..(1289): Ceres cDNA ID no. 13646011
  misc_feature (1)..(1289): Ceres CLONE  ID no. 156434
  misc_feature (1)..(1289): Also known as  Ceres CDNA ID no. 24378767
ataattccatttacccgaaaccctaatccccaatttctctttcaagttttcgatcacgatctctggaaaattaagagagaaattcaaaaacttcgggagttcaaagtctcattcagacattccagaaggtattctagtcgactgagtaaacaatcatgagaatcagaaaaggaagtagagttgaggtatttagcaacaaagaggcgccttatggtgcgtggcgatgtgctgagattgtctcgggtaatggacatacctacaatgttagattttactctttccaaattgaacacgaggaggcagttatggagaaagttccaaggaagataattaggccttgtcctccacttgtggatgttgagagatgggatactggtgaattggtggaagttcttgataatttttcctggaaagctgccacagttcgagaggagttatctggacattactatgtggttcgcttacttgggactccagaagaactcacatttcacaaagttaacctcagggcccgaaagtcgtggcaagatgagagatgggttgcaattggaaagatatctggttctctgaagtcatccacactgactggatcagacgtacatcagaagctacagccccacaggaacagcatgcctctccacgagcctagcgtggtctctgctagattgttaaagaggccgtcaccttacaactggtctgaatgtgctgaatcatgtacaggaaaccctaagaagatgcgttcattggaaaaagaaggacagcagcaaaaggtagatgccatttcttgccgaccagaaaacaggggtggtaaatctcacgtgcaagcttccttaaacaatcacaaaactggttactgtcaaattgtcagggtaagatcaaaagggtttagtgagagtgttcgtgctgatgattgttctgatagcgatgtatgctcagttggtagttgtagtgctactagttatgatgagagtaacatgccaccttgtatgctagatggctctactcaacaggcagactcatgtagcagcgatgctgaatcttcttgtggcctgggggaagaaccaaggtggaaacattcatcagttggtgatggagcaagaaattcttgtaggtcggaactatattcttaccgcagtactctgggggaattattttcttctggtcccctaagttgggagcaagaagcatcattaactgatcttcgtctttctcttaatatatcagatgatgaacatttgatggaggtaagaaatttgatatctactggtacccgcagtcaattttgttag

SEQ ID NO: 2714 - protein, 1289 aa, Arabidopsis thaliana
  misc_feature: PFam Name: Agenet; PFam Description: Agenet domain
  misc_feature: PFam Name: ENT; PFam Description: ENT domain
  misc_feature: GI Number: 42573127; NR Description: agenet domain-containing
  misc_feature: GI Number: 50906127; NR Description: putative agenet domain-containing protein [Oryza sativa (japonica cultivar-group)] >gi|51536260|dbj|BAD38428.1| putative agenet domain-containing protein [Oryza sativa (japonica
  misc_feature: GI Number: 21553399; NR Description: unknown [Arabidopsis thaliana] >gi|27808580|gb|AAO24570.1| At5g20030 [Arabidopsis thaliana] >gi|15241247|ref|NP_197503.1| agenet domain-containing
ATAATTCCATTTACCCGAAACCCTAATCCCCAATTTCTCTTTCAAGTTTTCGATCACGATCTCTGGAAAATTAAGAGAGAAATTCAAAAACTTCGGGAGTTCAAAGTCTCATTCAGACATTCCAGAAGGTATTCTAGTCGACTGAGTAAACAATCATGAGAATCAGAAAAGGAAGTAGAGTTGAGGTATTTAGCAACAAAGAGGCGCCTTATGGTGCGTGGCGATGTGCTGAGATTGTCTCGGGTAATGGACATACCTACAATGTTAGATTTTACTCTTTCCAAATTGAACACGAGGAGGCAGTTATGGAGAAAGTTCCAAGGAAGATAATTAGGCCTTGTCCTCCACTTGTGGATGTTGAGAGATGGGATACTGGTGAATTGGTGGAAGTTCTTGATAATTTTTCCTGGAAAGCTGCCACAGTTCGAGAGGAGTTATCTGGACATTACTATGTGGTTCGCTTACTTGGGACTCCAGAAGAACTCACATTTCACAAAGTTAACCTCAGGGCCCGAAAGTCGTGGCAAGATGAGAGATGGGTTGCAATTGGAAAGATATCTGGTTCTCTGAAGTCATCCACACTGACTGGATCAGACGTACATCAGAAGCTACAGCCCCACAGGAACAGCATGCCTCTCCACGAGCCTAGCGTGGTCTCTGCTAGATTGTTAAAGAGGCCGTCACCTTACAACTGGTCTGAATGTGCTGAATCATGTACAGGAAACCCTAAGAAGATGCGTTCATTGGAAAAAGAAGGACAGCAGCAAAAGGTAGATGCCATTTCTTGCCGACCAGAAAACAGGGGTGGTAAATCTCACGTGCAAGCTTCCTTAAACAATCACAAAACTGGTTACTGTCAAATTGTCAGGGTAAGATCAAAAGGGTTTAGTGAGAGTGTTCGTGCTGATGATTGTTCTGATAGCGATGTATGCTCAGTTGGTAGTTGTAGTGCTACTAGTTATGATGAGAGTAACATGCCACCTTGTATGCTAGATGGCTCTACTCAACAGGCAGACTCATGTAGCAGCGATGCTGAATCTTCTTGTGGCCTGGGGGAAGAACCAAGGTGGAAACATTCATCAGTTGGTGATGGAGCAAGAAATTCTTGTAGGTCGGAACTATATTCTTACCGCAGTACTCTGGGGGAATTATTTTCTTCTGGTCCCCTAAGTTGGGAGCAAGAAGCATCATTAACTGATCTTCGTCTTTCTCTTAATATATCAGATGATGAACATTTGATGGAGGTAAGAAATTTGATATCTACTGGTACCCGCAGTCAATTTTGTTAG

SEQ ID NO: 2715 - DNA, 1523 bp, Arabidopsis thaliana
  misc_feature (1)..(1523): Ceres cDNA ID no. 13646158
  misc_feature (1)..(1523): Ceres CLONE  ID no. 157414
  misc_feature (1)..(1523): Also known as  Ceres CDNA ID no. 23648768
atcataatcatttacttcaaacaacaatctttgcttctctctgagtgatcatctttcttgttcaatggctggtcaaaagatactttctttactggttatagctcttgttgttacttttgcagctgcggctcggcttcttgatgaagaaaatgcattctcagctaccacaaccacccttggctcaggttcaggttccaccggaattggttttggtgcaggaacagggtcaagtggttcaggttccacgggattcggttttggtgcaggatcagggtcatctggttcaggttctactggaagcggtctcggtgcaggtacagggtcaataccatcaagtggttcaggtcctggtcttctaccaactgccagttctgttcctggttctttagcgggtggtggttcaggttccttgcctaccactggttcagccactggtgcaggtgcaggtaccggttcagctcttggaggtggtccaggtgctggctcagctcttggtggtggtgcgggtgccggtccagctcttggtggtggtgcgggtgccggtccagctcttggtggtggtgcaggtgctggttcagctcttggtggtggtggtgcaggtgctggtccagctcttggtggtggtggtgcaggtgctggtccagctcttggtggtggtgttgcaggttctggttcagctcttggtggtggtgcaagtgctggtcctgacaatacgttggtattttttatgcatgatatactcggtggttcaaatcccactgccagagccgtaactggagtcgtcgcaaatccggctttaagcgggcaacttccatttgctaaacccaacggcgcaaaccttcctgtaagcaacggagttccgtcaaacaacaacaacaatgggattgtcaacaacaacaatgtccctttcctcgttggactcggcggaaccacagctaacattctccagaacaacaataacggaaacaacattttaaatggtttccctgttgctagtggcggtcagctcccgagcggttctgctcttcagatgctaatgttcgggacaatgacagtaatcgatgatgaactaactgaaggccatgagctcggatctggcttactcgggaaagcgcagggatattatgtggcgagtgcaattgacggaactagccagacaatggctttcaccgcgatgtttgaaagcggcggttatgaagatagtataagcttctttggggttctcagaacagcggtatcagaatcgcatataggagtaatgggaggtaccggaaagtatgtgaatgcgaggggattcgcgattctgaagacgtttacaggatctagcgggacgcagcagaatcagccgcatcagttcactgatgggcttgagactgttgttgagtgtaccgtttatctttcttactagttttatttttcttcttttgttggggtttgggaatgtttggtgtgtatgttatgtgtgtcatttgtaatctaaatatgaaatttgtgtaagaaaattgtatgtacttttttttttt

SEQ ID NO: 2716 - protein, 1523 aa, Arabidopsis thaliana
  misc_feature: PFam Name: Dirigent; PFam Description: Dirigent-like protein
  misc_feature: PFam Name: S-antigen; PFam Description: S-antigen protein
  misc_feature: PFam Name: Dehydrin; PFam Description: Dehydrin
  misc_feature: PFam Name: Chorion_1; PFam Description: Chorion protein
  misc_feature: PFam Name: Harpin; PFam Description: Harpin protein (HrpN)
  misc_feature: GI Number: 53749146; NR Description: At2g28670 [Arabidopsis thaliana] >gi|4580390|gb|AAD24368.1| putative disease resistance response protein [Arabidopsis thaliana] >gi|27754517|gb|AAO22706.1| putative fibroin protein [Arabidopsis
  misc_feature: GI Number: 34895944; NR Description: P0011G08.13 [Oryza sativa (japonica cultivar-group)] >gi|15528621|dbj|BAB64642.1|
  misc_feature: GI Number: 38454170; NR Description: At2g39430 [Arabidopsis thaliana] >gi|3355472|gb|AAC27834.1| putative disease resistance response protein [Arabidopsis thaliana] >gi|44022160|gb|AAS46642.1| At2g39430 [Arabidopsis thaliana]
  misc_feature: GI Number: 7019656; NR Description: disease resistance response/ dirigent-like protein [Arabidopsis thaliana] >gi|11282368|pir||T47662 disease resistance response/ dirigent-like protein - Arabidopsis thaliana
  misc_feature: GI Number: 27497202; NR Description: Putative disease resistance response protein [Oryza sativa (japonica
ATCATAATCATTTACTTCAAACAACAATCTTTGCTTCTCTCTGAGTGATCATCTTTCTTGTTCAATGGCTGGTCAAAAGATACTTTCTTTACTGGTTATAGCTCTTGTTGTTACTTTTGCAGCTGCGGCTCGGCTTCTTGATGAAGAAAATGCATTCTCAGCTACCACAACCACCCTTGGCTCAGGTTCAGGTTCCACCGGAATTGGTTTTGGTGCAGGAACAGGGTCAAGTGGTTCAGGTTCCACGGGATTCGGTTTTGGTGCAGGATCAGGGTCATCTGGTTCAGGTTCTACTGGAAGCGGTCTCGGTGCAGGTACAGGGTCAATACCATCAAGTGGTTCAGGTCCTGGTCTTCTACCAACTGCCAGTTCTGTTCCTGGTTCTTTAGCGGGTGGTGGTTCAGGTTCCTTGCCTACCACTGGTTCAGCCACTGGTGCAGGTGCAGGTACCGGTTCAGCTCTTGGAGGTGGTCCAGGTGCTGGCTCAGCTCTTGGTGGTGGTGCGGGTGCCGGTCCAGCTCTTGGTGGTGGTGCGGGTGCCGGTCCAGCTCTTGGTGGTGGTGCAGGTGCTGGTTCAGCTCTTGGTGGTGGTGGTGCAGGTGCTGGTCCAGCTCTTGGTGGTGGTGGTGCAGGTGCTGGTCCAGCTCTTGGTGGTGGTGTTGCAGGTTCTGGTTCAGCTCTTGGTGGTGGTGCAAGTGCTGGTCCTGACAATACGTTGGTATTTTTTATGCATGATATACTCGGTGGTTCAAATCCCACTGCCAGAGCCGTAACTGGAGTCGTCGCAAATCCGGCTTTAAGCGGGCAACTTCCATTTGCTAAACCCAACGGCGCAAACCTTCCTGTAAGCAACGGAGTTCCGTCAAACAACAACAACAATGGGATTGTCAACAACAACAATGTCCCTTTCCTCGTTGGACTCGGCGGAACCACAGCTAACATTCTCCAGAACAACAATAACGGAAACAACATTTTAAATGGTTTCCCTGTTGCTAGTGGCGGTCAGCTCCCGAGCGGTTCTGCTCTTCAGATGCTAATGTTCGGGACAATGACAGTAATCGATGATGAACTAACTGAAGGCCATGAGCTCGGATCTGGCTTACTCGGGAAAGCGCAGGGATATTATGTGGCGAGTGCAATTGACGGAACTAGCCAGACAATGGCTTTCACCGCGATGTTTGAAAGCGGCGGTTATGAAGATAGTATAAGCTTCTTTGGGGTTCTCAGAACAGCGGTATCAGAATCGCATATAGGAGTAATGGGAGGTACCGGAAAGTATGTGAATGCGAGGGGATTCGCGATTCTGAAGACGTTTACAGGATCTAGCGGGACGCAGCAGAATCAGCCGCATCAGTTCACTGATGGGCTTGAGACTGTTGTTGAGTGTACCGTTTATCTTTCTTACTAGTTTTATTTTTCTTCTTTTGTTGGGGTTTGGGAATGTTTGGTGTGTATGTTATGTGTGTCATTTGTAATCTAAATATGAAATTTGTGTAAGAAAATTGTATGTACTTTTTTTTTTT

SEQ ID NO: 2717 - DNA, 1067 bp, Arabidopsis thaliana
  misc_feature (1)..(1067): Ceres cDNA ID no. 13646184
  misc_feature (1)..(1067): Ceres CLONE  ID no. 8504
  misc_feature (1)..(1067): Also known as  Ceres CDNA ID no. 23650002
acttctctctaatttcttaatcatctcttcttatagtttttaccctaaagaaaatggcaaccgtcgatgtcatcaacggtgattcaatctcaactcttcattctgacataatccaaacccaaatcttgacccgactcgatggtccgacgctagcctccaccgcaacaacctcttcttacctccaaactctatgcacggaagagaaactctggcaagaactctccatcgacacgtggccttcgatcaatgatccacgtgttgtccaagctatctcctctttcccttccggttaccgttctttctttgctgactcgtacccgttcactgaacacacgtggcagtctgaaaaacatgatccaccgacgggattaatctcagccgttgatttatactacagaggagagattatatactcgaaggtacaagagatggaaacagagaaaggtaaatcaggatggttcttgtcatcaccgtttcgggtcgatatactcgacccgaaagagtcggtccaaacccggattcgatatccgggtggggactacgaagcgtgggtgaaagatatggaagagagcatgaaacttaattggatactaatcgatccgatcaagaaacgagcggcgaatatatctagtcgaaaggcggtgtcggcgcggcggaactggctaacgggggatttagaaatacggttttcaacggtagtgacggcggaggcggcggaagtggcggcggttgtgtcatgcgggtcagcggaagcgtggaaagaggtggatgaggaagtgggaggagaaatacacgtgagggacgtgaggctacaagtagaggacatagaaggaaaatgtatgaaaggtagggatagtttggtaattttacaagggttgttagatggaaagagatcgtgtaaagatgatgaagagagaagagctaaagaaaggtatgaagaatacgtgcgaatgaagatacaatggagagagaataaagagaggagagaaaaagctcaagacacaatttgtatgatctttgggttctctatgtttgtgcttttgtggagttttattttgttaaggtaa

SEQ ID NO: 2718 - protein, 1067 aa, Arabidopsis thaliana
  misc_feature: PFam Name: F-box; PFam Description: F-box domain
  misc_feature: GI Number: 62701652; NR Description: F-box domain, putative
  misc_feature: GI Number: 50253058; NR Description: F-box protein-like [Oryza sativa (japonica cultivar-group)] >gi|50251878|dbj|BAD27806.1| F-box protein-like [Oryza sativa
ACTTCTCTCTAATTTCTTAATCATCTCTTCTTATAGTTTTTACCCTAAAGAAAATGGCAACCGTCGATGTCATCAACGGTGATTCAATCTCAACTCTTCATTCTGACATAATCCAAACCCAAATCTTGACCCGACTCGATGGTCCGACGCTAGCCTCCACCGCAACAACCTCTTCTTACCTCCAAACTCTATGCACGGAAGAGAAACTCTGGCAAGAACTCTCCATCGACACGTGGCCTTCGATCAATGATCCACGTGTTGTCCAAGCTATCTCCTCTTTCCCTTCCGGTTACCGTTCTTTCTTTGCTGACTCGTACCCGTTCACTGAACACACGTGGCAGTCTGAAAAACATGATCCACCGACGGGATTAATCTCAGCCGTTGATTTATACTACAGAGGAGAGATTATATACTCGAAGGTACAAGAGATGGAAACAGAGAAAGGTAAATCAGGATGGTTCTTGTCATCACCGTTTCGGGTCGATATACTCGACCCGAAAGAGTCGGTCCAAACCCGGATTCGATATCCGGGTGGGGACTACGAAGCGTGGGTGAAAGATATGGAAGAGAGCATGAAACTTAATTGGATACTAATCGATCCGATCAAGAAACGAGCGGCGAATATATCTAGTCGAAAGGCGGTGTCGGCGCGGCGGAACTGGCTAACGGGGGATTTAGAAATACGGTTTTCAACGGTAGTGACGGCGGAGGCGGCGGAAGTGGCGGCGGTTGTGTCATGCGGGTCAGCGGAAGCGTGGAAAGAGGTGGATGAGGAAGTGGGAGGAGAAATACACGTGAGGGACGTGAGGCTACAAGTAGAGGACATAGAAGGAAAATGTATGAAAGGTAGGGATAGTTTGGTAATTTTACAAGGGTTGTTAGATGGAAAGAGATCGTGTAAAGATGATGAAGAGAGAAGAGCTAAAGAAAGGTATGAAGAATACGTGCGAATGAAGATACAATGGAGAGAGAATAAAGAGAGGAGAGAAAAAGCTCAAGACACAATTTGTATGATCTTTGGGTTCTCTATGTTTGTGCTTTTGTGGAGTTTTATTTTGTTAAGGTAA

SEQ ID NO: 2719 - DNA, 1144 bp, Arabidopsis thaliana
  misc_feature (1)..(1144): Ceres cDNA ID no. 13646268
  misc_feature (1)..(1144): Ceres CLONE  ID no. 1010007
  misc_feature (1)..(1144): Also known as  Ceres CDNA ID no. 23648099
atcaaacacaaaccaaagacaacttgagtaaccaaaccaaagactaaaaatggccaaagctcttcacataaccatctttctcttcctcatatcctccaatctcctcgcatttatcaactccgccagacttcttgacgagatccaacctcagcctcagttagtccctaccggccaaatccccactgtggctccaaccgaagctgaggaggaggatggaaccgatgacaacccaggactagcaaccacaaccacaactgcatcagcagttacagtcccagccggtccagcagaggctacagagccattactagagttctttatgcatgacgtgctaggcggatctcacccatcagctcgtgtggttacaggtatagtagctcaaactgaagtgaacggaataccattctcaaaggccagtaacagcattttcccggttgacaatggagtcccactggtcaactcaaacaacatcaacagtgtcattaacccaaacacagctccacttctcaccggacttggcggtgctcaaacctccaccgtcatccaaaacactaacggaaattccaacgatgcccttagcgccaacagtctcccttttgtaactgccgggaaccttcctcccggtgctgccctccagcatctcatgttcggaaccataaccgttgtagatgatgagctaaccgaaagccacgagcttggctcagccgttatagggagagctcaaggcttttacttggccagttccctggacggaacaagtcagactctttctctgactgtattgctacatggtgagcatgaccagcatgacactttagacgatgccattagtttctttggggttcacagaaccgcctctcatgcctcccagatcgcggttataggcgggaccgggaagtttgaacacgccaaagggtatgccatagtggaaactctgcataaccaggacaaccagcatatcactgatggtcaagacaccatcctccatttcagtgtataccttacctacaaagcttgaagagaaaatgagtgttaaaacaagaaaagattgcttttttataagtttttgctcactagattccccttggggcctttttcctttgttgcgcaaatttgatttttaaagaaattttttttgttgggg

SEQ ID NO: 2720 - protein, 1144 aa, Arabidopsis thaliana
  misc_feature: PFam Name: Dirigent; PFam Description: Dirigent-like protein
  misc_feature: GI Number: 38454170; NR Description: At2g39430 [Arabidopsis thaliana] >gi|3355472|gb|AAC27834.1| putative disease resistance response protein [Arabidopsis thaliana] >gi|44022160|gb|AAS46642.1| At2g39430 [Arabidopsis thaliana]
  misc_feature: GI Number: 7019656; NR Description: disease resistance response/ dirigent-like protein [Arabidopsis thaliana] >gi|11282368|pir||T47662 disease resistance response/ dirigent-like protein - Arabidopsis thaliana
  misc_feature: GI Number: 53749146; NR Description: At2g28670 [Arabidopsis thaliana] >gi|4580390|gb|AAD24368.1| putative disease resistance response protein [Arabidopsis thaliana] >gi|27754517|gb|AAO22706.1| putative fibroin protein [Arabidopsis
  misc_feature: GI Number: 34895944; NR Description: P0011G08.13 [Oryza sativa (japonica cultivar-group)] >gi|15528621|dbj|BAB64642.1|
  misc_feature: GI Number: 27497202; NR Description: Putative disease resistance response protein [Oryza sativa (japonica
ATCAAACACAAACCAAAGACAACTTGAGTAACCAAACCAAAGACTAAAAATGGCCAAAGCTCTTCACATAACCATCTTTCTCTTCCTCATATCCTCCAATCTCCTCGCATTTATCAACTCCGCCAGACTTCTTGACGAGATCCAACCTCAGCCTCAGTTAGTCCCTACCGGCCAAATCCCCACTGTGGCTCCAACCGAAGCTGAGGAGGAGGATGGAACCGATGACAACCCAGGACTAGCAACCACAACCACAACTGCATCAGCAGTTACAGTCCCAGCCGGTCCAGCAGAGGCTACAGAGCCATTACTAGAGTTCTTTATGCATGACGTGCTAGGCGGATCTCACCCATCAGCTCGTGTGGTTACAGGTATAGTAGCTCAAACTGAAGTGAACGGAATACCATTCTCAAAGGCCAGTAACAGCATTTTCCCGGTTGACAATGGAGTCCCACTGGTCAACTCAAACAACATCAACAGTGTCATTAACCCAAACACAGCTCCACTTCTCACCGGACTTGGCGGTGCTCAAACCTCCACCGTCATCCAAAACACTAACGGAAATTCCAACGATGCCCTTAGCGCCAACAGTCTCCCTTTTGTAACTGCCGGGAACCTTCCTCCCGGTGCTGCCCTCCAGCATCTCATGTTCGGAACCATAACCGTTGTAGATGATGAGCTAACCGAAAGCCACGAGCTTGGCTCAGCCGTTATAGGGAGAGCTCAAGGCTTTTACTTGGCCAGTTCCCTGGACGGAACAAGTCAGACTCTTTCTCTGACTGTATTGCTACATGGTGAGCATGACCAGCATGACACTTTAGACGATGCCATTAGTTTCTTTGGGGTTCACAGAACCGCCTCTCATGCCTCCCAGATCGCGGTTATAGGCGGGACCGGGAAGTTTGAACACGCCAAAGGGTATGCCATAGTGGAAACTCTGCATAACCAGGACAACCAGCATATCACTGATGGTCAAGACACCATCCTCCATTTCAGTGTATACCTTACCTACAAAGCTTGAAGAGAAAATGAGTGTTAAAACAAGAAAAGATTGCTTTTTTATAAGTTTTTGCTCACTAGATTCCCCTTGGGGCCTTTTTCCTTTGTTGCGCAAATTTGATTTTTAAAGAAATTTTTTTTGTTGGGG

SEQ ID NO: 2721 - DNA, 2394 bp, Arabidopsis thaliana
  misc_feature (1)..(2394): Ceres cDNA ID no. 13646548
  misc_feature (1)..(2394): Ceres CLONE  ID no. 1153115
  misc_feature (1)..(2394): Also known as  Ceres CDNA ID no. 23656383
agagaaaaaaacatatgagctgagtttgttaaccaccgtgagcgtcatccatgggacgtggttgacgcgtgcgtgattttattttaataaatgaattaacagtggaaggaaaaaacaacaacggagctgtaactgtgaggcgccgtctctcttcaacctcttcccctccactttgcttctctctctcctccccgggggttttacagtcatatcatcgtcggagactctgcgattcttcacggaatcgtatttctctctcagcgatttttttcgattctcgaagctgcaaggaccacccatcaaacattgaaactcaagcgggagaaattttctggctcgggagggaaactatggagccctaatgcccattttctgctgtctatgaggttttttaaagagtcctttatactctccctgtttttgggtgcttcgctcgctcactgatttttgattcgtcggaaaatctattttcgagctcggatttatgtaattccttattctccttctgattgcgattgttgtgttcattaagggttgttgggatatcgattaacggcccctatcgaaaaaaataagggttgttattattttcatttcgcttcatgttcaaggcaagtatctatctcttcttcttgcttttgtagttttagaatctaaatcccatggcatcaacgtttcgattactctttcagggaactccatttttcttgcatttgctttttttgaggtagagtctgtgctcctatatgattccatggattcgtcgtatactttctcaactgagaatgtttgacttagagaatcttccattttttttttttgtctttctcttttcagtgttactatcattttagatcttttttttgtttttccttctctggttgactgtgtttgaggtaatgctcaaaacgtgattctttgtgctcattatcttttcatattctagtttctggaatctttctgggtattaagcatttgatgattttaaaattgtatatttgttgattttattgagttgacaccaggtttcttgttgacatatgcccaattcattctgatcgttgatgatgattgattcttgtatccgttcaatgtaggttatgtttggatgatagatacattttgactttctcatacaatgagtacacgaagaaatggcatttccaagcatcagcgaggtgataaattttgtggtgaagggccaaactggatactaattgcagggggtgcattgttgagcacattgtccattcgctttggatacaagctaaagcagtcgcttgattcgaaacctcaatcaaatggctctgctggattaaaacctaatggaacatctgagaggcaaaaatctacaagctgttgcttacactctaccacatcttcctgtacacaaaataatgatttttgttgcttccgctccattccaggaactgagagtgtggaaggaaaagaggtgacaagcgagcaaatgatatccgcatctgacacttcactgcctcttgtgacagttcctgctccatcgagcaaagagaatggagtcatgtgggcaacttctcctgatcgcctggaacttcccccaagaccatacaatcacaattcaaactgctcagattctccttgcgtatctgaaaccagctcagacattttcagcaaacgagaagtaatacagaaactaaggcagcagctgaagagacgggatgacatgatacaggaaatgcaagaacagattctagagctgcaaaactcgtataacgcacagacggcacactcaagccatctccaggcacagctagacacactgaacagagatctgtttgaatcagaaagagaagttcaaagactgagaaaggcaattgctgatcacagcgtgggatgtggcgcggacagcaatggcaagacatctcaggttggaccttggaatggcgggtttatggacagcgaaagcaattatgagtcacaagaaaagagcctaagggatggagaaagagtagagatgttgagaaaggaagtgagtgagcttaaagaagtgatagatgggaaagagtatctacttagaagctataaggagcagaagattgagctttcgcagaaggtaaaagagttgcagcagagactggactcacagctccaaaacttattgtaggtggaaaggttaggcattgtgcatacttgcgtctcttattttttttttcggttctttttcctttttcgagaaaatgaatcttagtatgtactaagaacggtggagatcaagattttcaggttctttctggctttctgctttcgtttttgaatgtcttgattctgttttttctttcaacatttggtgtaaaggtaaatagatagttgttgaagaaaaaaaaaaaaaaaaaaactcgagggggggcccggtac

SEQ ID NO: 2722 - protein, 2394 aa, Arabidopsis thaliana
  misc_feature: GI Number: 21536672; NR Description: unknown [Arabidopsis thaliana]
AGAGAAAAAAACATATGAGCTGAGTTTGTTAACCACCGTGAGCGTCATCCATGGGACGTGGTTGACGCGTGCGTGATTTTATTTTAATAAATGAATTAACAGTGGAAGGAAAAAACAACAACGGAGCTGTAACTGTGAGGCGCCGTCTCTCTTCAACCTCTTCCCCTCCACTTTGCTTCTCTCTCTCCTCCCCGGGGGTTTTACAGTCATATCATCGTCGGAGACTCTGCGATTCTTCACGGAATCGTATTTCTCTCTCAGCGATTTTTTTCGATTCTCGAAGCTGCAAGGACCACCCATCAAACATTGAAACTCAAGCGGGAGAAATTTTCTGGCTCGGGAGGGAAACTATGGAGCCCTAATGCCCATTTTCTGCTGTCTATGAGGTTTTTTAAAGAGTCCTTTATACTCTCCCTGTTTTTGGGTGCTTCGCTCGCTCACTGATTTTTGATTCGTCGGAAAATCTATTTTCGAGCTCGGATTTATGTAATTCCTTATTCTCCTTCTGATTGCGATTGTTGTGTTCATTAAGGGTTGTTGGGATATCGATTAACGGCCCCTATCGAAAAAAATAAGGGTTGTTATTATTTTCATTTCGCTTCATGTTCAAGGCAAGTATCTATCTCTTCTTCTTGCTTTTGTAGTTTTAGAATCTAAATCCCATGGCATCAACGTTTCGATTACTCTTTCAGGGAACTCCATTTTTCTTGCATTTGCTTTTTTTGAGGTAGAGTCTGTGCTCCTATATGATTCCATGGATTCGTCGTATACTTTCTCAACTGAGAATGTTTGACTTAGAGAATCTTCCATTTTTTTTTTTTGTCTTTCTCTTTTCAGTGTTACTATCATTTTAGATCTTTTTTTTGTTTTTCCTTCTCTGGTTGACTGTGTTTGAGGTAATGCTCAAAACGTGATTCTTTGTGCTCATTATCTTTTCATATTCTAGTTTCTGGAATCTTTCTGGGTATTAAGCATTTGATGATTTTAAAATTGTATATTTGTTGATTTTATTGAGTTGACACCAGGTTTCTTGTTGACATATGCCCAATTCATTCTGATCGTTGATGATGATTGATTCTTGTATCCGTTCAATGTAGGTTATGTTTGGATGATAGATACATTTTGACTTTCTCATACAATGAGTACACGAAGAAATGGCATTTCCAAGCATCAGCGAGGTGATAAATTTTGTGGTGAAGGGCCAAACTGGATACTAATTGCAGGGGGTGCATTGTTGAGCACATTGTCCATTCGCTTTGGATACAAGCTAAAGCAGTCGCTTGATTCGAAACCTCAATCAAATGGCTCTGCTGGATTAAAACCTAATGGAACATCTGAGAGGCAAAAATCTACAAGCTGTTGCTTACACTCTACCACATCTTCCTGTACACAAAATAATGATTTTTGTTGCTTCCGCTCCATTCCAGGAACTGAGAGTGTGGAAGGAAAAGAGGTGACAAGCGAGCAAATGATATCCGCATCTGACACTTCACTGCCTCTTGTGACAGTTCCTGCTCCATCGAGCAAAGAGAATGGAGTCATGTGGGCAACTTCTCCTGATCGCCTGGAACTTCCCCCAAGACCATACAATCACAATTCAAACTGCTCAGATTCTCCTTGCGTATCTGAAACCAGCTCAGACATTTTCAGCAAACGAGAAGTAATACAGAAACTAAGGCAGCAGCTGAAGAGACGGGATGACATGATACAGGAAATGCAAGAACAGATTCTAGAGCTGCAAAACTCGTATAACGCACAGACGGCACACTCAAGCCATCTCCAGGCACAGCTAGACACACTGAACAGAGATCTGTTTGAATCAGAAAGAGAAGTTCAAAGACTGAGAAAGGCAATTGCTGATCACAGCGTGGGATGTGGCGCGGACAGCAATGGCAAGACATCTCAGGTTGGACCTTGGAATGGCGGGTTTATGGACAGCGAAAGCAATTATGAGTCACAAGAAAAGAGCCTAAGGGATGGAGAAAGAGTAGAGATGTTGAGAAAGGAAGTGAGTGAGCTTAAAGAAGTGATAGATGGGAAAGAGTATCTACTTAGAAGCTATAAGGAGCAGAAGATTGAGCTTTCGCAGAAGGTAAAAGAGTTGCAGCAGAGACTGGACTCACAGCTCCAAAACTTATTGTAGGTGGAAAGGTTAGGCATTGTGCATACTTGCGTCTCTTATTTTTTTTTTCGGTTCTTTTTCCTTTTTCGAGAAAATGAATCTTAGTATGTACTAAGAACGGTGGAGATCAAGATTTTCAGGTTCTTTCTGGCTTTCTGCTTTCGTTTTTGAATGTCTTGATTCTGTTTTTTCTTTCAACATTTGGTGTAAAGGTAAATAGATAGTTGTTGAAGAAAAAAAAAAAAAAAAAAACTCGAGGGGGGGCCCGGTAC

SEQ ID NO: 2723 - DNA, 1322 bp, Arabidopsis thaliana
  misc_feature (1)..(1322): Ceres cDNA ID no. 13646612
  misc_feature (1)..(1322): Ceres CLONE  ID no. 1189454
  misc_feature (1)..(1322): Also known as  Ceres CDNA ID no. 23654293
ccccccccccgatttgaagatgatgtctcggccctccttatccttatctcgcccaccgttctaaaacccttcccttcctcttcttttctcttctccttccacttccacttcttctatctctcacaattcagcaatggcttcttctatagttacctctagcttgaagcctttagccatggccgattctacctcttctaccattttctcccatccttccatctcctctaccatctcttcctccagaattcgcagctccagtgtttccctccttaccggacgcattaacctgcccctctctttctctcgcgtctctctatctcttaaaaccaaaacccaccttaaaaaatccccctttgtctccttcgttgcccagacttcggattgggctgaagaaggtggagaaggaagcgtcgctgttgaggagaccgagaacagtttagagtcacaagatgtgagcgaaggagatgagagcgaaggagatgtgagcgaaggagatgtgagcgaaggagatgagagcgaaggagatgtgagcgaaggagctgtgagcgaaagagctgagttcccggagccatcggaagaagccaagcttttcgtcggaaatttggcttatgatgttaatagccaagctttggctatgctctttgagcaagccggtactgttgaaatcgccgaggttatatacaatagggaaactgaccagagtcgtgggtttggatttgtgacaatgagttctgtggacgaagctgagacagctgtggagaagttcaaccgttatgatcttaacggacgtctactaactgtaaacaaggcagctccaagaggatcacgtccagaacgtgcgcctcgggtatatgaacctgcattcagagtatatgtagggaatctaccatgggatgtggacaatggccgtctagaacagcttttcagtgagcatggtaaagttgtggaagctagggtggtttacgaccgtgagacaggtcgttcacgtggattcgggtttgtcacaatgtctgacgtggatgaactcaacgaagccatctctgccctcgatggacagaacttggagggtagagcaatcagagtgaatgtagcggaagagcgtcctccaaggcgtggatattaaagctgagatctagctgtgccctctctctctccctatcttgcattttgtttagacgagattcttacactcttcaacgattgtttttggctgaactctgaatgtgaaagttaagctgcttctaaagtaatttgtatcgcttgtttttgatgaaaaaaaaaaaaaaaaaaaaaaaaaaaaaactcgagggggggcccggtac

SEQ ID NO: 2724 - protein, 1322 aa, Arabidopsis thaliana
  misc_feature: PFam Name: RRM_1; PFam Description: RNA recognition motif.
  misc_feature: GI Number: 23505889; NR Description: At4g24770/F22K18_30 [Arabidopsis thaliana] >gi|15294254|gb|AAK95304.1|
  misc_feature: GI Number: 510240; NR Description: RNA binding protein [Arabidopsis thaliana] >gi|629557|pir||S49030 RNA-binding protein
  misc_feature: GI Number: 475719; NR Description: RNA-binding protein 2
  misc_feature: GI Number: 16490; NR Description: RNA-binding protein [Arabidopsis thaliana] >gi|7269328|emb|CAB79387.1| RNA-binding protein RNP-T precursor [Arabidopsis thaliana] >gi|4220513|emb|CAA22986.1| RNA-binding protein RNP-T precursor
  misc_feature: GI Number: 681908; NR Description: cp31 [Arabidopsis thaliana]
CCCCCCCCCCGATTTGAAGATGATGTCTCGGCCCTCCTTATCCTTATCTCGCCCACCGTTCTAAAACCCTTCCCTTCCTCTTCTTTTCTCTTCTCCTTCCACTTCCACTTCTTCTATCTCTCACAATTCAGCAATGGCTTCTTCTATAGTTACCTCTAGCTTGAAGCCTTTAGCCATGGCCGATTCTACCTCTTCTACCATTTTCTCCCATCCTTCCATCTCCTCTACCATCTCTTCCTCCAGAATTCGCAGCTCCAGTGTTTCCCTCCTTACCGGACGCATTAACCTGCCCCTCTCTTTCTCTCGCGTCTCTCTATCTCTTAAAACCAAAACCCACCTTAAAAAATCCCCCTTTGTCTCCTTCGTTGCCCAGACTTCGGATTGGGCTGAAGAAGGTGGAGAAGGAAGCGTCGCTGTTGAGGAGACCGAGAACAGTTTAGAGTCACAAGATGTGAGCGAAGGAGATGAGAGCGAAGGAGATGTGAGCGAAGGAGATGTGAGCGAAGGAGATGAGAGCGAAGGAGATGTGAGCGAAGGAGCTGTGAGCGAAAGAGCTGAGTTCCCGGAGCCATCGGAAGAAGCCAAGCTTTTCGTCGGAAATTTGGCTTATGATGTTAATAGCCAAGCTTTGGCTATGCTCTTTGAGCAAGCCGGTACTGTTGAAATCGCCGAGGTTATATACAATAGGGAAACTGACCAGAGTCGTGGGTTTGGATTTGTGACAATGAGTTCTGTGGACGAAGCTGAGACAGCTGTGGAGAAGTTCAACCGTTATGATCTTAACGGACGTCTACTAACTGTAAACAAGGCAGCTCCAAGAGGATCACGTCCAGAACGTGCGCCTCGGGTATATGAACCTGCATTCAGAGTATATGTAGGGAATCTACCATGGGATGTGGACAATGGCCGTCTAGAACAGCTTTTCAGTGAGCATGGTAAAGTTGTGGAAGCTAGGGTGGTTTACGACCGTGAGACAGGTCGTTCACGTGGATTCGGGTTTGTCACAATGTCTGACGTGGATGAACTCAACGAAGCCATCTCTGCCCTCGATGGACAGAACTTGGAGGGTAGAGCAATCAGAGTGAATGTAGCGGAAGAGCGTCCTCCAAGGCGTGGATATTAAAGCTGAGATCTAGCTGTGCCCTCTCTCTCTCCCTATCTTGCATTTTGTTTAGACGAGATTCTTACACTCTTCAACGATTGTTTTTGGCTGAACTCTGAATGTGAAAGTTAAGCTGCTTCTAAAGTAATTTGTATCGCTTGTTTTTGATGAAAAAAAAAAAAAAAAAAAAAAAAAAAAAACTCGAGGGGGGGCCCGGTAC

SEQ ID NO: 2725 - DNA, 2045 bp, Arabidopsis thaliana
  misc_feature (1)..(2045): Ceres cDNA ID no. 13646629
  misc_feature (1)..(2045): Ceres CLONE  ID no. 1148635
  misc_feature (1)..(2045): Also known as  Ceres CDNA ID no. 23656195
atcagagagttctttctcaaaaactatttacacatcaaaaataaaatcaaaataaattgttgtgatcatagagttctcttgcaccaatgagtgctccaaagtttggttatgtattactattgattgtattaatcaatattagcaataatggcgtcgatgcatttcacaaagttttcaagaaattgcaatcaaaatcgacatcattggagtcagtaagtcctcttcacagaaccgcttatcactttcaacctccccgccattggatcaacgatccgaatgctccaatgctctacaagggagtttaccatctcttctaccaatacaatcccaaaggtgcggtttggggtaacattgtgtgggctcactcggtttctaaggacttgatcaattgggaagcccttgaaccagccatttacccatccaaatggttcgacatcaacggtacatggtccggttcagctacccacgtaccgggaaaaggaccggttatcctctacaccggtatcaccgagaaccagactcagattcaaaactacgccattccacaagatctttccgacccatacctcaagacatggataaagccagacgataaccccatcgtaaaacccgataatggcgagaacggatccgctttccgtgacccgaccacggcttggttcaacaaaaaagatgggtattggagaatgcttgttggctcaaagagaaagaacagaggaattgcttatatgtacaagagccgtgacttcaaaaaatgggtcaaaagcaaacgtcctatccactcaagaaagaaaaccggtatgtgggaatgtcccgatttcttcccggtatccgtaaccgacaagaaaaacggtttggacttcagctacgacggtccaaacgccaagcatgtgttgaaggttagtttggacttgaccagatacgagtactacactcttggaacgtatgacaccaagaaggatcgttacaggccagacagttacactcctgacggttgggatggtttgagatttgattatggtaactactatgcgtcaaagacattctttgatgacaagacgaacagaagaattctttgggggtgggccaatgaatccgacaccgttcaagatgataccgtgaagggttgggccggaattcagcttatcccaagaacaatcttgcttgactctagcggtaagcaactcgtgttttggcctattgaagagattgagtcattgagaggaaagaatgtccaaatgaccaaccagaaaatggagatgggccaacgctttgaggtccaaggaatcactcctgctcaggtggatgtggatgtgacattcaacgttggaaatctagagaaggccgaaaagtttgacgaaagcttcgcaactaaaccactagagttatgtaacttgaaaggttcgaatgtgaatggtggagttggtccttttggtttgatcacgttggctacatctgacttagaagaatacactcctgttttctttagagtcttcaaagatgccgcatccaacaagcctaaggttctcatgtgctctgacgccaagccttcgagtctcaaaaaagacaccgggactgacgccaaggagaggatgtacaaaccatcgtttgctggttttgtggatgtcggtctccttgacggaaagatctctctaaggagtttgattgatcactcggttgtggagagctttggagcaaaaggaaagacagtgataacatctagagtgtatccgacaaaagcagtaggagaaaaagctcatttgtttgtctttaacaacggctcacaacctgtgaccgtagagagcctcaatgcatggaacatgcagaagcctctgaagatgaaccaaggtgcaaagtgatcacatcattctttaattttttcgttgacaaatttaattcattcgttaaaacagagagtctgtcacaatatattgtagaaaaaaggaacctattgtgtttcttttacaatcaatacaatttgtacatagtttatcactactaacaaagtattgatcttatattttattaatgaaacacgtttcctt

SEQ ID NO: 2726 - protein, 2045 aa, Arabidopsis thaliana
  misc_feature: PFam Name: Glyco_hydro_32; PFam Description: Glycosyl
  misc_feature: GI Number: 5052007; NR Description: apoplastic invertase
  misc_feature: GI Number: 4886267; NR Description: beta-fructofuranosidase [Arabidopsis thaliana] >gi|7435478|pir||T08439
  misc_feature: GI Number: 18324; NR Description: beta-fructofuranosidase [Daucus carota] >gi|2129916|pir||S61503 beta-fructofuranosidase (EC
  misc_feature: GI Number: 397631; NR Description: beta-fructofuranosidase [Solanum tuberosum] >gi|480566|pir||S37047 beta-fructofuranosidase
  misc_feature: GI Number: 30693668; NR Description: beta-fructosidase,
ATCAGAGAGTTCTTTCTCAAAAACTATTTACACATCAAAAATAAAATCAAAATAAATTGTTGTGATCATAGAGTTCTCTTGCACCAATGAGTGCTCCAAAGTTTGGTTATGTATTACTATTGATTGTATTAATCAATATTAGCAATAATGGCGTCGATGCATTTCACAAAGTTTTCAAGAAATTGCAATCAAAATCGACATCATTGGAGTCAGTAAGTCCTCTTCACAGAACCGCTTATCACTTTCAACCTCCCCGCCATTGGATCAACGATCCGAATGCTCCAATGCTCTACAAGGGAGTTTACCATCTCTTCTACCAATACAATCCCAAAGGTGCGGTTTGGGGTAACATTGTGTGGGCTCACTCGGTTTCTAAGGACTTGATCAATTGGGAAGCCCTTGAACCAGCCATTTACCCATCCAAATGGTTCGACATCAACGGTACATGGTCCGGTTCAGCTACCCACGTACCGGGAAAAGGACCGGTTATCCTCTACACCGGTATCACCGAGAACCAGACTCAGATTCAAAACTACGCCATTCCACAAGATCTTTCCGACCCATACCTCAAGACATGGATAAAGCCAGACGATAACCCCATCGTAAAACCCGATAATGGCGAGAACGGATCCGCTTTCCGTGACCCGACCACGGCTTGGTTCAACAAAAAAGATGGGTATTGGAGAATGCTTGTTGGCTCAAAGAGAAAGAACAGAGGAATTGCTTATATGTACAAGAGCCGTGACTTCAAAAAATGGGTCAAAAGCAAACGTCCTATCCACTCAAGAAAGAAAACCGGTATGTGGGAATGTCCCGATTTCTTCCCGGTATCCGTAACCGACAAGAAAAACGGTTTGGACTTCAGCTACGACGGTCCAAACGCCAAGCATGTGTTGAAGGTTAGTTTGGACTTGACCAGATACGAGTACTACACTCTTGGAACGTATGACACCAAGAAGGATCGTTACAGGCCAGACAGTTACACTCCTGACGGTTGGGATGGTTTGAGATTTGATTATGGTAACTACTATGCGTCAAAGACATTCTTTGATGACAAGACGAACAGAAGAATTCTTTGGGGGTGGGCCAATGAATCCGACACCGTTCAAGATGATACCGTGAAGGGTTGGGCCGGAATTCAGCTTATCCCAAGAACAATCTTGCTTGACTCTAGCGGTAAGCAACTCGTGTTTTGGCCTATTGAAGAGATTGAGTCATTGAGAGGAAAGAATGTCCAAATGACCAACCAGAAAATGGAGATGGGCCAACGCTTTGAGGTCCAAGGAATCACTCCTGCTCAGGTGGATGTGGATGTGACATTCAACGTTGGAAATCTAGAGAAGGCCGAAAAGTTTGACGAAAGCTTCGCAACTAAACCACTAGAGTTATGTAACTTGAAAGGTTCGAATGTGAATGGTGGAGTTGGTCCTTTTGGTTTGATCACGTTGGCTACATCTGACTTAGAAGAATACACTCCTGTTTTCTTTAGAGTCTTCAAAGATGCCGCATCCAACAAGCCTAAGGTTCTCATGTGCTCTGACGCCAAGCCTTCGAGTCTCAAAAAAGACACCGGGACTGACGCCAAGGAGAGGATGTACAAACCATCGTTTGCTGGTTTTGTGGATGTCGGTCTCCTTGACGGAAAGATCTCTCTAAGGAGTTTGATTGATCACTCGGTTGTGGAGAGCTTTGGAGCAAAAGGAAAGACAGTGATAACATCTAGAGTGTATCCGACAAAAGCAGTAGGAGAAAAAGCTCATTTGTTTGTCTTTAACAACGGCTCACAACCTGTGACCGTAGAGAGCCTCAATGCATGGAACATGCAGAAGCCTCTGAAGATGAACCAAGGTGCAAAGTGATCACATCATTCTTTAATTTTTTCGTTGACAAATTTAATTCATTCGTTAAAACAGAGAGTCTGTCACAATATATTGTAGAAAAAAGGAACCTATTGTGTTTCTTTTACAATCAATACAATTTGTACATAGTTTATCACTACTAACAAAGTATTGATCTTATATTTTATTAATGAAACACGTTTCCTT

SEQ ID NO: 2727 - DNA, 1784 bp, Arabidopsis thaliana
  misc_feature (1)..(1784): Ceres cDNA ID no. 13646633
  misc_feature (1)..(1784): Ceres CLONE  ID no. 1342374
  misc_feature (1)..(1784): Also known as  Ceres CDNA ID no. 23656245
gaaacgatcattttctaggaaaacgaacgaacagaggacaaatatattagataaacagagggaaacaagaacaaaaacgtttgcttcattctctaatggcagccaccacgagacggttgctttactctgtgtccaaaagattctctaccgccggagtgcggcggagctatggcggtctgccacaatcgaattccaaatctcctccgtcttcttctcaacgattgatggaattggaatctgaattcagtgcccacaattaccatcctgttccggttgtgttttctcgcgcgaatggctcaactatatgggaccctgaaggaaagagatacattgattttcttgcagcttactctgcagttaatcagggacattgtcatcctaagatcatgaaggcattgcaggaacaagtggagaagctcactttaagttcacgagcgttttacaacgataaattcccggtatttgctgagcgtctcacaaacatgttcggttatgatatggtgcttcctatgaacacgggtgctgaaggtgtcgaaactgctttgaaactagcaagaaaatggggtcatgaaaagaaaaatattcccaaagacgaggctatcattgtctcttgttgtggctgctttcatggacgtacattagcaattgtttccatgagttgtgacaatgatgctactcgtggattcgggccattgttgccagggaatcttaaagttgattttggtgatgcggattcacttgagaaaatctttaaagaaaagggagatagaatagcgggatttctattcgagcctattcaaggcgaagctggagttattattcctcccgacggttacttgaaagctgttagagaactctgcacaaaatacaatgttttgatgatagcggatgaagtacaaagcggtctggctagatccgggaagatgctagcttgtgattgggaagaaattcgtcctgacatggtgatacttgggaaagcattaggtggaggagtaattccagtaagtgcagtgcttgctgataaagacgtgatgcttcatataaaacctggtcaacacggaagcacatttggtggtaaccctttagctagtgctgtagctatggcttctttagacgttatcgtggaagaaaaactcgttgaaagatcagcaagtcttggagaggaactgaggattcaattgaatgaaatcaagaaacagtttccgaagtacataaaggaagtacgaggaagaggcttgtttaatgcgattgagttcaatagcgaaagcttgtccccggtttcagcttacgatatttgcttgagcttgaaggagagaggagtcttggctaaacctactcacaacactattgtccggttaactccaccactctctataagctctgatgaactccgagatggatctgaggctcttcacgatgtactcgagctcgatcttccaaatctgctgaaaatcaattccggtaaaactccggtttctcatataaccgagtgtgatcgctgtggaagaaacctctatgcttgaaccggtttgaaacttgattaggttctggtataattagattctttgtatcttgtgatttccataggacacagcaccggtttggtataagaaatatattaaagtataaggccgaaccggattgtaccgagcttggtagaaataactctggtttatttctggtttggcattaaataaaaccaacataaaataatatgatgcctgttttcataggtgttatacatgatatctcaacaaacaaataaatgttacataacaatatgt

SEQ ID NO: 2728 - protein, 1784 aa, Arabidopsis thaliana
  misc_feature: PFam Name: Aminotran_3; PFam Description: Aminotransferase
  misc_feature: GI Number: 9757738; NR Description: ornithine aminotransferase [Arabidopsis thaliana] >gi|15237392|ref|NP_199430.1| ornithine aminotransferase, putative / ornithine--oxo-acid aminotransferase, putative [Arabidopsis
  misc_feature: GI Number: 27527063; NR Description: ornithine
  misc_feature: GI Number: 9957234; NR Description: ornithine
  misc_feature: GI Number: 53749407; NR Description: ornithine--oxo-acid
  misc_feature: GI Number: 60465399; NR Description: ornithine-oxo-acid
GAAACGATCATTTTCTAGGAAAACGAACGAACAGAGGACAAATATATTAGATAAACAGAGGGAAACAAGAACAAAAACGTTTGCTTCATTCTCTAATGGCAGCCACCACGAGACGGTTGCTTTACTCTGTGTCCAAAAGATTCTCTACCGCCGGAGTGCGGCGGAGCTATGGCGGTCTGCCACAATCGAATTCCAAATCTCCTCCGTCTTCTTCTCAACGATTGATGGAATTGGAATCTGAATTCAGTGCCCACAATTACCATCCTGTTCCGGTTGTGTTTTCTCGCGCGAATGGCTCAACTATATGGGACCCTGAAGGAAAGAGATACATTGATTTTCTTGCAGCTTACTCTGCAGTTAATCAGGGACATTGTCATCCTAAGATCATGAAGGCATTGCAGGAACAAGTGGAGAAGCTCACTTTAAGTTCACGAGCGTTTTACAACGATAAATTCCCGGTATTTGCTGAGCGTCTCACAAACATGTTCGGTTATGATATGGTGCTTCCTATGAACACGGGTGCTGAAGGTGTCGAAACTGCTTTGAAACTAGCAAGAAAATGGGGTCATGAAAAGAAAAATATTCCCAAAGACGAGGCTATCATTGTCTCTTGTTGTGGCTGCTTTCATGGACGTACATTAGCAATTGTTTCCATGAGTTGTGACAATGATGCTACTCGTGGATTCGGGCCATTGTTGCCAGGGAATCTTAAAGTTGATTTTGGTGATGCGGATTCACTTGAGAAAATCTTTAAAGAAAAGGGAGATAGAATAGCGGGATTTCTATTCGAGCCTATTCAAGGCGAAGCTGGAGTTATTATTCCTCCCGACGGTTACTTGAAAGCTGTTAGAGAACTCTGCACAAAATACAATGTTTTGATGATAGCGGATGAAGTACAAAGCGGTCTGGCTAGATCCGGGAAGATGCTAGCTTGTGATTGGGAAGAAATTCGTCCTGACATGGTGATACTTGGGAAAGCATTAGGTGGAGGAGTAATTCCAGTAAGTGCAGTGCTTGCTGATAAAGACGTGATGCTTCATATAAAACCTGGTCAACACGGAAGCACATTTGGTGGTAACCCTTTAGCTAGTGCTGTAGCTATGGCTTCTTTAGACGTTATCGTGGAAGAAAAACTCGTTGAAAGATCAGCAAGTCTTGGAGAGGAACTGAGGATTCAATTGAATGAAATCAAGAAACAGTTTCCGAAGTACATAAAGGAAGTACGAGGAAGAGGCTTGTTTAATGCGATTGAGTTCAATAGCGAAAGCTTGTCCCCGGTTTCAGCTTACGATATTTGCTTGAGCTTGAAGGAGAGAGGAGTCTTGGCTAAACCTACTCACAACACTATTGTCCGGTTAACTCCACCACTCTCTATAAGCTCTGATGAACTCCGAGATGGATCTGAGGCTCTTCACGATGTACTCGAGCTCGATCTTCCAAATCTGCTGAAAATCAATTCCGGTAAAACTCCGGTTTCTCATATAACCGAGTGTGATCGCTGTGGAAGAAACCTCTATGCTTGAACCGGTTTGAAACTTGATTAGGTTCTGGTATAATTAGATTCTTTGTATCTTGTGATTTCCATAGGACACAGCACCGGTTTGGTATAAGAAATATATTAAAGTATAAGGCCGAACCGGATTGTACCGAGCTTGGTAGAAATAACTCTGGTTTATTTCTGGTTTGGCATTAAATAAAACCAACATAAAATAATATGATGCCTGTTTTCATAGGTGTTATACATGATATCTCAACAAACAAATAAATGTTACATAACAATATGT

SEQ ID NO: 2729 - DNA, 1270 bp, Arabidopsis thaliana
  misc_feature (1)..(1270): Ceres cDNA ID no. 13646637
  misc_feature (1)..(1270): Ceres CLONE  ID no. 1148706
  misc_feature (1)..(1270): Also known as  Ceres CDNA ID no. 23655775
  misc_feature (1269)..(1269): n is a, c, t, g, unknown, or other
gacttttatccyctcactctctaatggcttcttcttctctacctctttctcttccgtttccactcagatctcttactagtaccagtcgatctctaccatttcaatgttctcctctctttttctctattccttcttcaatcgtttgcttctccactcaaaatcccgaccgcgaagaggtccggtggctccgggaagagcagagatggattcgcgaggagcaacgatggattcgtgaagaacagagatggatacgcgaacgtgaatcgcttctacaatagatttcggatctacagctcagaattcaatccctagagtcacgaaattcgcaattggggaattctattcccgatacgatttcgaatatcgctgctttgcttcaggttttgaaggagaagaatcggatttctgagagtggattgagcgcaacgccgatggtattggagagtacgagagaacaaattattgaggaggtggaagaagaagagaagcgagtgattattgctgaagagaaagttagggtttcggagccggtgaagaagatcaagaggaggatattgaaagttggaagcgaaggcgacgatgttcaagctttgcagctctgttgaaattaggattctattcgggcgaagaggatatggagttctcgagcttttcaagtgggactgcaagtgctgttaagacttggcaagcatcgcttggggtccgtgaggatggggtaatgacagcagagcttcttcagaggttgttcatggatgaagacgtagagacagataaggatgaagcaagtacaatgaagaaagagatgggaagatccctccaggctcattggcaggaacaaaccggtagacagaagtgaatcaacaaacaccaaaacgaggtgcatcacttgtcgaggggagggtcgattgatgtgcctagagtgcgatggaaccggtgagcaacattgagccgcagttcatggagtgggttggtgaagatacgaagtgtccgtactgtgaaggtcttggctatacagtttgcgatgtctgcgacggcaaaaaaaacttataataatgattcatatttaatttaatgaaaaaacaaattagtttgttttccaaatcgcataatatggttgtttaagagagatatatatataaatttagtgaaaaagtacgtatgttagtttgtttttcrsttaaaaaaaaaaaaaaaaaaaaaaaaaaaaaaaaaaaaaaaaaaaaaaaaaaaggaaaaaaaaaaaaaaaaaaactcgrgggggggcccggna

SEQ ID NO: 2730 - protein, 1270 aa, Arabidopsis thaliana
  misc_feature: PFam Name: PG_binding_1; PFam Description: Putative
  misc_feature: GI Number: 30682566; NR Description: peptidoglycan-binding
GACTTTTATCCYCTCACTCTCTAATGGCTTCTTCTTCTCTACCTCTTTCTCTTCCGTTTCCACTCAGATCTCTTACTAGTACCAGTCGATCTCTACCATTTCAATGTTCTCCTCTCTTTTTCTCTATTCCTTCTTCAATCGTTTGCTTCTCCACTCAAAATCCCGACCGCGAAGAGGTCCGGTGGCTCCGGGAAGAGCAGAGATGGATTCGCGAGGAGCAACGATGGATTCGTGAAGAACAGAGATGGATACGCGAACGTGAATCGCTTCTACAATAGATTTCGGATCTACAGCTCAGAATTCAATCCCTAGAGTCACGAAATTCGCAATTGGGGAATTCTATTCCCGATACGATTTCGAATATCGCTGCTTTGCTTCAGGTTTTGAAGGAGAAGAATCGGATTTCTGAGAGTGGATTGAGCGCAACGCCGATGGTATTGGAGAGTACGAGAGAACAAATTATTGAGGAGGTGGAAGAAGAAGAGAAGCGAGTGATTATTGCTGAAGAGAAAGTTAGGGTTTCGGAGCCGGTGAAGAAGATCAAGAGGAGGATATTGAAAGTTGGAAGCGAAGGCGACGATGTTCAAGCTTTGCAGCTCTGTTGAAATTAGGATTCTATTCGGGCGAAGAGGATATGGAGTTCTCGAGCTTTTCAAGTGGGACTGCAAGTGCTGTTAAGACTTGGCAAGCATCGCTTGGGGTCCGTGAGGATGGGGTAATGACAGCAGAGCTTCTTCAGAGGTTGTTCATGGATGAAGACGTAGAGACAGATAAGGATGAAGCAAGTACAATGAAGAAAGAGATGGGAAGATCCCTCCAGGCTCATTGGCAGGAACAAACCGGTAGACAGAAGTGAATCAACAAACACCAAAACGAGGTGCATCACTTGTCGAGGGGAGGGTCGATTGATGTGCCTAGAGTGCGATGGAACCGGTGAGCAACATTGAGCCGCAGTTCATGGAGTGGGTTGGTGAAGATACGAAGTGTCCGTACTGTGAAGGTCTTGGCTATACAGTTTGCGATGTCTGCGACGGCAAAAAAAACTTATAATAATGATTCATATTTAATTTAATGAAAAAACAAATTAGTTTGTTTTCCAAATCGCATAATATGGTTGTTTAAGAGAGATATATATATAAATTTAGTGAAAAAGTACGTATGTTAGTTTGTTTTTCRSTTAAAAAAAAAAAAAAAAAAAAAAAAAAAAAAAAAAAAAAAAAAAAAAAAAAAGGAAAAAAAAAAAAAAAAAAACTCGRGGGGGGGCCCGGNA

SEQ ID NO: 2731 - DNA, 1942 bp, Arabidopsis thaliana
  misc_feature (1)..(1942): Ceres cDNA ID no. 13646960
  misc_feature (1)..(1942): Ceres CLONE  ID no. 1198559
  misc_feature (1)..(1942): Also known as  Ceres CDNA ID no. 23656432
gatcatttcctgaaaactagaaaacacagtttaaagggaacataaaaagcaactctttgagagatcagagaaaccctaatttgctaagaaccctaatctcaatttccatcttccaaagttcagattctgtatgtaaatgcatctgaagaattctactgtagcagaacggcggtacatcggaaaagaaaccgccggttatttaacttcttcctccgatttggatccgaaacctaagattaaacatcatcgtcctcttcaggtacctgagattttgactccagacattggtgctggtgctggattcagtgtgtataataatcaagttcaagctcagagtcgtcatcatctgacggttgaaatcccagattcatcgtctcacaatcttacatctaagagacctgtggtggttcaatcttctaatccgttcaacgttgacgatttccgaagacaacaacgcgcaagcttgggtccgatttcatcttattgtccgtcgtatcttttatcgtggttttcttcttctcttccatcgatccatcggccactaatcagaagcttctccgtcatgttcttagaattcttccttctctttgtcttctcgattatcgctttttctttcgtcctttcgatctctctcaaattcgctcttcctcacttaccatcgattcgtttgattatcgctcggttactttctctcaagcttacccctaccagatcatcctcttcatctcaggagaacactaaacatgttatttggtcaattgggtctaagcctgtgactgagaagaagaccagctctggctcatgggttcagaagtacagctctggtgatgtatacgagggagagtttcatagggggaagtgttcaggaagtggagtttattactattctatgaagggtaaatacgaaggggattggattgatgggaagtatgatggatatggagttgaaacttgggctaaagggagtaggtaccgaggtcaatacaggcaagggatgagacatggaactggtatctacagattttatacaggggatgtatatgctggtgagtggtctaatggacagagccatggctgtggtgtgtatacctctgaggatggtagtcgttttgttggagagtttaaatggggtgtcaaacatggccttggtcattatcatttcaggatgcatggttttggagtgtatcaatttggaaacgggcatcggtatgaaggagcctggcatgaggggagaaggcaaggacttggtatgtacacgttcaggaatggtgagacacaggcaggccattgggaagacggagttcttaactgtcctaccgagcagaccactcgccctgattcatcgttttccatcagtcattccaaggttgtcgacactgtccagcaagcaaggaaagcagccaagaaagcacgcgaagttgtgaaagttgaagagagagtgaacagagcagtgatggtcgcaaaccgagcagcaaatgctgctagagttgctgctacaaaggctgtccaaacccaaacatttcattgtagtagtggtgacgatcccttgtgaattcctgcggcaaagattttgacataatcgcagtcatgaccttacctcaaacttctacgaagacagaagagtgaaagagagatgtttagagaacagagtcagaattcgcaatctccgttgagattttcttgaaggtgaaccacttggaaccaatatcgagatctcataagtaataagtaagagatctggctatggagcaagtattactggtttactttttcttttctcccacttgttttatgagcaggctggtttaaaactgtacataggttgttgaagagtaagcaatgtgtgttaacaaaagatctttgtaacaagcgtaatccatgtaagagaagtaacaaaacattgttttacttttacaacgtgttgaaaataacaccttttttt

SEQ ID NO: 2732 - protein, 1942 aa, Arabidopsis thaliana
  misc_feature: PFam Name: MORN; PFam Description: MORN repeat
  misc_feature: GI Number: 21928129; NR Description: AT4g17080/dl4570w [Arabidopsis thaliana] >gi|27764944|gb|AAO23593.1|
  misc_feature: GI Number: 37536922; NR Description: putative phosphatidylinositol-4-phosphate 5-kinase [Oryza sativa (japonica cultivar-group)] >gi|12597886|gb|AAG60194.1| putative phosphatidylinositol-4-phosphate 5-kinase [Oryza sativa]
  misc_feature: GI Number: 51535948; NR Description: 1-phosphatidylinositol-4-phosphate 5-kinase-like protein [Oryza
  misc_feature: GI Number: 23297433; NR Description: putative phosphatidylinositol-4-phosphate 5-kinase [Arabidopsis thaliana] >gi|13878045|gb|AAK44100.1| putative phosphatidylinositol-4-phosphate 5-kinase [Arabidopsis thaliana]
  misc_feature: GI Number: 21593251; NR Description: phosphatidylinositol-4-phosphate 5-kinase, putative [Arabidopsis
GATCATTTCCTGAAAACTAGAAAACACAGTTTAAAGGGAACATAAAAAGCAACTCTTTGAGAGATCAGAGAAACCCTAATTTGCTAAGAACCCTAATCTCAATTTCCATCTTCCAAAGTTCAGATTCTGTATGTAAATGCATCTGAAGAATTCTACTGTAGCAGAACGGCGGTACATCGGAAAAGAAACCGCCGGTTATTTAACTTCTTCCTCCGATTTGGATCCGAAACCTAAGATTAAACATCATCGTCCTCTTCAGGTACCTGAGATTTTGACTCCAGACATTGGTGCTGGTGCTGGATTCAGTGTGTATAATAATCAAGTTCAAGCTCAGAGTCGTCATCATCTGACGGTTGAAATCCCAGATTCATCGTCTCACAATCTTACATCTAAGAGACCTGTGGTGGTTCAATCTTCTAATCCGTTCAACGTTGACGATTTCCGAAGACAACAACGCGCAAGCTTGGGTCCGATTTCATCTTATTGTCCGTCGTATCTTTTATCGTGGTTTTCTTCTTCTCTTCCATCGATCCATCGGCCACTAATCAGAAGCTTCTCCGTCATGTTCTTAGAATTCTTCCTTCTCTTTGTCTTCTCGATTATCGCTTTTTCTTTCGTCCTTTCGATCTCTCTCAAATTCGCTCTTCCTCACTTACCATCGATTCGTTTGATTATCGCTCGGTTACTTTCTCTCAAGCTTACCCCTACCAGATCATCCTCTTCATCTCAGGAGAACACTAAACATGTTATTTGGTCAATTGGGTCTAAGCCTGTGACTGAGAAGAAGACCAGCTCTGGCTCATGGGTTCAGAAGTACAGCTCTGGTGATGTATACGAGGGAGAGTTTCATAGGGGGAAGTGTTCAGGAAGTGGAGTTTATTACTATTCTATGAAGGGTAAATACGAAGGGGATTGGATTGATGGGAAGTATGATGGATATGGAGTTGAAACTTGGGCTAAAGGGAGTAGGTACCGAGGTCAATACAGGCAAGGGATGAGACATGGAACTGGTATCTACAGATTTTATACAGGGGATGTATATGCTGGTGAGTGGTCTAATGGACAGAGCCATGGCTGTGGTGTGTATACCTCTGAGGATGGTAGTCGTTTTGTTGGAGAGTTTAAATGGGGTGTCAAACATGGCCTTGGTCATTATCATTTCAGGATGCATGGTTTTGGAGTGTATCAATTTGGAAACGGGCATCGGTATGAAGGAGCCTGGCATGAGGGGAGAAGGCAAGGACTTGGTATGTACACGTTCAGGAATGGTGAGACACAGGCAGGCCATTGGGAAGACGGAGTTCTTAACTGTCCTACCGAGCAGACCACTCGCCCTGATTCATCGTTTTCCATCAGTCATTCCAAGGTTGTCGACACTGTCCAGCAAGCAAGGAAAGCAGCCAAGAAAGCACGCGAAGTTGTGAAAGTTGAAGAGAGAGTGAACAGAGCAGTGATGGTCGCAAACCGAGCAGCAAATGCTGCTAGAGTTGCTGCTACAAAGGCTGTCCAAACCCAAACATTTCATTGTAGTAGTGGTGACGATCCCTTGTGAATTCCTGCGGCAAAGATTTTGACATAATCGCAGTCATGACCTTACCTCAAACTTCTACGAAGACAGAAGAGTGAAAGAGAGATGTTTAGAGAACAGAGTCAGAATTCGCAATCTCCGTTGAGATTTTCTTGAAGGTGAACCACTTGGAACCAATATCGAGATCTCATAAGTAATAAGTAAGAGATCTGGCTATGGAGCAAGTATTACTGGTTTACTTTTTCTTTTCTCCCACTTGTTTTATGAGCAGGCTGGTTTAAAACTGTACATAGGTTGTTGAAGAGTAAGCAATGTGTGTTAACAAAAGATCTTTGTAACAAGCGTAATCCATGTAAGAGAAGTAACAAAACATTGTTTTACTTTTACAACGTGTTGAAAATAACACCTTTTTTT

SEQ ID NO: 2733 - DNA, 1167 bp, Arabidopsis thaliana
  misc_feature (1)..(1167): Ceres cDNA ID no. 13647079
  misc_feature (1)..(1167): Ceres CLONE  ID no. 26742
  misc_feature (1)..(1167): Also known as  Ceres CDNA ID no. 23558244
accttacgctgttcttcccctttccttccgaaattagggcttccgtgtttcgcagtgctctccttcaatccccagcttgacaatgcctcgctatgatgatcgctatgggaacactcgtctctacgttggccgattatcatcgagaactaggacccgagaccttgaacgtctttttagcagatacggaagagtgcgagatgtggatatgaagcgagattatgctttcgttgaatttggtgatccccgtgatgctgatgatgcaagacattacctggacggacgagactttgatggaagtcgcatcactgtggagttttcacgaggggcacctcgtggttctcgggattttgatagcagaggcccaccacctggagctggtcgctgttttaactgtggtgtagatggtcattgggctcgtgactgcacagcaggggactggaagaacaagtgttaccgttgtggagagagatgacacattgagagaaactgcaaaaacagccccaagaagcttaggcgcagtggaagctactccaggtcacctgtaagatcccgttctcctcgtcgtagaagaagcccaagccggagtcttagccgtagccgaagctacagccgatcacgatccccggtgagaagaagagagaggagtgtggaggagagatcacgcagtccaaagcggatggatgactctctatcgccaagagccagagatcgtagtccggttcttgatgatgaaggcagcccaaagatcatagacgggagcccaccaccatcaccaaagcttcaaaaggaagtcggatctgaccgtgacggtggtagcccccaagacaatggcagaaactctgttgtcagtcctgttgtaggagccggtggtgacagttcgaaagaggaccggagccctgttgatgatgattacgagccaaaccgcacttcccctagaggaagtgagtctccttaactttgatggctcatggccacggcttgcaggcattgtagcatgtatactattggatcgactgttcctttctcttttaagtgtgtttgctttagaaccttttaagtttcatgttaccaagagttttttcatttgagacataatgttgttgcgtttcttttggacaatttttcgaagattgttataaggatttataaaagtttcaatctgaggag

SEQ ID NO: 2734 - protein, 1167 aa, Arabidopsis thaliana
  misc_feature: PFam Name: RRM_1; PFam Description: RNA recognition motif.
  misc_feature: PFam Name: zf-CCHC; PFam Description: Zinc knuckle
  misc_feature: GI Number: 9843663; NR Description: splicing factor RSZ33
  misc_feature: GI Number: 42571091; NR Description: splicing factor RSZ33
  misc_feature: GI Number: 9795142; NR Description: splicing factor-like protein [Arabidopsis thaliana] >gi|30693839|ref|NP_190918.3| zinc
  misc_feature: GI Number: 24111329; NR Description: At3g53500/F4P12_200 [Arabidopsis thaliana] >gi|20465265|gb|AAM19952.1| AT3g53500/F4P12_200 [Arabidopsis thaliana] >gi|30693836|ref|NP_851015.1| zinc knuckle (CCHC-type) family
  misc_feature: GI Number: 11346381; NR Description: splicing factor-like
ACCTTACGCTGTTCTTCCCCTTTCCTTCCGAAATTAGGGCTTCCGTGTTTCGCAGTGCTCTCCTTCAATCCCCAGCTTGACAATGCCTCGCTATGATGATCGCTATGGGAACACTCGTCTCTACGTTGGCCGATTATCATCGAGAACTAGGACCCGAGACCTTGAACGTCTTTTTAGCAGATACGGAAGAGTGCGAGATGTGGATATGAAGCGAGATTATGCTTTCGTTGAATTTGGTGATCCCCGTGATGCTGATGATGCAAGACATTACCTGGACGGACGAGACTTTGATGGAAGTCGCATCACTGTGGAGTTTTCACGAGGGGCACCTCGTGGTTCTCGGGATTTTGATAGCAGAGGCCCACCACCTGGAGCTGGTCGCTGTTTTAACTGTGGTGTAGATGGTCATTGGGCTCGTGACTGCACAGCAGGGGACTGGAAGAACAAGTGTTACCGTTGTGGAGAGAGATGACACATTGAGAGAAACTGCAAAAACAGCCCCAAGAAGCTTAGGCGCAGTGGAAGCTACTCCAGGTCACCTGTAAGATCCCGTTCTCCTCGTCGTAGAAGAAGCCCAAGCCGGAGTCTTAGCCGTAGCCGAAGCTACAGCCGATCACGATCCCCGGTGAGAAGAAGAGAGAGGAGTGTGGAGGAGAGATCACGCAGTCCAAAGCGGATGGATGACTCTCTATCGCCAAGAGCCAGAGATCGTAGTCCGGTTCTTGATGATGAAGGCAGCCCAAAGATCATAGACGGGAGCCCACCACCATCACCAAAGCTTCAAAAGGAAGTCGGATCTGACCGTGACGGTGGTAGCCCCCAAGACAATGGCAGAAACTCTGTTGTCAGTCCTGTTGTAGGAGCCGGTGGTGACAGTTCGAAAGAGGACCGGAGCCCTGTTGATGATGATTACGAGCCAAACCGCACTTCCCCTAGAGGAAGTGAGTCTCCTTAACTTTGATGGCTCATGGCCACGGCTTGCAGGCATTGTAGCATGTATACTATTGGATCGACTGTTCCTTTCTCTTTTAAGTGTGTTTGCTTTAGAACCTTTTAAGTTTCATGTTACCAAGAGTTTTTTCATTTGAGACATAATGTTGTTGCGTTTCTTTTGGACAATTTTTCGAAGATTGTTATAAGGATTTATAAAAGTTTCAATCTGAGGAG

SEQ ID NO: 2735 - DNA, 1537 bp, Arabidopsis thaliana
  misc_feature (1)..(1537): Ceres cDNA ID no. 13647286
  misc_feature (1)..(1537): Ceres CLONE  ID no. 1356294
  misc_feature (1)..(1537): Also known as  Ceres CDNA ID no. 23480567
attcacacacacacactcacacaaaaaccaaaaactaattttcacgaaatccgaagcttaaaaattattcctctactgtttcaatttcatctcttcttcctcttgagttggcaatttctagggttttctcattttcctttttttccatttctggaaactggtaaaaggctttttctttgtctgtgggggagaaacaaaaatggagacagacgaagcataccaaaagaaagagcgagctgcattagtagccatcgttgtccttgcttgtcttgctttatcttctttgttcgtcgcctttagctactactgctatattcgtaacaaggtttctaagcgtcacagaattagcaagaggtttgattgtgaggaaaaaggcgattgtcagaaagtacaagatgttactgacaatgggttgcaaattttcacctttaagcaattgcattcagcaactggtggatttagcaagtctaatgtggttgggaatggtgggtttggcttggtttatcgtggtgtgcttaacgatggcagaaaagttgctatcaagctcatggatcatgcaggaaagcaaggggaagaagaattcaagatggaggttgagttactgagccgtctgcgttcaccatacttgttggcacttcttggttattgctcagacaatagtcataagctgcttgtgtatgagttcatggcaaatggtggtctgcaggaacacctgtatcttcccaacaggtctggttctgtcccaccaagattagattgggaaactaggatgagaatagctgtggaagctgcaaaaggcttggaatatctccatgaacaagtatcacccccggtgattcatagagactttaagagcagcaatattctgctggacagaaacttcaatgccaaagtttcagattttggattggctaaagtcggatcagataaagctggtggacacgtttctacccgtgtattaggcacacaaggatatgtagctcctgagtacgctttaactggtcacttgacaacaaagtcggatgtctatagctacggtgttgtcctgttagagttactaaccggtagagttccagtagatatgaagagagctacaggagaaggtgttcttgtctcttgggctttgcctcaattggctgatagagacaaagtagtagacataatggatccaacactcgaaggacaatactctacgaaagaagttgttcaagttgcagcaatagcagcaatgtgtgttcaagcagaagctgactacagacccttaatggcagatgtggtgcagtcactggttccattagtgagaaaccgtaggtcagcttcaaagcttagtggctgctctagtagctttagcttggctcggtctcctaactctccgggtaaagcaagcataggttctcaatgaataaatcaatcagagaagacgaaatgtgaggcttttattatgtaacggtatttactaaaacagacaatgatgtaaacacttgagtgatcaaacatggagtcatagagataatcatcaaataaactttttcgaacc

SEQ ID NO: 2736 - protein, 1537 aa, Arabidopsis thaliana
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 42566031; NR Description: protein kinase family
  misc_feature: GI Number: 26449989; NR Description: putative
  misc_feature: GI Number: 53749329; NR Description: putative serine/threonine-specific protein kinase [Oryza sativa (japonica
  misc_feature: GI Number: 7630064; NR Description: serine/threonine-specific protein kinase-like protein [Arabidopsis thaliana] >gi|11358842|pir||T49152 serine/threonine-specific protein
  misc_feature: GI Number: 42562758; NR Description: protein kinase family
ATTCACACACACACACTCACACAAAAACCAAAAACTAATTTTCACGAAATCCGAAGCTTAAAAATTATTCCTCTACTGTTTCAATTTCATCTCTTCTTCCTCTTGAGTTGGCAATTTCTAGGGTTTTCTCATTTTCCTTTTTTTCCATTTCTGGAAACTGGTAAAAGGCTTTTTCTTTGTCTGTGGGGGAGAAACAAAAATGGAGACAGACGAAGCATACCAAAAGAAAGAGCGAGCTGCATTAGTAGCCATCGTTGTCCTTGCTTGTCTTGCTTTATCTTCTTTGTTCGTCGCCTTTAGCTACTACTGCTATATTCGTAACAAGGTTTCTAAGCGTCACAGAATTAGCAAGAGGTTTGATTGTGAGGAAAAAGGCGATTGTCAGAAAGTACAAGATGTTACTGACAATGGGTTGCAAATTTTCACCTTTAAGCAATTGCATTCAGCAACTGGTGGATTTAGCAAGTCTAATGTGGTTGGGAATGGTGGGTTTGGCTTGGTTTATCGTGGTGTGCTTAACGATGGCAGAAAAGTTGCTATCAAGCTCATGGATCATGCAGGAAAGCAAGGGGAAGAAGAATTCAAGATGGAGGTTGAGTTACTGAGCCGTCTGCGTTCACCATACTTGTTGGCACTTCTTGGTTATTGCTCAGACAATAGTCATAAGCTGCTTGTGTATGAGTTCATGGCAAATGGTGGTCTGCAGGAACACCTGTATCTTCCCAACAGGTCTGGTTCTGTCCCACCAAGATTAGATTGGGAAACTAGGATGAGAATAGCTGTGGAAGCTGCAAAAGGCTTGGAATATCTCCATGAACAAGTATCACCCCCGGTGATTCATAGAGACTTTAAGAGCAGCAATATTCTGCTGGACAGAAACTTCAATGCCAAAGTTTCAGATTTTGGATTGGCTAAAGTCGGATCAGATAAAGCTGGTGGACACGTTTCTACCCGTGTATTAGGCACACAAGGATATGTAGCTCCTGAGTACGCTTTAACTGGTCACTTGACAACAAAGTCGGATGTCTATAGCTACGGTGTTGTCCTGTTAGAGTTACTAACCGGTAGAGTTCCAGTAGATATGAAGAGAGCTACAGGAGAAGGTGTTCTTGTCTCTTGGGCTTTGCCTCAATTGGCTGATAGAGACAAAGTAGTAGACATAATGGATCCAACACTCGAAGGACAATACTCTACGAAAGAAGTTGTTCAAGTTGCAGCAATAGCAGCAATGTGTGTTCAAGCAGAAGCTGACTACAGACCCTTAATGGCAGATGTGGTGCAGTCACTGGTTCCATTAGTGAGAAACCGTAGGTCAGCTTCAAAGCTTAGTGGCTGCTCTAGTAGCTTTAGCTTGGCTCGGTCTCCTAACTCTCCGGGTAAAGCAAGCATAGGTTCTCAATGAATAAATCAATCAGAGAAGACGAAATGTGAGGCTTTTATTATGTAACGGTATTTACTAAAACAGACAATGATGTAAACACTTGAGTGATCAAACATGGAGTCATAGAGATAATCATCAAATAAACTTTTTCGAACC

SEQ ID NO: 2737 - DNA, 1972 bp, Arabidopsis thaliana
  misc_feature (1)..(1972): Ceres cDNA ID no. 13647613
  misc_feature (1)..(1972): Ceres CLONE  ID no. 1334352
  misc_feature (1)..(1972): Also known as  Ceres CDNA ID no. 23657234
actttttcgtctagatacattcttcgtgaagaaatccaagtgcacacattcattagtgttggacggacccattttattttggatttttttgtataattctttggggtttttttgttaataattcacttctgtctataatatgattatgattgttcatcatattttagctgtaatttcctctcttgaacaaaattattattttcgtgatgtttttaagtacgtgacgaaagatcatttggtgatctcactgacatgatttgcccagcctgtcaggtttacctatggtcaaatatcattttctcgattttgccccaaacggtcaaggcatatatccccaatcttcaaagggtatttatgtacttttcgctattaaccgtgtggctatatgaagccgattcctcataacaactacaaaaaaggaaagcttcttccctccggcaaattcttacgtttctccggcggttagaaaaatgacaccacagatcaaaactcatctcttgccgaagcaagaaccttcttcgtctgagaaccatggatcatcaacctccggcatcgttttcaacgtgtcaacgagtataatcggagccggaataatgtcgatgccggcggcgtttaaagttcttggaatagttccagcgtttttgattatcacgatcatagcttggctttccacaatttccgttggatttctgatgaaatcaactctcgccggagaatcaactacttacgccggagttatgaaagagtcgtttggtaaaacaggatccatcgctgtacagattgctacgatggttgctacttttggttgtatgattatattttcgattattataggagatgtgctttctggtaatgaaaatggtggtcctgaacatattggagttttgcaagaatggtttggttcttactggtggaacacgagaatcttcgctttgttatttgtctacggctttgtcttgcttccattggtcctgcgtagacgagtcgaaagactggcaattagttccgctgtatcgtttcttcttgcggttctatttgttgtcataagctcggtgctggcgatttccgcgctggtgaatggacaaacgaagaatccaagactgtttccggagttgagcaatggaggatcgttctggcaactcttcacagcttcccctgttatagttacagccttcacgtttcacttcaatgttcatccaattggattcgagctcaaagatccattacaagtgatcccagcaactaagatctctgtcatcttgtgtgctgctatctacttcgcaactggactctttggttaccttctctttggagatgcaactatgtcggatattctagtgaactttgaccagagctctggttcttccattggttctcttctcaacgacattgtcagactcagctacgtgcttcacctcatgctggtctttcctctcctgaacttctcattgagagcaaatctcgacgaactcttgtaccccaagaagccgtccttggaaaaagacacaaaaagattcatcggactcactctggctctactgatttgctgtttcttgtctgcaatcgctgtaccagacatttggtacttctttcagttcatgggatcaaccatcacagtctccatagcattcatatttccagccgccattgttctaaggaatatccatggtgtatcaacctcaagagagaagatcgtagctgcaataatgcttgttcttgctgttgccactagcattattgctatctcgacaaatttatacagcctcgcagcaaactagtcgttgaaaaaagttttgcaaacagtcccttccatgatcacttcaaagaaatctgtaaaattattagcttgccgtagcattcatatttatatctttgtgaaataggtttgtcagaaaatgcaatgtaatagctatacaaagtgcaatttttgttgctgcttgaaacagagaaagaggaaatgaacaactcttct

SEQ ID NO: 2738 - protein, 1972 aa, Arabidopsis thaliana
  misc_feature: PFam Name: Aa_trans; PFam Description: Transmembrane amino
  misc_feature: GI Number: 42569800; NR Description: amino acid transporter
  misc_feature: GI Number: 51535770; NR Description: putative system A
  misc_feature: GI Number: 50905855; NR Description: putative amino acid transporter A1 [Oryza sativa (japonica cultivar-group)] >gi|46390972|dbj|BAD16485.1| putative amino acid transporter A1 [Oryza sativa (japonica cultivar-group)] [Oryza sativa (japonica
  misc_feature: GI Number: 15241555; NR Description: amino acid transporter
  misc_feature: GI Number: 9758059; NR Description: amino acid
ACTTTTTCGTCTAGATACATTCTTCGTGAAGAAATCCAAGTGCACACATTCATTAGTGTTGGACGGACCCATTTTATTTTGGATTTTTTTGTATAATTCTTTGGGGTTTTTTTGTTAATAATTCACTTCTGTCTATAATATGATTATGATTGTTCATCATATTTTAGCTGTAATTTCCTCTCTTGAACAAAATTATTATTTTCGTGATGTTTTTAAGTACGTGACGAAAGATCATTTGGTGATCTCACTGACATGATTTGCCCAGCCTGTCAGGTTTACCTATGGTCAAATATCATTTTCTCGATTTTGCCCCAAACGGTCAAGGCATATATCCCCAATCTTCAAAGGGTATTTATGTACTTTTCGCTATTAACCGTGTGGCTATATGAAGCCGATTCCTCATAACAACTACAAAAAAGGAAAGCTTCTTCCCTCCGGCAAATTCTTACGTTTCTCCGGCGGTTAGAAAAATGACACCACAGATCAAAACTCATCTCTTGCCGAAGCAAGAACCTTCTTCGTCTGAGAACCATGGATCATCAACCTCCGGCATCGTTTTCAACGTGTCAACGAGTATAATCGGAGCCGGAATAATGTCGATGCCGGCGGCGTTTAAAGTTCTTGGAATAGTTCCAGCGTTTTTGATTATCACGATCATAGCTTGGCTTTCCACAATTTCCGTTGGATTTCTGATGAAATCAACTCTCGCCGGAGAATCAACTACTTACGCCGGAGTTATGAAAGAGTCGTTTGGTAAAACAGGATCCATCGCTGTACAGATTGCTACGATGGTTGCTACTTTTGGTTGTATGATTATATTTTCGATTATTATAGGAGATGTGCTTTCTGGTAATGAAAATGGTGGTCCTGAACATATTGGAGTTTTGCAAGAATGGTTTGGTTCTTACTGGTGGAACACGAGAATCTTCGCTTTGTTATTTGTCTACGGCTTTGTCTTGCTTCCATTGGTCCTGCGTAGACGAGTCGAAAGACTGGCAATTAGTTCCGCTGTATCGTTTCTTCTTGCGGTTCTATTTGTTGTCATAAGCTCGGTGCTGGCGATTTCCGCGCTGGTGAATGGACAAACGAAGAATCCAAGACTGTTTCCGGAGTTGAGCAATGGAGGATCGTTCTGGCAACTCTTCACAGCTTCCCCTGTTATAGTTACAGCCTTCACGTTTCACTTCAATGTTCATCCAATTGGATTCGAGCTCAAAGATCCATTACAAGTGATCCCAGCAACTAAGATCTCTGTCATCTTGTGTGCTGCTATCTACTTCGCAACTGGACTCTTTGGTTACCTTCTCTTTGGAGATGCAACTATGTCGGATATTCTAGTGAACTTTGACCAGAGCTCTGGTTCTTCCATTGGTTCTCTTCTCAACGACATTGTCAGACTCAGCTACGTGCTTCACCTCATGCTGGTCTTTCCTCTCCTGAACTTCTCATTGAGAGCAAATCTCGACGAACTCTTGTACCCCAAGAAGCCGTCCTTGGAAAAAGACACAAAAAGATTCATCGGACTCACTCTGGCTCTACTGATTTGCTGTTTCTTGTCTGCAATCGCTGTACCAGACATTTGGTACTTCTTTCAGTTCATGGGATCAACCATCACAGTCTCCATAGCATTCATATTTCCAGCCGCCATTGTTCTAAGGAATATCCATGGTGTATCAACCTCAAGAGAGAAGATCGTAGCTGCAATAATGCTTGTTCTTGCTGTTGCCACTAGCATTATTGCTATCTCGACAAATTTATACAGCCTCGCAGCAAACTAGTCGTTGAAAAAAGTTTTGCAAACAGTCCCTTCCATGATCACTTCAAAGAAATCTGTAAAATTATTAGCTTGCCGTAGCATTCATATTTATATCTTTGTGAAATAGGTTTGTCAGAAAATGCAATGTAATAGCTATACAAAGTGCAATTTTTGTTGCTGCTTGAAACAGAGAAAGAGGAAATGAACAACTCTTCT

SEQ ID NO: 2739 - DNA, 948 bp, Arabidopsis thaliana
  misc_feature (1)..(948): Ceres cDNA ID no. 13647693
  misc_feature (1)..(948): Ceres CLONE  ID no. 1351862
  misc_feature (1)..(948): Also known as  Ceres CDNA ID no. 0
acttgatagtggactcaaccactcaaaaagtgtaacggagtcaaaaaatctctcatatccaaagtagtgtaatccattgtaaccaggtttcatcagaaagcctttggattgtaataatcctttcgtgtcctttcgtttctctcactccactctgcaatctacttcatcgtcgacatcttcttgcgcatttcaaaggttagcttaactctgttgaaagatggcttctcgggtggtgaggactagtatgagacttcgaaggagggatggtgtgactcaaaacgaacaccagggagatcaacaagtggctgaccaagctccaacggtgcctcagattgtggctactcctcctaggatcaatgtggttgctattgaagatgatgatgatgttgttgaatcaactgcttctgcttttgctcaggctaaaaacaaatcgagaagtgcacgcagaggatcacaagtagttgatgtggagtcagctggtgctaatagatccacaaggcgtcgctctgatcaaactagtgttgactcagttgagcttaacaagccgagaaagtccaaggctgtggctcctcctgtagaggaaccaaaatttagctgtccaatctgtctgtgtccatttactcaggaggtttcaacgaaatgtggtcatattttctgcaaaaagtgcataaagaatgcgttatccctccaagctaaatgcccgacatgtaggaaaaaaatcactgttaaggaccttatccgggtcttccttccaaccaccagatgaatgatacagaaacatcactagtagccatggatagtggtctagcgattctacctccaacgatgaagaaatgttgttcattagttgtagtttgttatgtcaatattgttctgttttgtaagagaaatatctaggaattatggaagacctgattttctaatggatatcgttcattggtgatctcc

SEQ ID NO: 2740 - protein, 948 aa, Arabidopsis thaliana
ACTTGATAGTGGACTCAACCACTCAAAAAGTGTAACGGAGTCAAAAAATCTCTCATATCCAAAGTAGTGTAATCCATTGTAACCAGGTTTCATCAGAAAGCCTTTGGATTGTAATAATCCTTTCGTGTCCTTTCGTTTCTCTCACTCCACTCTGCAATCTACTTCATCGTCGACATCTTCTTGCGCATTTCAAAGGTTAGCTTAACTCTGTTGAAAGATGGCTTCTCGGGTGGTGAGGACTAGTATGAGACTTCGAAGGAGGGATGGTGTGACTCAAAACGAACACCAGGGAGATCAACAAGTGGCTGACCAAGCTCCAACGGTGCCTCAGATTGTGGCTACTCCTCCTAGGATCAATGTGGTTGCTATTGAAGATGATGATGATGTTGTTGAATCAACTGCTTCTGCTTTTGCTCAGGCTAAAAACAAATCGAGAAGTGCACGCAGAGGATCACAAGTAGTTGATGTGGAGTCAGCTGGTGCTAATAGATCCACAAGGCGTCGCTCTGATCAAACTAGTGTTGACTCAGTTGAGCTTAACAAGCCGAGAAAGTCCAAGGCTGTGGCTCCTCCTGTAGAGGAACCAAAATTTAGCTGTCCAATCTGTCTGTGTCCATTTACTCAGGAGGTTTCAACGAAATGTGGTCATATTTTCTGCAAAAAGTGCATAAAGAATGCGTTATCCCTCCAAGCTAAATGCCCGACATGTAGGAAAAAAATCACTGTTAAGGACCTTATCCGGGTCTTCCTTCCAACCACCAGATGAATGATACAGAAACATCACTAGTAGCCATGGATAGTGGTCTAGCGATTCTACCTCCAACGATGAAGAAATGTTGTTCATTAGTTGTAGTTTGTTATGTCAATATTGTTCTGTTTTGTAAGAGAAATATCTAGGAATTATGGAAGACCTGATTTTCTAATGGATATCGTTCATTGGTGATCTCC

SEQ ID NO: 2741 - DNA, 1746 bp, Arabidopsis thaliana
  misc_feature (1)..(1746): Ceres cDNA ID no. 13647702
  misc_feature (1)..(1746): Ceres CLONE  ID no. 1342671
  misc_feature (1)..(1746): Also known as  Ceres CDNA ID no. 23657485
ggttagtctactcattaatcctcacaactctctatctctctctccccattctctatcataatgacaggtgccacaccggaaaaccgaacggccccgtcgccaccaccgatgaaacatgtgccggagtcagttctgccggctaaaccaccaaagaggaacaattatgcattcgcgtgtgctatcttagcttccatgacttctatcctccttggttatgatataggagtgatgagtggagcaatgatttatataaagagagatttgaagattaatgatttacaaatcgggattctcgctggaagcctcaacatctattcacttataggatcttgcgccgccggaagaacctctgactggattggtcggcgttacactatcgtgttggctggagccatattcttcgccggagctatccttatgggattgtcccctaactacgctttcctcatgttcggaaggttcatcgccggtatcggcgtcggatatgctctcatgatcgcaccagtttataccgccgaagtctctccggcatcttcccgcggcttcctcaattccttccccgaggtgtttatcaacgccggaattatgctcgggtacgtatcaaatctggctttctcgaacttgccgttgaaggtaggatggagactgatgctcggaatcggagccgtaccttccgtgatactcgctatcggcgttctcgctatgccggaatctccacggtggctcgttatgcaaggccgtctcggtgatgccaagcgcgttctggacaaaacctctgattcccccaccgaagcaactctccgtctcgaagacatcaaacacgccgctggtattcccgccgattgccacgacgacgtcgttcaggtgtcgaggaggaacagtcatggagaaggagtttggagagagcttttaatccgaccaacaccagccgtgcgtcgtgttatgatcgccgcaatcggaatccatttcttccagcaagcttccggtatcgacgcggtggttctcttctcaccgcgaattttcaaaaccgccggactcaaaaccgatcaccaacagcttctagcgactgtagcagtaggagtagtgaagacatcattcatactagtcgccactttcttactcgacagaatcgggagaagaccattgcttctaaccagcgtaggaggaatggtactatctctagcagcgttagggacttctctaacgattatagaccagtcagagaagaaagtgatgtgggctgtggttgtagctatagctacggtgatgacttatgtagctacgttttcgataggagctggaccgataacttgggtttatagctcggagatattcccgttgaggttgagatcacagggctcgagtatgggtgtggtggtgaacagagtgactagtggtgtgatctcgatatcgtttcttccaatgtcgaaagcgatgactactggtggagcgttttacttgtttggagggattgcgactgtggcttgggttttcttttacactttcttgccggagacgcaagggaggatgcttgaggatatggatgagcttttcagtggtttcaggtggagagattccaagagtaagcctaagggtaaccccgagaagacggtaccgaatcccgaggttgagattggatcaaacaagcagtggaaggaaggagacacacaaagttcgtaggaaatttgatcagatatgtaatttgtatggtatgtgggtttaatgataaaacgaacaaattagcgt

SEQ ID NO: 2742 - protein, 1746 aa, Arabidopsis thaliana
  misc_feature: PFam Name: Sugar_tr; PFam Description: Sugar (and other)
  misc_feature: PFam Name: MFS_1; PFam Description: Major Facilitator Superfamily
  misc_feature: GI Number: 9293909; NR Description: sugar transporter protein [Arabidopsis thaliana] >gi|15230212|ref|NP_188513.1| mannitol
  misc_feature: GI Number: 30025133; NR Description: putative sorbitol
  misc_feature: GI Number: 51849627; NR Description: sorbitol transporter
  misc_feature: GI Number: 1778095; NR Description: putative sugar transporter; member of major facilitative superfamily; integral
  misc_feature: GI Number: 1778093; NR Description: putative sugar transporter; member of major facilitative superfamily; integral membrane protein [Beta vulgaris] >gi|7484647|pir||T14606 probable
GGTTAGTCTACTCATTAATCCTCACAACTCTCTATCTCTCTCTCCCCATTCTCTATCATAATGACAGGTGCCACACCGGAAAACCGAACGGCCCCGTCGCCACCACCGATGAAACATGTGCCGGAGTCAGTTCTGCCGGCTAAACCACCAAAGAGGAACAATTATGCATTCGCGTGTGCTATCTTAGCTTCCATGACTTCTATCCTCCTTGGTTATGATATAGGAGTGATGAGTGGAGCAATGATTTATATAAAGAGAGATTTGAAGATTAATGATTTACAAATCGGGATTCTCGCTGGAAGCCTCAACATCTATTCACTTATAGGATCTTGCGCCGCCGGAAGAACCTCTGACTGGATTGGTCGGCGTTACACTATCGTGTTGGCTGGAGCCATATTCTTCGCCGGAGCTATCCTTATGGGATTGTCCCCTAACTACGCTTTCCTCATGTTCGGAAGGTTCATCGCCGGTATCGGCGTCGGATATGCTCTCATGATCGCACCAGTTTATACCGCCGAAGTCTCTCCGGCATCTTCCCGCGGCTTCCTCAATTCCTTCCCCGAGGTGTTTATCAACGCCGGAATTATGCTCGGGTACGTATCAAATCTGGCTTTCTCGAACTTGCCGTTGAAGGTAGGATGGAGACTGATGCTCGGAATCGGAGCCGTACCTTCCGTGATACTCGCTATCGGCGTTCTCGCTATGCCGGAATCTCCACGGTGGCTCGTTATGCAAGGCCGTCTCGGTGATGCCAAGCGCGTTCTGGACAAAACCTCTGATTCCCCCACCGAAGCAACTCTCCGTCTCGAAGACATCAAACACGCCGCTGGTATTCCCGCCGATTGCCACGACGACGTCGTTCAGGTGTCGAGGAGGAACAGTCATGGAGAAGGAGTTTGGAGAGAGCTTTTAATCCGACCAACACCAGCCGTGCGTCGTGTTATGATCGCCGCAATCGGAATCCATTTCTTCCAGCAAGCTTCCGGTATCGACGCGGTGGTTCTCTTCTCACCGCGAATTTTCAAAACCGCCGGACTCAAAACCGATCACCAACAGCTTCTAGCGACTGTAGCAGTAGGAGTAGTGAAGACATCATTCATACTAGTCGCCACTTTCTTACTCGACAGAATCGGGAGAAGACCATTGCTTCTAACCAGCGTAGGAGGAATGGTACTATCTCTAGCAGCGTTAGGGACTTCTCTAACGATTATAGACCAGTCAGAGAAGAAAGTGATGTGGGCTGTGGTTGTAGCTATAGCTACGGTGATGACTTATGTAGCTACGTTTTCGATAGGAGCTGGACCGATAACTTGGGTTTATAGCTCGGAGATATTCCCGTTGAGGTTGAGATCACAGGGCTCGAGTATGGGTGTGGTGGTGAACAGAGTGACTAGTGGTGTGATCTCGATATCGTTTCTTCCAATGTCGAAAGCGATGACTACTGGTGGAGCGTTTTACTTGTTTGGAGGGATTGCGACTGTGGCTTGGGTTTTCTTTTACACTTTCTTGCCGGAGACGCAAGGGAGGATGCTTGAGGATATGGATGAGCTTTTCAGTGGTTTCAGGTGGAGAGATTCCAAGAGTAAGCCTAAGGGTAACCCCGAGAAGACGGTACCGAATCCCGAGGTTGAGATTGGATCAAACAAGCAGTGGAAGGAAGGAGACACACAAAGTTCGTAGGAAATTTGATCAGATATGTAATTTGTATGGTATGTGGGTTTAATGATAAAACGAACAAATTAGCGT

SEQ ID NO: 2743 - DNA, 1785 bp, Arabidopsis thaliana
  misc_feature (1)..(1785): Ceres cDNA ID no. 13647875
  misc_feature (1)..(1785): Ceres CLONE  ID no. 1353496
  misc_feature (1)..(1785): Also known as  Ceres CDNA ID no. 23657944
gaatatcttcctttgtcaatctcttgagagtttttgcttcctcgtcttcttcgattcatcaaacagcgtgtgttttttgtttagagttggaagagacgaatcgaattttgaagctttcttttatgtctgacaagatatctccgttttgttgtcaatctggttgcttggaaaacacagtcctacatccagaattaaggactactactagttcctccatcactttagggtctcgcatcttcaaaccggagatccctcctctttctctccacttttttagctaagaagaatggcgctgcagaacattggtgcttccaaccgtaacgatgccttctacaggtacaagatgcctaagatggttaccaaaaccgaaggcaaaggtaatggcattaagaccaacattatcaacaatgttgagattgccaaagccttggctagaccgccttcttatacgaccaagtactttggttgtgagcttggagcgcagtctaagtttgatgagaagactgggacgtcgcttgtgaatggagctcacaacacgtctaagcttgctgggcttttggagaattttattaagaagtttgttcagtgttatggatgtggtaacccggagactgagattattattacgaagacgcagatggtgaatctcaagtgtgctgcttgtgggtttatctctgaggtcgacatgagggataagttgactaatttcattctcaagaacccacctgagcagaagaaggtgtcaaaggataagaaagcaatgaggaaagctgagaaggagaggcttaaagaaggcgagctagctgatgaggagcagagaaagctgaaagctaagaagaaagcattgtctaacggcaaggattctaagacgtctaagaaccattcttctgatgaggatataagcccgaagcatgatgagaatgctctagaggtggatgaggatgaagatgatgatgatggtgtcgagtggcaaactgatacttcccgagaagctgctgagaaaagaatgatggaacagttgagtgctaaaactgccgaaatggtgatgctctctgcaatggaagtagaagagaaaaaggcgcccaaaagcaaatctaacgggaacgttgtgaaaactgagaatcctcctccgcaagagaagaatctcgtgcaggatatgaaagagtatctgaagaaagggtcaccaataagcgcgctcaaaagtttcatctcgtctctctctgaacctcctcaagacatcatggacgcactcttcaatgctctctttgatggtgtgggaaagggattcgccaaagaagtgactaagaagaagaattacttagcggctgctgcaacaatgcaagaggatggatcacagatgcatctgctcaattcgattgggacattctgtggaaagaatggaaacgaagaagctttgaaagaggtggctctggttcttaaagcattgtacgaccaagacatcattgaggaagaggtagtgttggattggtacgaaaagggtctcaccggagctgacaaaagctcgccggtttggaagaatgttaagccttttgtggagtggcttcagagcgctgagtctgagtccgaagaggaggattgagtcacttttttcttccctcctaacttttctttgcggcatttcttataatacttcgtcagttttcagaattcttaaatctttttgctgtgttcttataaagaaacatcatctattaaagttgtcttcgtttggatttggttttgacgactttgggaaatatttatgtttaagaaggtttcattggt

SEQ ID NO: 2744 - protein, 1785 aa, Arabidopsis thaliana
  misc_feature: PFam Name: eIF-5_eIF-2B; PFam Description: Domain found in
  misc_feature: PFam Name: W2; PFam Description: eIF4-gamma/eIF5/eIF2-epsilon
  misc_feature: PFam Name: eIF-3c_N; PFam Description: Eukaryotic
  misc_feature: GI Number: 15810339; NR Description: putative eukaryotic
  misc_feature: GI Number: 21387159; NR Description: putative eukaryotic translation initiation factor 5 [Arabidopsis thaliana] >gi|17473619|gb|AAL38273.1| putative eukaryotic translation initiation factor 5 [Arabidopsis thaliana]
  misc_feature: GI Number: 20465815; NR Description: putative eukaryotic translation initiation factor 5 protein [Arabidopsis thaliana] >gi|17381210|gb|AAL36417.1| putative Eukaryotic translation initiation factor 5 [Arabidopsis thaliana] factor 5, putative
  misc_feature: GI Number: 53792080; NR Description: putative eukaryotic translation initiation factor 5 [Oryza sativa (japonica
  misc_feature: GI Number: 4160402; NR Description: eukaryotic translation
GAATATCTTCCTTTGTCAATCTCTTGAGAGTTTTTGCTTCCTCGTCTTCTTCGATTCATCAAACAGCGTGTGTTTTTTGTTTAGAGTTGGAAGAGACGAATCGAATTTTGAAGCTTTCTTTTATGTCTGACAAGATATCTCCGTTTTGTTGTCAATCTGGTTGCTTGGAAAACACAGTCCTACATCCAGAATTAAGGACTACTACTAGTTCCTCCATCACTTTAGGGTCTCGCATCTTCAAACCGGAGATCCCTCCTCTTTCTCTCCACTTTTTTAGCTAAGAAGAATGGCGCTGCAGAACATTGGTGCTTCCAACCGTAACGATGCCTTCTACAGGTACAAGATGCCTAAGATGGTTACCAAAACCGAAGGCAAAGGTAATGGCATTAAGACCAACATTATCAACAATGTTGAGATTGCCAAAGCCTTGGCTAGACCGCCTTCTTATACGACCAAGTACTTTGGTTGTGAGCTTGGAGCGCAGTCTAAGTTTGATGAGAAGACTGGGACGTCGCTTGTGAATGGAGCTCACAACACGTCTAAGCTTGCTGGGCTTTTGGAGAATTTTATTAAGAAGTTTGTTCAGTGTTATGGATGTGGTAACCCGGAGACTGAGATTATTATTACGAAGACGCAGATGGTGAATCTCAAGTGTGCTGCTTGTGGGTTTATCTCTGAGGTCGACATGAGGGATAAGTTGACTAATTTCATTCTCAAGAACCCACCTGAGCAGAAGAAGGTGTCAAAGGATAAGAAAGCAATGAGGAAAGCTGAGAAGGAGAGGCTTAAAGAAGGCGAGCTAGCTGATGAGGAGCAGAGAAAGCTGAAAGCTAAGAAGAAAGCATTGTCTAACGGCAAGGATTCTAAGACGTCTAAGAACCATTCTTCTGATGAGGATATAAGCCCGAAGCATGATGAGAATGCTCTAGAGGTGGATGAGGATGAAGATGATGATGATGGTGTCGAGTGGCAAACTGATACTTCCCGAGAAGCTGCTGAGAAAAGAATGATGGAACAGTTGAGTGCTAAAACTGCCGAAATGGTGATGCTCTCTGCAATGGAAGTAGAAGAGAAAAAGGCGCCCAAAAGCAAATCTAACGGGAACGTTGTGAAAACTGAGAATCCTCCTCCGCAAGAGAAGAATCTCGTGCAGGATATGAAAGAGTATCTGAAGAAAGGGTCACCAATAAGCGCGCTCAAAAGTTTCATCTCGTCTCTCTCTGAACCTCCTCAAGACATCATGGACGCACTCTTCAATGCTCTCTTTGATGGTGTGGGAAAGGGATTCGCCAAAGAAGTGACTAAGAAGAAGAATTACTTAGCGGCTGCTGCAACAATGCAAGAGGATGGATCACAGATGCATCTGCTCAATTCGATTGGGACATTCTGTGGAAAGAATGGAAACGAAGAAGCTTTGAAAGAGGTGGCTCTGGTTCTTAAAGCATTGTACGACCAAGACATCATTGAGGAAGAGGTAGTGTTGGATTGGTACGAAAAGGGTCTCACCGGAGCTGACAAAAGCTCGCCGGTTTGGAAGAATGTTAAGCCTTTTGTGGAGTGGCTTCAGAGCGCTGAGTCTGAGTCCGAAGAGGAGGATTGAGTCACTTTTTTCTTCCCTCCTAACTTTTCTTTGCGGCATTTCTTATAATACTTCGTCAGTTTTCAGAATTCTTAAATCTTTTTGCTGTGTTCTTATAAAGAAACATCATCTATTAAAGTTGTCTTCGTTTGGATTTGGTTTTGACGACTTTGGGAAATATTTATGTTTAAGAAGGTTTCATTGGT

SEQ ID NO: 2745 - DNA, 813 bp, Arabidopsis thaliana
  misc_feature (1)..(813): Ceres cDNA ID no. 13647966
  misc_feature (1)..(813): Ceres CLONE  ID no. 1343892
  misc_feature (1)..(813): Also known as  Ceres CDNA ID no. 23658160
gagagaagataatgagctccttggggttttcagttggaacttgttctcctccaagtgagaaaagaaaatgcagatttcttgtgaataatagcttaaacaaagcagaggctattaacttgagaaacaagcaaaaagtttcttctgatcctgagttaagttttgcccaattatcctcatgtggtagaagagaagcaattattggttttggtttctctattggcttgcttgataatgtttctgcattagccgaaacaacttcttgtgaattctctgtgtctccttctggtcttgctttttgtgataaagttgttggttatggtcctgaagctgttaaagggcaactaatcaaggcacattatgtagggaagttggagaatgggaaagtctttgataatagctataatcgagggaaacctcttactttccgaattggtgttggtgaggtgataaaaggttgggatcaaggaatccttggctctgatggaattcctcctatgcttactggtgggaaacgaacattgaggattcctccagaactcgcgtatggtgatcgaggcgcaggttgcaaaggaggctcatgccttattcctccagcttcggttcttctctttgacattgagtacataggtaaagcttgagagagcttttttgcttttgctttgccttttctgagccatatcatactcttgtttgaatcatccttatagaagaaaaaaatatgtctattattttttctactatgtaatcaagtgaatatctcagctttttctatcaaaaaaaaaaaaaaaaaaaactcgagggggggcccggtac

SEQ ID NO: 2746 - protein, 813 aa, Arabidopsis thaliana
  misc_feature: PFam Name: FKBP_C; PFam Description: FKBP-type
  misc_feature: GI Number: 21535744; NR Description: FK506 binding protein 1
  misc_feature: GI Number: 52075930; NR Description: putative peptidyl-prolyl
  misc_feature: GI Number: 6686802; NR Description: FKBP like protein
  misc_feature: GI Number: 6686798; NR Description: FKBP like protein [Arabidopsis thaliana] >gi|18420509|ref|NP_568067.1| immunophilin, putative / FKBP-type peptidyl-prolyl cis-trans isomerase, putative
  misc_feature: GI Number: 16329650; NR Description: FKBP-type peptidyl-prolyl cis-trans isomerase [Synechocystis sp. PCC 6803] >gi|7428434|pir||S75144 FKBP-type peptidyl-prolyl cis-trans isomerase - Synechocystis sp. (strain PCC 6803) isomerase
GAGAGAAGATAATGAGCTCCTTGGGGTTTTCAGTTGGAACTTGTTCTCCTCCAAGTGAGAAAAGAAAATGCAGATTTCTTGTGAATAATAGCTTAAACAAAGCAGAGGCTATTAACTTGAGAAACAAGCAAAAAGTTTCTTCTGATCCTGAGTTAAGTTTTGCCCAATTATCCTCATGTGGTAGAAGAGAAGCAATTATTGGTTTTGGTTTCTCTATTGGCTTGCTTGATAATGTTTCTGCATTAGCCGAAACAACTTCTTGTGAATTCTCTGTGTCTCCTTCTGGTCTTGCTTTTTGTGATAAAGTTGTTGGTTATGGTCCTGAAGCTGTTAAAGGGCAACTAATCAAGGCACATTATGTAGGGAAGTTGGAGAATGGGAAAGTCTTTGATAATAGCTATAATCGAGGGAAACCTCTTACTTTCCGAATTGGTGTTGGTGAGGTGATAAAAGGTTGGGATCAAGGAATCCTTGGCTCTGATGGAATTCCTCCTATGCTTACTGGTGGGAAACGAACATTGAGGATTCCTCCAGAACTCGCGTATGGTGATCGAGGCGCAGGTTGCAAAGGAGGCTCATGCCTTATTCCTCCAGCTTCGGTTCTTCTCTTTGACATTGAGTACATAGGTAAAGCTTGAGAGAGCTTTTTTGCTTTTGCTTTGCCTTTTCTGAGCCATATCATACTCTTGTTTGAATCATCCTTATAGAAGAAAAAAATATGTCTATTATTTTTTCTACTATGTAATCAAGTGAATATCTCAGCTTTTTCTATCAAAAAAAAAAAAAAAAAAAACTCGAGGGGGGGCCCGGTAC

SEQ ID NO: 2747 - DNA, 1628 bp, Arabidopsis thaliana
  misc_feature (1)..(1628): Ceres cDNA ID no. 13648279
  misc_feature (1)..(1628): Ceres CLONE  ID no. 1339699
  misc_feature (1)..(1628): Also known as  Ceres CDNA ID no. 23658753
gatcaatttatataaccctctcaaaacacacaattttaagattcaaataaaattccttcttcaacattcaccaccacaacatcatgggcattgcacggtggctcaaccgcaccgtgggcttctttgtcttctctctcctcgacattgctgatttcttgctttgttacacttacaagactttggattacttcttggaatccgagaggaaaccttgctactgctcttctccaccagaggctaaagccaagaccgagaagatcatagtgtcggaacgaggcgggtactcaaaggttgtgtctctaacaagaagtaagatccatttcgatgagatctcggacacgctttactcacgtggcccttcacttctaacgaggctctctaagctcgtgaggtccgtgaaatgttttaattataagggtttgatcatgagaggcaatgtggtggaatcttgtgatcatcatgagtctaaaaaaaagattagcaaaggtaaaaagagattaatgactttgaattctaccgtgattgagaaatcttcgacagctccaagatggtcggattgccattgcagtttctgcacttcttggcttacttctaccaacagagattctctgtttgttaaagttcaacaacccaaagataacaagaaggcccgagacaacgttgtgtttatacatggttttgtatcatcatccgcgttttggacggagactctcttcccaaacttttctgattcagccaaatcgaactataggttcatcgcagtcgatcttttgggctatggaagaagtcctaagccaaatgactcattatatactttaagagaacatttggagatgattgagaaatcggtgatctctaagttcaagctcaaaacgttccacatagtagctcattccctaggctgcattttggctcttgcactcgcagtaaaacatccgggagctatcaaatcccttactcttttggctcctccatattacaaggtgccaaagggagtccaaccagcgcaatacgtgatgagggaagtggctcggaaggaagtttggccaccgatgcagtttggtgcatcggtgcttagctggtatgagcacctaggccgcaccattggccttgtccttatcaagaaccatcaattgattgaatttgtcacccgcctccttaccctaaacaggatgcgaacgtatttgatagaaggattcttatgtcacacacataatggatcatttcacacattacacaacatcatcttcgggtcaggagccaagctcgactcgtatctcgaccatgtccgtgaccatgtggactgcgacgtcgccattttccacggtggcaaggacgagctcattcctgtggagtgtagttacagtgtgaagagcaaagtgccacgtgccactgtccacgtcatccctgacaaagaccacatcaccattgtcgtcggccgacaaaaagactttgcacgagagcttgagctcatttggcaaagaaccaaatcaacttaagtgaatatattttatagtgatgaaactctttttttcttttttctgtttctattaagtatatatttttcttattacaaaagttagatagatatcgttttctattcaatgaagattttgttttagtttccc

SEQ ID NO: 2748 - protein, 1628 aa, Arabidopsis thaliana
  misc_feature: PFam Name: Abhydrolase_1; PFam Description: alpha/beta
  misc_feature: GI Number: 6633825; NR Description: F1N19.24 [Arabidopsis thaliana]
GATCAATTTATATAACCCTCTCAAAACACACAATTTTAAGATTCAAATAAAATTCCTTCTTCAACATTCACCACCACAACATCATGGGCATTGCACGGTGGCTCAACCGCACCGTGGGCTTCTTTGTCTTCTCTCTCCTCGACATTGCTGATTTCTTGCTTTGTTACACTTACAAGACTTTGGATTACTTCTTGGAATCCGAGAGGAAACCTTGCTACTGCTCTTCTCCACCAGAGGCTAAAGCCAAGACCGAGAAGATCATAGTGTCGGAACGAGGCGGGTACTCAAAGGTTGTGTCTCTAACAAGAAGTAAGATCCATTTCGATGAGATCTCGGACACGCTTTACTCACGTGGCCCTTCACTTCTAACGAGGCTCTCTAAGCTCGTGAGGTCCGTGAAATGTTTTAATTATAAGGGTTTGATCATGAGAGGCAATGTGGTGGAATCTTGTGATCATCATGAGTCTAAAAAAAAGATTAGCAAAGGTAAAAAGAGATTAATGACTTTGAATTCTACCGTGATTGAGAAATCTTCGACAGCTCCAAGATGGTCGGATTGCCATTGCAGTTTCTGCACTTCTTGGCTTACTTCTACCAACAGAGATTCTCTGTTTGTTAAAGTTCAACAACCCAAAGATAACAAGAAGGCCCGAGACAACGTTGTGTTTATACATGGTTTTGTATCATCATCCGCGTTTTGGACGGAGACTCTCTTCCCAAACTTTTCTGATTCAGCCAAATCGAACTATAGGTTCATCGCAGTCGATCTTTTGGGCTATGGAAGAAGTCCTAAGCCAAATGACTCATTATATACTTTAAGAGAACATTTGGAGATGATTGAGAAATCGGTGATCTCTAAGTTCAAGCTCAAAACGTTCCACATAGTAGCTCATTCCCTAGGCTGCATTTTGGCTCTTGCACTCGCAGTAAAACATCCGGGAGCTATCAAATCCCTTACTCTTTTGGCTCCTCCATATTACAAGGTGCCAAAGGGAGTCCAACCAGCGCAATACGTGATGAGGGAAGTGGCTCGGAAGGAAGTTTGGCCACCGATGCAGTTTGGTGCATCGGTGCTTAGCTGGTATGAGCACCTAGGCCGCACCATTGGCCTTGTCCTTATCAAGAACCATCAATTGATTGAATTTGTCACCCGCCTCCTTACCCTAAACAGGATGCGAACGTATTTGATAGAAGGATTCTTATGTCACACACATAATGGATCATTTCACACATTACACAACATCATCTTCGGGTCAGGAGCCAAGCTCGACTCGTATCTCGACCATGTCCGTGACCATGTGGACTGCGACGTCGCCATTTTCCACGGTGGCAAGGACGAGCTCATTCCTGTGGAGTGTAGTTACAGTGTGAAGAGCAAAGTGCCACGTGCCACTGTCCACGTCATCCCTGACAAAGACCACATCACCATTGTCGTCGGCCGACAAAAAGACTTTGCACGAGAGCTTGAGCTCATTTGGCAAAGAACCAAATCAACTTAAGTGAATATATTTTATAGTGATGAAACTCTTTTTTTCTTTTTTCTGTTTCTATTAAGTATATATTTTTCTTATTACAAAAGTTAGATAGATATCGTTTTCTATTCAATGAAGATTTTGTTTTAGTTTCCC

SEQ ID NO: 2749 - DNA, 1744 bp, Arabidopsis thaliana
  misc_feature (1)..(1744): Ceres cDNA ID no. 13648298
  misc_feature (1)..(1744): Ceres CLONE  ID no. 1351723
  misc_feature (1)..(1744): Also known as  Ceres CDNA ID no. 23660803
gaagtggcaaactcatttttgtttgttccttctttcttttgaggccaaaagagaccagattcatttttggtttcttcaaaggccaaaccttattttcttattttctcagacaaacccttttgccatattacaaaataaaatttattcgtctgagaattatcttgatcccttttggattcgaggttcaagaacattcatgaacttcgagtaaatcaatcatcttcttgtagtaataatccaggaagatacattatcaacacacataaaacagaatgaaaatcaattgcttgttctgttgtatgtcccacagacgatttaacagacgatcatcatcgagacaaagcatcaaagactgcattgatgcaaagaacaatataactacatttgacaacatctcttttaaaacagatagcagtaggcgaagatacatatccgaggagatagcaaaactcggtaaagggaacatcagtgctcatatttttacattcagagagctttgcgtcgctaccaagaacttcaaccccgataatcagctcggtgaaggcgggtttggaagggtttacaaagggcagatagaaaccccggaacaagttgttgcggttaagcagctagacaggaatggttaccaagggaacagagagtttcttgtggaagtcatgatgttgagtctcttacatcatcaaaaccttgtcaatttggtcggatattgcgcagacggtgatcaacggattcttgtctatgaatacatgcaaaatggctctttagaggatcatcttctagaattggcgcggaacaagaagaagccgttggattgggacacaagaatgaaagttgcggcaggagcagctagagggcttgagtatctacacgaaacagcagatcctcctgttatctacagagacttcaaggcctcaaatatattacttgacgaagaattcaacccaaagctttcggatttcggtttagctaaggttggtccgaccggtggagagactcatgtgtcaacgagagtgatgggaacatacggctattgtgcgcctgagtatgctctcacaggacagctcactgtgaaatccgatgtatacagcttcggagtcgtgttcttggagatgatcacaggaagacgagtcattgacacaacaaaaccaactgaagaacagaacttagtcacttgggcgagtccattgttcaaagataggagaaagttcacgttaatggcagatccattgcttgaaggaaagtatccaataaaaggattgtatcaagcgcttgcagtagcagcaatgtgtcttcaagaagaagcagcaacgagaccaatgatgagtgatgtagtcactgcgcttgagtacttagccgtgaccaaaaccgaagaagatggacaaactgtagaaggagaagaagaagaagaagaagaagacgaaagatccaaactttgagcaaatttttttgtttgttttcgtttgtaattttcaaatgatcggttttaggaaatttgataactttacgaattcaccaatgaaaaaagaagattaaatgagagttttcgtgttycccmatcgaacattttaaaggatttgctgagaattttgtaaaaaaaaaaaaaaaaaaaaaaaaaaaaaaaaaaaaaaaaaaaaaaaaaaaaagaaaaaaaaaaaaaaaaaaacctcgrgggggggcccggaacccawttcccccaawagggagccgaataacaattcatgggccgccgtttaacaacgccggg

SEQ ID NO: 2750 - protein, 1744 aa, Arabidopsis thaliana
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 15232294; NR Description: protein kinase family
  misc_feature: GI Number: 11994140; NR Description: receptor protein
  misc_feature: GI Number: 15238886; NR Description: protein kinase family
  misc_feature: GI Number: 50931229; NR Description: putative serine/threonine protein kinase [Oryza sativa (japonica cultivar-group)] >gi|49328131|gb|AAT58829.1| putative serine/threonine protein kinase [Oryza sativa (japonica
  misc_feature: GI Number: 34907210; NR Description: putative serine/threonine kinase PBS1 protein [Oryza sativa (japonica cultivar-group)] >gi|15408807|dbj|BAB64203.1| putative serine/threonine kinase PBS1 protein [Oryza sativa (japonica
GAAGTGGCAAACTCATTTTTGTTTGTTCCTTCTTTCTTTTGAGGCCAAAAGAGACCAGATTCATTTTTGGTTTCTTCAAAGGCCAAACCTTATTTTCTTATTTTCTCAGACAAACCCTTTTGCCATATTACAAAATAAAATTTATTCGTCTGAGAATTATCTTGATCCCTTTTGGATTCGAGGTTCAAGAACATTCATGAACTTCGAGTAAATCAATCATCTTCTTGTAGTAATAATCCAGGAAGATACATTATCAACACACATAAAACAGAATGAAAATCAATTGCTTGTTCTGTTGTATGTCCCACAGACGATTTAACAGACGATCATCATCGAGACAAAGCATCAAAGACTGCATTGATGCAAAGAACAATATAACTACATTTGACAACATCTCTTTTAAAACAGATAGCAGTAGGCGAAGATACATATCCGAGGAGATAGCAAAACTCGGTAAAGGGAACATCAGTGCTCATATTTTTACATTCAGAGAGCTTTGCGTCGCTACCAAGAACTTCAACCCCGATAATCAGCTCGGTGAAGGCGGGTTTGGAAGGGTTTACAAAGGGCAGATAGAAACCCCGGAACAAGTTGTTGCGGTTAAGCAGCTAGACAGGAATGGTTACCAAGGGAACAGAGAGTTTCTTGTGGAAGTCATGATGTTGAGTCTCTTACATCATCAAAACCTTGTCAATTTGGTCGGATATTGCGCAGACGGTGATCAACGGATTCTTGTCTATGAATACATGCAAAATGGCTCTTTAGAGGATCATCTTCTAGAATTGGCGCGGAACAAGAAGAAGCCGTTGGATTGGGACACAAGAATGAAAGTTGCGGCAGGAGCAGCTAGAGGGCTTGAGTATCTACACGAAACAGCAGATCCTCCTGTTATCTACAGAGACTTCAAGGCCTCAAATATATTACTTGACGAAGAATTCAACCCAAAGCTTTCGGATTTCGGTTTAGCTAAGGTTGGTCCGACCGGTGGAGAGACTCATGTGTCAACGAGAGTGATGGGAACATACGGCTATTGTGCGCCTGAGTATGCTCTCACAGGACAGCTCACTGTGAAATCCGATGTATACAGCTTCGGAGTCGTGTTCTTGGAGATGATCACAGGAAGACGAGTCATTGACACAACAAAACCAACTGAAGAACAGAACTTAGTCACTTGGGCGAGTCCATTGTTCAAAGATAGGAGAAAGTTCACGTTAATGGCAGATCCATTGCTTGAAGGAAAGTATCCAATAAAAGGATTGTATCAAGCGCTTGCAGTAGCAGCAATGTGTCTTCAAGAAGAAGCAGCAACGAGACCAATGATGAGTGATGTAGTCACTGCGCTTGAGTACTTAGCCGTGACCAAAACCGAAGAAGATGGACAAACTGTAGAAGGAGAAGAAGAAGAAGAAGAAGAAGACGAAAGATCCAAACTTTGAGCAAATTTTTTTGTTTGTTTTCGTTTGTAATTTTCAAATGATCGGTTTTAGGAAATTTGATAACTTTACGAATTCACCAATGAAAAAAGAAGATTAAATGAGAGTTTTCGTGTTYCCCMATCGAACATTTTAAAGGATTTGCTGAGAATTTTGTAAAAAAAAAAAAAAAAAAAAAAAAAAAAAAAAAAAAAAAAAAAAAAAAAAAAAGAAAAAAAAAAAAAAAAAAACCTCGRGGGGGGGCCCGGAACCCAWTTCCCCCAAWAGGGAGCCGAATAACAATTCATGGGCCGCCGTTTAACAACGCCGGG

SEQ ID NO: 2751 - DNA, 1606 bp, Arabidopsis thaliana
  misc_feature (1)..(1606): Ceres cDNA ID no. 13648454
  misc_feature (1)..(1606): Ceres CLONE  ID no. 1339812
aaagttgtaagaaaataaaaaaaggggtcaaaaagaacaaaaaatcaaattttgggggggcgacaccataaaataaagagaaaaagcagagtccagaatccgttgccttgcccgcatctgcaactggaaaacacaaaaacagacgccacgatggatgaatgatttcgcaaatcgtcgagattttggaattcgatgaagagcgtatcaacctgggctttgtctttcttctccgacgaactttctcggcgagctgtttccgattgttatttatggaccaccgcgatttcgcttctcttaatccttctccttcatatcttcttttccactaaatttcgcttcttcacttctgctccttcttcttcttcttcttcttcttcttcttcctctccctctacagaatcagttcccgcgaactctcaatcaaggatatccaaactagtctctgatgaagatttgaaatttctgatcgagaatttggaggaggaaacaaatgattccacggagatatgggaacatgttattcacaaaagcaacgatcgcatttcatactctgctaaacgctgcaaacccaaagatggcggtggtcctatgaagtacctaagtgtcacggtcttcgagggtttctctgcagagattgtgagggacttttacatggacaatgattataggaaactatgggataagactgtggttgagcatgagcagttgcaggttgatagtaatactggaattgagattggtcgcaccattaaaaagtttcccttgttgacatcgagagagtacgttctagcttggagattgtggcaaggaaaggagaagaagttctactgtttcacaaaggaatgtgatcacaatatggtaccacaacagaggaagtatgtacgtgtaagttactttagatctggttggcgaatcaggcaagttcccggtagaaatgcgtgtgagatcaaaatgtttcaccaggagaatgctgggttaaatgttgagatggccaagctcgccttctcaaaaggcatatggagttacgtttgtaagatggaaaacgctctttgtaaatacatagcaaccagtcatagaacccaaggacccattctatctgctgtcaccttaatgaaagaggttccatcagagttagaaactgggacagataatgtcacaggctccatggaaacaagtagtggtgaaggagtgttgagtcatgttgtagccgccaaacagaagaaaaaaatgagaaagccatcaacgaaactgatagcaaaaggtctagtacttgtgggcggtgcgatctgcttgtcccgtggtccctcagccttaggtgctaaagtcgcattggcttacctcttgacgaagctgaacaaacgtggaacttctctgaatcagaccacccagaccaccaccatttaagtaaatttctcctgaactctggtagcttttggtatcaaattgttgtaccacagtagtactaccactagcgtatacaaaatgcaagtcggtgttgatatgaatgtaaaagcatacattataaacatacaagcctaaaggttatcattcttgtaattgtatgtactatgtaaggtctttatccctaaccaatcaatctttactg

SEQ ID NO: 2752 - protein, 403 aa, Arabidopsis thaliana
  misc_feature: PFam Name: START; PFam Description: START domain
  misc_feature: GI Number: 50908121; NR Description: putative membrane related protein [Oryza sativa (japonica cultivar-group)] >gi|47497322|dbj|BAD19363.1| putative membrane related protein
  misc_feature: GI Number: 21593272; NR Description: membrane related
  misc_feature: GI Number: 46798907; NR Description: membrane related protein
  misc_feature: GI Number: 18423599; NR Description: membrane related
  misc_feature: GI Number: 18033654; NR Description: putative nodule membrane
MKSVSTWALSFFSDELSRRAVSDCYLWTTAISLLLILLLHIFFSTKFRFFTSAPSSSSSSSSSSSPSTESVPANSQSRISKLVSDEDLKFLIENLEEETNDSTEIWEHVIHKSNDRISYSAKRCKPKDGGGPMKYLSVTVFEGFSAEIVRDFYMDNDYRKLWDKTVVEHEQLQVDSNTGIEIGRTIKKFPLLTSREYVLAWRLWQGKEKKFYCFTKECDHNMVPQQRKYVRVSYFRSGWRIRQVPGRNACEIKMFHQENAGLNVEMAKLAFSKGIWSYVCKMENALCKYIATSHRTQGPILSAVTLMKEVPSELETGTDNVTGSMETSSGEGVLSHVVAAKQKKKMRKPSTKLIAKGLVLVGGAICLSRGPSALGAKVALAYLLTKLNKRGTSLNQTTQTTTI

SEQ ID NO: 2753 - DNA, 1962 bp, Arabidopsis thaliana
  misc_feature (1)..(1962): Ceres cDNA ID no. 13648455
  misc_feature (1)..(1962): Ceres CLONE  ID no. 1334350
  misc_feature (1)..(1962): Also known as  Ceres CDNA ID no. 23659049
gtcgtctttttaaaaacgttttactttccacggcgaattttggtctgaatccaaattcttccctagtttgaaaaatcttctgtattctgaaaagagattttatgcgtatcgctgaaataggaagaaaacagattcctttccatttcccaaattttgtcattgagtcttggcatttcaaccaatcgcaatttattgaaattccggcgagtcattagatttttttggattccgtttcaaggtacggtgctttttcgcagattgagaagagcttaataagaaagatgacattgacgatcccaaacgcacctgggagctccgggtacttggatatgttcccagagagaaggatgtcgtattttgggaattcttacattctgggtttgactgtcactgccggaatcggtggccttctgttcggttatgatacaggtgtaatttccggtgcccttttgtacattaaggatgatttcgaagttgttaagcagagcagtttcttacaggaaactattgtaagtatggctttagttggtgccatgattggtgctgcagctggaggttggatcaatgactactacggtcgtaaaaaggcgactctttttgcagatgttgtctttgcagctggagctatcgttatggctgctgctcctgatccgtatgttttgatatcgggtcgtctcttggtcggtttaggagttggtgttgcttctgtgactgctccggtttatatagcggaagcatctccatcggaagttagaggtggacttgtgagcaccaacgtattgatgatcactggtggacagtttctttcatatctcgttaattctgctttcacacaggttccaggaacatggagatggatgcttggtgtttcaggcgttcccgctgtgattcagttcatcctcatgcttttcatgccagaatcccctcgatggcttttcatgaaaaatcgtaaagcggaagccatccaagtgctcgccagaacctatgacatctcgcggttagaagacgagattgatcatctttcagcggctgaagaggaagaaaaacaaaggaagcgcactgttggctacttggatgttttcagatccaaagaattgagacttgcatttcttgccggagcaggacttcaggcgtttcagcagttcactggtatcaatacagttatgtactacagccctacgatagtccaaatggctggatttcactcaaaccagctcgctttgttcctgtctctcattgttgctgccatgaatgctgctggaacagtcgtggggatttacttcatcgatcattgtggaaggaaaaagctagctctctcaagtttatttggcgtcattatatcactcttaatcctctcagtctcgtttttcaaacaatctgagacatcatctgatggagggctctatggttggctcgctgtgcttggcttagctctatacattgttttctttgcaccgggaatgggaccagtcccatggacggtgaactcagagatataccctcaacaataccgaggcatatgcggaggcatgtcagctacagttaactggatcagcaatttgattgtggcacaaacattcttgacaatcgcggaagctgctggaacaggaatgactttcttgattttggcgggaattgcggttcttgctgtaatctttgtgattgtgtttgtccctgagactcaagggctaacgttttcggaagttgaacagatttggaaagaaagagcttatggaaatatcagtggctggggcagtagcagtgatagcaacaacatggaagggttactcgagcagggatctcaatcttaaagatcttggatggctcatgagtcatgcatgacttacacattgtgaaatcacatagtagtaaaccgggattggttccggtttagcaatgtgagatgtatgtgatgttggaattgtaatgttcttaggaactgtgattgtaaataaatacatt

SEQ ID NO: 2754 - protein, 1962 aa, Arabidopsis thaliana
  misc_feature: PFam Name: Sugar_tr; PFam Description: Sugar (and other)
  misc_feature: PFam Name: MFS_1; PFam Description: Major Facilitator Superfamily
  misc_feature: GI Number: 29501739; NR Description: putative
  misc_feature: GI Number: 2289003; NR Description: putative membrane transporter [Arabidopsis thaliana] >gi|25308955|pir||G84864
  misc_feature: GI Number: 20465939; NR Description: putative membrane transporter protein [Arabidopsis thaliana] >gi|17380890|gb|AAL36257.1| putative membrane transporter protein [Arabidopsis thaliana] >gi|30689342|ref|NP_850393.1| sugar
  misc_feature: GI Number: 50934251; NR Description: putative proton myo-inositol transporter [Oryza sativa (japonica cultivar-group)] >gi|33146705|dbj|BAC79509.1| putative proton myo-inositol transporter [Oryza sativa (japonica cultivar-group)]
  misc_feature: GI Number: 28973605; NR Description: putative membrane transporter [Arabidopsis thaliana] >gi|7268398|emb|CAB78690.1| membrane transporter like protein [Arabidopsis thaliana] >gi|2245004|emb|CAB10424.1| membrane transporter like protein
GTCGTCTTTTTAAAAACGTTTTACTTTCCACGGCGAATTTTGGTCTGAATCCAAATTCTTCCCTAGTTTGAAAAATCTTCTGTATTCTGAAAAGAGATTTTATGCGTATCGCTGAAATAGGAAGAAAACAGATTCCTTTCCATTTCCCAAATTTTGTCATTGAGTCTTGGCATTTCAACCAATCGCAATTTATTGAAATTCCGGCGAGTCATTAGATTTTTTTGGATTCCGTTTCAAGGTACGGTGCTTTTTCGCAGATTGAGAAGAGCTTAATAAGAAAGATGACATTGACGATCCCAAACGCACCTGGGAGCTCCGGGTACTTGGATATGTTCCCAGAGAGAAGGATGTCGTATTTTGGGAATTCTTACATTCTGGGTTTGACTGTCACTGCCGGAATCGGTGGCCTTCTGTTCGGTTATGATACAGGTGTAATTTCCGGTGCCCTTTTGTACATTAAGGATGATTTCGAAGTTGTTAAGCAGAGCAGTTTCTTACAGGAAACTATTGTAAGTATGGCTTTAGTTGGTGCCATGATTGGTGCTGCAGCTGGAGGTTGGATCAATGACTACTACGGTCGTAAAAAGGCGACTCTTTTTGCAGATGTTGTCTTTGCAGCTGGAGCTATCGTTATGGCTGCTGCTCCTGATCCGTATGTTTTGATATCGGGTCGTCTCTTGGTCGGTTTAGGAGTTGGTGTTGCTTCTGTGACTGCTCCGGTTTATATAGCGGAAGCATCTCCATCGGAAGTTAGAGGTGGACTTGTGAGCACCAACGTATTGATGATCACTGGTGGACAGTTTCTTTCATATCTCGTTAATTCTGCTTTCACACAGGTTCCAGGAACATGGAGATGGATGCTTGGTGTTTCAGGCGTTCCCGCTGTGATTCAGTTCATCCTCATGCTTTTCATGCCAGAATCCCCTCGATGGCTTTTCATGAAAAATCGTAAAGCGGAAGCCATCCAAGTGCTCGCCAGAACCTATGACATCTCGCGGTTAGAAGACGAGATTGATCATCTTTCAGCGGCTGAAGAGGAAGAAAAACAAAGGAAGCGCACTGTTGGCTACTTGGATGTTTTCAGATCCAAAGAATTGAGACTTGCATTTCTTGCCGGAGCAGGACTTCAGGCGTTTCAGCAGTTCACTGGTATCAATACAGTTATGTACTACAGCCCTACGATAGTCCAAATGGCTGGATTTCACTCAAACCAGCTCGCTTTGTTCCTGTCTCTCATTGTTGCTGCCATGAATGCTGCTGGAACAGTCGTGGGGATTTACTTCATCGATCATTGTGGAAGGAAAAAGCTAGCTCTCTCAAGTTTATTTGGCGTCATTATATCACTCTTAATCCTCTCAGTCTCGTTTTTCAAACAATCTGAGACATCATCTGATGGAGGGCTCTATGGTTGGCTCGCTGTGCTTGGCTTAGCTCTATACATTGTTTTCTTTGCACCGGGAATGGGACCAGTCCCATGGACGGTGAACTCAGAGATATACCCTCAACAATACCGAGGCATATGCGGAGGCATGTCAGCTACAGTTAACTGGATCAGCAATTTGATTGTGGCACAAACATTCTTGACAATCGCGGAAGCTGCTGGAACAGGAATGACTTTCTTGATTTTGGCGGGAATTGCGGTTCTTGCTGTAATCTTTGTGATTGTGTTTGTCCCTGAGACTCAAGGGCTAACGTTTTCGGAAGTTGAACAGATTTGGAAAGAAAGAGCTTATGGAAATATCAGTGGCTGGGGCAGTAGCAGTGATAGCAACAACATGGAAGGGTTACTCGAGCAGGGATCTCAATCTTAAAGATCTTGGATGGCTCATGAGTCATGCATGACTTACACATTGTGAAATCACATAGTAGTAAACCGGGATTGGTTCCGGTTTAGCAATGTGAGATGTATGTGATGTTGGAATTGTAATGTTCTTAGGAACTGTGATTGTAAATAAATACATT

SEQ ID NO: 2755 - DNA, 546 bp, Arabidopsis thaliana
  misc_feature (1)..(546): Ceres cDNA ID no. 13648621
  misc_feature (1)..(546): Ceres CLONE  ID no. 1366992
  misc_feature (1)..(546): Also known as  Ceres CDNA ID no. 23660480
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
gattcataacaaaaaatgggttttataactcgatttttagttttcatgtcactcttcaccagtttggtttctggatttgctctacaaaagcttcctcttatacagttcgacgaaggttacacacagctctttggtgaccagaatcttattgttcacagagatggaaaatctgtccggttaacgcttgatgaaagaaccggttctggatttgtctcaaatgatatttacttgcatggcttcttcagttcctctatcaaattgccagcagattactctgcaggagttgttatcgccttttatttatcaaatggggacttatatgagaagaatcatgacgagattgattttgagtttttggggaatattagaggcagagaatggaggattcagaccaatannnnnaaaagtggataatcacacttgggcagagaagaaagatacaatctttggtttgatccaacagaggatttccatcaatacagtatcctttggtctctatctcacatcatattttatgtagacaatgttccgatcagagaagtcaaa

SEQ ID NO: 2756 - protein, 546 aa, Arabidopsis thaliana
  misc_feature: PFam Name: Glyco_hydro_16; PFam Description: Glycosyl
  misc_feature: GI Number: 21553987; NR Description: xyloglucan endo-transglycosylase, putative [Arabidopsis thaliana] >gi|2154611|dbj|BAA20290.1| endoxyloglucan transferase related protein [Arabidopsis thaliana] >gi|8778237|gb|AAF79246.1|
  misc_feature: GI Number: 31711806; NR Description: At2g01850 [Arabidopsis thaliana] >gi|2154609|dbj|BAA20289.1| endoxyloglucan transferase related protein [Arabidopsis thaliana] >gi|4522010|gb|AAD21783.1| xyloglucan endotransglycosylase >gi|38605340|sp|Q8LDS2|XT27_ARATH
  misc_feature: GI Number: 5533313; NR Description: endoxyloglucan
  misc_feature: GI Number: 21553969; NR Description: putative
  misc_feature: GI Number: 6681351; NR Description: ETAG-A3 [Lycopersicon
GATTCATAACAAAAAATGGGTTTTATAACTCGATTTTTAGTTTTCATGTCACTCTTCACCAGTTTGGTTTCTGGATTTGCTCTACAAAAGCTTCCTCTTATACAGTTCGACGAAGGTTACACACAGCTCTTTGGTGACCAGAATCTTATTGTTCACAGAGATGGAAAATCTGTCCGGTTAACGCTTGATGAAAGAACCGGTTCTGGATTTGTCTCAAATGATATTTACTTGCATGGCTTCTTCAGTTCCTCTATCAAATTGCCAGCAGATTACTCTGCAGGAGTTGTTATCGCCTTTTATTTATCAAATGGGGACTTATATGAGAAGAATCATGACGAGATTGATTTTGAGTTTTTGGGGAATATTAGAGGCAGAGAATGGAGGATTCAGACCAATANNNNNAAAAGTGGATAATCACACTTGGGCAGAGAAGAAAGATACAATCTTTGGTTTGATCCAACAGAGGATTTCCATCAATACAGTATCCTTTGGTCTCTATCTCACATCATATTTTATGTAGACAATGTTCCGATCAGAGAAGTCAAA

SEQ ID NO: 2757 - DNA, 1205 bp, Arabidopsis thaliana
  misc_feature (1)..(1205): Ceres cDNA ID no. 13648905
  misc_feature (1)..(1205): Ceres CLONE  ID no. 1367565
  misc_feature (1)..(1205): Also known as  Ceres CDNA ID no. 23660845
tgcaattctctctttctctctctctctctctctctctttatcttctttcttcaaagtctatcactttataaaaccctaattaaatctctaaactccttagcctctctctattctcagaaccttgtggttattctcaagaaaggtttcattttgagataaagtttgctgctctttctggttgtggatagatcaaaagaatggagattgcaagtcaagaagatcctattccaataaacactagttatggtaatagtggaggtgggcatgggaacatgaaccatcatcatcatgccaattctgcaccatcatctctcaacattactacttcaaacccactactagtctcctcaaatagtaatggtcttggtaaaaatcatgatcattctcatcatcatcatgtgggttacaacatcatggttaccaacatcaagaaagagaagcctgtggtgataaagtacaaggaatgcctaaagaaccatgcagctaccatgggaggcaatgccattgatggttgtggagagtttatgccaagtggtgaagaaggttccattgaagctctcacttgctcagtttgcaactgccatagaaactttcatagaagagaaaccgaaggtgaagagaaaacattcttttccccttacctcaaccaccaccaaccacctccgcagcagagaaaactcatgttccaccacaagatgatcaaatcaccattaccacaacaaatgataatgcctattggcgttacaaccgctggatccaactcagagtcagaggatcttatggaggaagaaggcggaggaagcttgacattccggcagccaccaccaccaccatcaccgtatagttacggacataatcagaagaaaaggtttaggacaaagtttacacaagagcaaaaggagaagatgattagttttgcggaaagagttggttggaagattcagagacaagaggaatctgttgttcaacagctttgtcaagagattggaattaggagaagagttcttaaagtttggatgcacaacaacaaacaaaatctctccaagaagagcaacaacgttagtaacaatgtcgacctttctgctggtaataacgacattactgaaaatcttgcttctactaatccttagttaagttcagattgttgttatataacttcactcatgtgattacttaattaattaagtactttcttatcgtatggt

SEQ ID NO: 2758 - protein, 1205 aa, Arabidopsis thaliana
  misc_feature: PFam Name: ZF-HD_dimer; PFam Description: ZF-HD protein
  misc_feature: PFam Name: Homeobox; PFam Description: Homeobox domain
  misc_feature: GI Number: 50900288; NR Description: putative ZF-HD homeobox protein [Oryza sativa (japonica cultivar-group)] >gi|46806323|dbj|BAD17515.1| putative ZF-HD homeobox protein [Oryza
  misc_feature: GI Number: 50946893; NR Description: putative ZF-HD homeobox protein [Oryza sativa (japonica cultivar-group)] >gi|42408573|dbj|BAD09750.1| putative ZF-HD homeobox protein [Oryza
  misc_feature: GI Number: 53689757; NR Description: ZF-HD homeobox
  misc_feature: GI Number: 48057668; NR Description: putative ZF-HD homeobox
  misc_feature: GI Number: 13374061; NR Description: ZF-HD homeobox protein
TGCAATTCTCTCTTTCTCTCTCTCTCTCTCTCTCTCTTTATCTTCTTTCTTCAAAGTCTATCACTTTATAAAACCCTAATTAAATCTCTAAACTCCTTAGCCTCTCTCTATTCTCAGAACCTTGTGGTTATTCTCAAGAAAGGTTTCATTTTGAGATAAAGTTTGCTGCTCTTTCTGGTTGTGGATAGATCAAAAGAATGGAGATTGCAAGTCAAGAAGATCCTATTCCAATAAACACTAGTTATGGTAATAGTGGAGGTGGGCATGGGAACATGAACCATCATCATCATGCCAATTCTGCACCATCATCTCTCAACATTACTACTTCAAACCCACTACTAGTCTCCTCAAATAGTAATGGTCTTGGTAAAAATCATGATCATTCTCATCATCATCATGTGGGTTACAACATCATGGTTACCAACATCAAGAAAGAGAAGCCTGTGGTGATAAAGTACAAGGAATGCCTAAAGAACCATGCAGCTACCATGGGAGGCAATGCCATTGATGGTTGTGGAGAGTTTATGCCAAGTGGTGAAGAAGGTTCCATTGAAGCTCTCACTTGCTCAGTTTGCAACTGCCATAGAAACTTTCATAGAAGAGAAACCGAAGGTGAAGAGAAAACATTCTTTTCCCCTTACCTCAACCACCACCAACCACCTCCGCAGCAGAGAAAACTCATGTTCCACCACAAGATGATCAAATCACCATTACCACAACAAATGATAATGCCTATTGGCGTTACAACCGCTGGATCCAACTCAGAGTCAGAGGATCTTATGGAGGAAGAAGGCGGAGGAAGCTTGACATTCCGGCAGCCACCACCACCACCATCACCGTATAGTTACGGACATAATCAGAAGAAAAGGTTTAGGACAAAGTTTACACAAGAGCAAAAGGAGAAGATGATTAGTTTTGCGGAAAGAGTTGGTTGGAAGATTCAGAGACAAGAGGAATCTGTTGTTCAACAGCTTTGTCAAGAGATTGGAATTAGGAGAAGAGTTCTTAAAGTTTGGATGCACAACAACAAACAAAATCTCTCCAAGAAGAGCAACAACGTTAGTAACAATGTCGACCTTTCTGCTGGTAATAACGACATTACTGAAAATCTTGCTTCTACTAATCCTTAGTTAAGTTCAGATTGTTGTTATATAACTTCACTCATGTGATTACTTAATTAATTAAGTACTTTCTTATCGTATGGT

SEQ ID NO: 2759 - DNA, 3652 bp, Arabidopsis thaliana
  misc_feature (1)..(3652): Ceres cDNA ID no. 13648943
  misc_feature (1)..(3652): Ceres CLONE  ID no. 268817
  misc_feature (1)..(3652): Also known as  Ceres CDNA ID no. 23486898
ggactcgcgcgcctgcaggtcgacactagtggatccaaagaattcgcggccgcgtcgactacggctgcgagaagacgacagaaggggatcccaagattctcctcttcgtcttccttataaactatctctctgtagagaagaaagcttggatccagattgagagagattcagagagtcacatcaccacactccatcttcagatctcatgatttaaactattccgacgtttcggtgttggaagcaactaagtgacgaatggaatccgaaggagaaaccgcgggaaagccgatgaagaacattgttccgcagacttgccagatctgtagtgacaatgttggcaagactgttgatggagatcgttttgtggcttgtgatatttgttcattcccagtttgtcggccttgctacgagtatgagaggaaagatgggaatcaatcttgtcctcagtgcaaaaccagatacaagaggctcaaaggtagtcctgctattcctggtgataaagacgaggatggcttagctgatgaaggtactgttgagttcaactaccctcagaaggagaaaatttcagagcggatgcttggttggcatcttactcgtgggaagggagaggaaatgggggaaccccagtatgataaagaggtctctcacaatcatcttcctcgtctcacgagcagacaagatacttcaggagagttttctgctgcctcacctgaacgcctctctgtatcttctactatcgctgggggaaagcgccttccctattcatcagatgtcaatcaatcaccaaatagaaggattgtggatcctgttggactcgggaatgtagcttggaaggagagagttgatggctggaaaatgaagcaagagaagaatactggtcctgtcagcacgcaggctgcttctgaaagaggtggagtagatattgatgccagcacagatatcctagcagatgaggctctgctgaatgacgaagcgaggcagcctctgtcaaggaaagtttcaattccttcatcacggatcaatccttacagaatggttattatgctgcggcttgttatcctttgtctcttcttgcattaccgtataacaaacccagtgccaaatgcctttgctctatggctggtctctgtgatatgtgagatctggtttgccttatcctggattttggatcagtttcccaagtggtttcctgtgaaccgtgaaacctacctcgacaggcttgctttaagatatgatcgtgaaggtgagccatcacagttagctgctgttgacattttcgtgagtactgttgaccccttgaaggagccaccccttgtgacagccaacacagtgctctctattctggctgttgactacccagttgacaaggtgtcctgttatgtttctgatgatggtgctgctatgttatcatttgaatcacttgcagaaacatcagagtttgctcgtaaatgggtaccattttgcaagaaatatagcatagagcctcgtgcaccagaatggtactttgctgcgaaaatagattacttgaaggataaagttcagacatcatttgtcaaagatcgtagagctatgaagagggaatatgaggaatttaaaatccgaatcaatgcacttgtttccaaagccctaaaatgtcctgaagaagggtgggttatgcaagatggcacaccgtggcctggaaataatacaagggaccatccaggaatgatccaggtcttcttagggcaaaatggtggacttgatgcagagggcaatgagctcccgcgtttggtatatgtttctcgagaaaagcgaccaggattccagcaccacaaaaaggctggtgctatgaatgcactggtgagagtttcagcagttcttaccaatggacctttcatcttgaatcttgattgtgatcattacataaataacagcaaagccttaagagaagcaatgtgcttcctgatggacccaaacctcgggaagcaagtttgttatgttcagttcccacaaagatttgatggtatcgataagaacgatagatatgctaatcgtaataccgtgttctttgatattaacttgagaggtttagatgggattcaaggacctgtatatgtcggaactggatgtgttttcaacagaacagcattatacggttatgaacctccaataaaagtaaaacacaagaagccaagtcttttatctaagctctgtggtggatcaagaaagaagaattccaaagctaagaaagagtcggacaaaaagaaatcaggcaggcatactgactcaactgttcctgtattcaacctcgatgacatagaagagggagttgaaggtgctggttttgatgatgaaaaggcgctcttaatgtcgcaaatgagcctggagaagcgatttggacagtctgctgtttttgttgcttctaccctaatggaaaatggtggtgttcctccttcagcaactccagaaaaccttctcaaagaggctatccatgtcattagttgtggttatgaggataagtcagattggggaatggagattggatggatctatggttctgtgacagaagatattctgactgggttcaaaatgcatgcccgtggatggcgatccatttactgcatgcctaagcttccagctttcaagggttctgctcctatcaatctttcagatcgtctgaaccaagtgctgaggtgggctttaggttcagttgagattctcttcagtcggcattgtcctatatggtatggttacaatgggaggctaaaatttcttgagaggtttgcgtatgtgaacaccaccatctaccctatcacctccattcctcttctcatgtattgtacattgccagccgtttgtctcttcaccaaccagtttattattcctcagattagtaacattgcaagtatatggtttctgtctctctttctctccattttcgccacgggtatactagaaatgaggtggagtggcgtaggcatagacgaatggtggagaaacgagcagttttgggtcattggtggagtatccgctcatttattcgctgtgtttcaaggtatcctcaaagtccttgccggtattgacacaaacttcacagttacctcaaaagcttcagatgaagacggagactttgctgagctctacttgttcaaatggacaacacttctgattccgccaacgacgctgctcattgtaaacttagtgggagttgttgcaggagtctcttatgctatcaacagtggataccaatcatggggaccactctttggtaagttgttctttgccttctgggtgattgttcacttgtaccctttcctcaagggtttgatgggtcgacagaaccggactcctaccattgttgtggtctggtctgttctcttggcttctatcttctcgttgttgtgggttaggattgatcccttcactagccgagtcactggcccggacattctggaatgtggaatcaactgttgagaagcgagcaaatatttacctgttttgagggttaaaaaaaacacagaatttaaattatttttcattgttttatttgttcacttttttacttttgttgtgtgtatctgtctgttcgttcttctgtcttggtgtcataaatttatgtgtagaatatatcttactctagttactttggaaagttataattaaagtgaaagcc

SEQ ID NO: 2760 - protein, 3652 aa, Arabidopsis thaliana
  misc_feature: PFam Name: Cellulose_synt; PFam Description: Cellulose synthase
  misc_feature: PFam Name: Glycos_transf_2; PFam Description: Glycosyl transferase
  misc_feature: GI Number: 49615365; NR Description: CesA2 [Acacia mangium]
  misc_feature: GI Number: 34419230; NR Description: TPA: cellulose
  misc_feature: GI Number: 13925884; NR Description: cellulose synthase
  misc_feature: GI Number: 37725361; NR Description: cellulose synthase
  misc_feature: GI Number: 39933010; NR Description: cellulose synthase
GGACTCGCGCGCCTGCAGGTCGACACTAGTGGATCCAAAGAATTCGCGGCCGCGTCGACTACGGCTGCGAGAAGACGACAGAAGGGGATCCCAAGATTCTCCTCTTCGTCTTCCTTATAAACTATCTCTCTGTAGAGAAGAAAGCTTGGATCCAGATTGAGAGAGATTCAGAGAGTCACATCACCACACTCCATCTTCAGATCTCATGATTTAAACTATTCCGACGTTTCGGTGTTGGAAGCAACTAAGTGACGAATGGAATCCGAAGGAGAAACCGCGGGAAAGCCGATGAAGAACATTGTTCCGCAGACTTGCCAGATCTGTAGTGACAATGTTGGCAAGACTGTTGATGGAGATCGTTTTGTGGCTTGTGATATTTGTTCATTCCCAGTTTGTCGGCCTTGCTACGAGTATGAGAGGAAAGATGGGAATCAATCTTGTCCTCAGTGCAAAACCAGATACAAGAGGCTCAAAGGTAGTCCTGCTATTCCTGGTGATAAAGACGAGGATGGCTTAGCTGATGAAGGTACTGTTGAGTTCAACTACCCTCAGAAGGAGAAAATTTCAGAGCGGATGCTTGGTTGGCATCTTACTCGTGGGAAGGGAGAGGAAATGGGGGAACCCCAGTATGATAAAGAGGTCTCTCACAATCATCTTCCTCGTCTCACGAGCAGACAAGATACTTCAGGAGAGTTTTCTGCTGCCTCACCTGAACGCCTCTCTGTATCTTCTACTATCGCTGGGGGAAAGCGCCTTCCCTATTCATCAGATGTCAATCAATCACCAAATAGAAGGATTGTGGATCCTGTTGGACTCGGGAATGTAGCTTGGAAGGAGAGAGTTGATGGCTGGAAAATGAAGCAAGAGAAGAATACTGGTCCTGTCAGCACGCAGGCTGCTTCTGAAAGAGGTGGAGTAGATATTGATGCCAGCACAGATATCCTAGCAGATGAGGCTCTGCTGAATGACGAAGCGAGGCAGCCTCTGTCAAGGAAAGTTTCAATTCCTTCATCACGGATCAATCCTTACAGAATGGTTATTATGCTGCGGCTTGTTATCCTTTGTCTCTTCTTGCATTACCGTATAACAAACCCAGTGCCAAATGCCTTTGCTCTATGGCTGGTCTCTGTGATATGTGAGATCTGGTTTGCCTTATCCTGGATTTTGGATCAGTTTCCCAAGTGGTTTCCTGTGAACCGTGAAACCTACCTCGACAGGCTTGCTTTAAGATATGATCGTGAAGGTGAGCCATCACAGTTAGCTGCTGTTGACATTTTCGTGAGTACTGTTGACCCCTTGAAGGAGCCACCCCTTGTGACAGCCAACACAGTGCTCTCTATTCTGGCTGTTGACTACCCAGTTGACAAGGTGTCCTGTTATGTTTCTGATGATGGTGCTGCTATGTTATCATTTGAATCACTTGCAGAAACATCAGAGTTTGCTCGTAAATGGGTACCATTTTGCAAGAAATATAGCATAGAGCCTCGTGCACCAGAATGGTACTTTGCTGCGAAAATAGATTACTTGAAGGATAAAGTTCAGACATCATTTGTCAAAGATCGTAGAGCTATGAAGAGGGAATATGAGGAATTTAAAATCCGAATCAATGCACTTGTTTCCAAAGCCCTAAAATGTCCTGAAGAAGGGTGGGTTATGCAAGATGGCACACCGTGGCCTGGAAATAATACAAGGGACCATCCAGGAATGATCCAGGTCTTCTTAGGGCAAAATGGTGGACTTGATGCAGAGGGCAATGAGCTCCCGCGTTTGGTATATGTTTCTCGAGAAAAGCGACCAGGATTCCAGCACCACAAAAAGGCTGGTGCTATGAATGCACTGGTGAGAGTTTCAGCAGTTCTTACCAATGGACCTTTCATCTTGAATCTTGATTGTGATCATTACATAAATAACAGCAAAGCCTTAAGAGAAGCAATGTGCTTCCTGATGGACCCAAACCTCGGGAAGCAAGTTTGTTATGTTCAGTTCCCACAAAGATTTGATGGTATCGATAAGAACGATAGATATGCTAATCGTAATACCGTGTTCTTTGATATTAACTTGAGAGGTTTAGATGGGATTCAAGGACCTGTATATGTCGGAACTGGATGTGTTTTCAACAGAACAGCATTATACGGTTATGAACCTCCAATAAAAGTAAAACACAAGAAGCCAAGTCTTTTATCTAAGCTCTGTGGTGGATCAAGAAAGAAGAATTCCAAAGCTAAGAAAGAGTCGGACAAAAAGAAATCAGGCAGGCATACTGACTCAACTGTTCCTGTATTCAACCTCGATGACATAGAAGAGGGAGTTGAAGGTGCTGGTTTTGATGATGAAAAGGCGCTCTTAATGTCGCAAATGAGCCTGGAGAAGCGATTTGGACAGTCTGCTGTTTTTGTTGCTTCTACCCTAATGGAAAATGGTGGTGTTCCTCCTTCAGCAACTCCAGAAAACCTTCTCAAAGAGGCTATCCATGTCATTAGTTGTGGTTATGAGGATAAGTCAGATTGGGGAATGGAGATTGGATGGATCTATGGTTCTGTGACAGAAGATATTCTGACTGGGTTCAAAATGCATGCCCGTGGATGGCGATCCATTTACTGCATGCCTAAGCTTCCAGCTTTCAAGGGTTCTGCTCCTATCAATCTTTCAGATCGTCTGAACCAAGTGCTGAGGTGGGCTTTAGGTTCAGTTGAGATTCTCTTCAGTCGGCATTGTCCTATATGGTATGGTTACAATGGGAGGCTAAAATTTCTTGAGAGGTTTGCGTATGTGAACACCACCATCTACCCTATCACCTCCATTCCTCTTCTCATGTATTGTACATTGCCAGCCGTTTGTCTCTTCACCAACCAGTTTATTATTCCTCAGATTAGTAACATTGCAAGTATATGGTTTCTGTCTCTCTTTCTCTCCATTTTCGCCACGGGTATACTAGAAATGAGGTGGAGTGGCGTAGGCATAGACGAATGGTGGAGAAACGAGCAGTTTTGGGTCATTGGTGGAGTATCCGCTCATTTATTCGCTGTGTTTCAAGGTATCCTCAAAGTCCTTGCCGGTATTGACACAAACTTCACAGTTACCTCAAAAGCTTCAGATGAAGACGGAGACTTTGCTGAGCTCTACTTGTTCAAATGGACAACACTTCTGATTCCGCCAACGACGCTGCTCATTGTAAACTTAGTGGGAGTTGTTGCAGGAGTCTCTTATGCTATCAACAGTGGATACCAATCATGGGGACCACTCTTTGGTAAGTTGTTCTTTGCCTTCTGGGTGATTGTTCACTTGTACCCTTTCCTCAAGGGTTTGATGGGTCGACAGAACCGGACTCCTACCATTGTTGTGGTCTGGTCTGTTCTCTTGGCTTCTATCTTCTCGTTGTTGTGGGTTAGGATTGATCCCTTCACTAGCCGAGTCACTGGCCCGGACATTCTGGAATGTGGAATCAACTGTTGAGAAGCGAGCAAATATTTACCTGTTTTGAGGGTTAAAAAAAACACAGAATTTAAATTATTTTTCATTGTTTTATTTGTTCACTTTTTTACTTTTGTTGTGTGTATCTGTCTGTTCGTTCTTCTGTCTTGGTGTCATAAATTTATGTGTAGAATATATCTTACTCTAGTTACTTTGGAAAGTTATAATTAAAGTGAAAGCC

SEQ ID NO: 2761 - DNA, 1050 bp, Arabidopsis thaliana
  misc_feature (1)..(1050): Ceres cDNA ID no. 13649040
  misc_feature (1)..(1050): Ceres CLONE  ID no. 1361977
  misc_feature (1)..(1050): Also known as  Ceres CDNA ID no. 23659513
gacaaaccaatctaactcaatacaagaatatctacaatctctagaaaatggcgatcacttacttgcttcctctgtttctttctcttatcatcacctcctctgtttcagctaatttccaaagagacgttgagatcacttggggtgatggtcgtggacagatcaagaacaatggagagcttctcactttatctctagataaatcctctggttctggattccaatccaaaaacgagtacttgtttggtaaagtctccatgcaaatgaagcttgtccctggaaactccgcaggaacagtcacaacactttacttgaaatcacctggaacaacatgggacgagatagatttcgagtttttagggaattcaagtggagaaccttacacacttcacacaaatgtctacacacaaggcaaaggagacaaagaacaacaattcaaactctggtttgatccaacagctaatttccacacttacactattctctggaacccacaaagaatcattttcaccgtcgatggaactccgatcagagaattcaagaacatggagtctctaggcactctgtttcccaagaacaaaccaatgagaatgtactcgagtctttggaacgctgatgattgggcaacgagaggtggtttggtcaaaaccgattggtctaaagctcctttcactgcttcttaccgtggctttcaacaagaagcttgtgtttggtcaaacggcaagtcttcttgtcctaatgcctcgaaacaggggactactactggctcgtggttgtcacaagagcttgactcaacagctcaacaaaggatgagatgggtgcagaggaactacatgatctataattattgtacggatgcgaagaggttccctcaaggtcttcctaaagagtgcttagctgcatagagagagtaaagagttgagagaggaacaagattttatttttctttgtggttataaaattctattcattttattgtagatcacgtgaattttattgatttgttttgtagtatactctatagttcgttaaagttataatattctctttgtt

SEQ ID NO: 2762 - protein, 1050 aa, Arabidopsis thaliana
  misc_feature: PFam Name: Glyco_hydro_16; PFam Description: Glycosyl
  misc_feature: PFam Name: XET_C; PFam Description: Xyloglucan
  misc_feature: GI Number: 9758317; NR Description: TCH4 protein [Arabidopsis thaliana] >gi|17386136|gb|AAL38614.1| AT5g57560/MUA2_13 [Arabidopsis thaliana] >gi|15777883|gb|AAL05902.1| AT5g57560/MUA2_13 [Arabidopsis thaliana]
  misc_feature: GI Number: 4539299; NR Description: xyloglucan endo-1, 4-beta-D-glucanase (XTR-6) [Arabidopsis thaliana] >gi|7269432|emb|CAB79436.1| xyloglucan endo-1, 4-beta-D-glucanase (XTR-6) [Arabidopsis thaliana] >gi|38605152|sp|Q38910|XT23_ARATH
  misc_feature: GI Number: 20259808; NR Description: xyloglucan endo-1, 4-beta-D-glucanase [Arabidopsis thaliana] >gi|17064792|gb|AAL32550.1| xyloglucan endo-1, 4-beta-D-glucanase
  misc_feature: GI Number: 29500899; NR Description: putative xyloglucan endotransglycosylase [Cucumis sativus] >gi|29500891|emb|CAD87535.1|
  misc_feature: GI Number: 29500901; NR Description: putative xyloglucan endotransglycosylase [Cucumis sativus] >gi|29500893|emb|CAD87536.1|
GACAAACCAATCTAACTCAATACAAGAATATCTACAATCTCTAGAAAATGGCGATCACTTACTTGCTTCCTCTGTTTCTTTCTCTTATCATCACCTCCTCTGTTTCAGCTAATTTCCAAAGAGACGTTGAGATCACTTGGGGTGATGGTCGTGGACAGATCAAGAACAATGGAGAGCTTCTCACTTTATCTCTAGATAAATCCTCTGGTTCTGGATTCCAATCCAAAAACGAGTACTTGTTTGGTAAAGTCTCCATGCAAATGAAGCTTGTCCCTGGAAACTCCGCAGGAACAGTCACAACACTTTACTTGAAATCACCTGGAACAACATGGGACGAGATAGATTTCGAGTTTTTAGGGAATTCAAGTGGAGAACCTTACACACTTCACACAAATGTCTACACACAAGGCAAAGGAGACAAAGAACAACAATTCAAACTCTGGTTTGATCCAACAGCTAATTTCCACACTTACACTATTCTCTGGAACCCACAAAGAATCATTTTCACCGTCGATGGAACTCCGATCAGAGAATTCAAGAACATGGAGTCTCTAGGCACTCTGTTTCCCAAGAACAAACCAATGAGAATGTACTCGAGTCTTTGGAACGCTGATGATTGGGCAACGAGAGGTGGTTTGGTCAAAACCGATTGGTCTAAAGCTCCTTTCACTGCTTCTTACCGTGGCTTTCAACAAGAAGCTTGTGTTTGGTCAAACGGCAAGTCTTCTTGTCCTAATGCCTCGAAACAGGGGACTACTACTGGCTCGTGGTTGTCACAAGAGCTTGACTCAACAGCTCAACAAAGGATGAGATGGGTGCAGAGGAACTACATGATCTATAATTATTGTACGGATGCGAAGAGGTTCCCTCAAGGTCTTCCTAAAGAGTGCTTAGCTGCATAGAGAGAGTAAAGAGTTGAGAGAGGAACAAGATTTTATTTTTCTTTGTGGTTATAAAATTCTATTCATTTTATTGTAGATCACGTGAATTTTATTGATTTGTTTTGTAGTATACTCTATAGTTCGTTAAAGTTATAATATTCTCTTTGTT

SEQ ID NO: 2763 - DNA, 1401 bp, Arabidopsis thaliana
  misc_feature (1)..(1401): Ceres cDNA ID no. 13649216
  misc_feature (1)..(1401): Ceres CLONE  ID no. 1369087
  misc_feature (1)..(1401): Also known as  Ceres CDNA ID no. 23659988
gaattttcagttttcattaccatttcctcttcaccggggaaaattctgttagtttctttcgccggtagttgaaagaaaatgtctcctgcgatcaaagcaccgctcttaccaaaccaagagccttcatcatcatcatcggagaaccatggatcattcgccggagctgtgtttaacatctcgacaagcatcgtcggagctggaattatggcgattccggcggctttcaaagtcctaggtgtaatcccatctctatcgataatcgtaatcatagcttggctctccaatgtatcagctgggtttttaatgaaatccagtctcgccggagaatcaacaacttacgccggcgtgatgaaggaatcgttcggaaaatctggtgccgttgctgttacggttgttacaatggttgtgacttttgggtctatgattattttctcgattatcattggtgatgttatttcgggtaatgagaaagatggaatcatacatttaggtcttcttcaagaatggtttggttctcattggtggaatacgagattctttggtttgttgttcatctttgtcttcctcttccttcctttagtcttatgcagacgtgtagaaagattggcatttagttctgcaatttcgtttctgcttgcgttactctttgttgtcataagctcggtgttagcgattattgctctcgtgcaagggaagacaaagcctccgagactcttccctgaactcaatgatggtggattatcgtttttcagtctcttcactgcttcccctgtcattgtaacagccttcacctttcatttcaatgtccatccagtagcattcgaactcaaagatccattaaatgtgctttcagcaacaaggatctctgtgattctgtgtgctacgatctactcagctactggtctcttttgttaccttctgtttggggattccactatgacagatgttctaatgaactttgatcaaagcaccagttcttcggttggttcattactaaatgatattgttagactcagctacgcgattcacctcatgctcgtgtttcctctgctcaacttctcgcttagagccaacctcgacgaactcttgttccctatgaagctttctttagtggaagacaacaaaagattcttcgcactcacttttccattactgatatcttgtttcttgggtgcaattgccataccagacatttggtacttctttcagttcttgggatcaacttctacagtctctatagcattcatctttccagctgcaattgtcctacggaatgtaaatggtttctcgactttaagagagaagattgtagcttcagtaatgcttgttcttgctgttgccacaagtatcatcgctatttcgacaaatatatacactttcacagcaacagaagaaacatga

SEQ ID NO: 2764 - protein, 1401 aa, Arabidopsis thaliana
  misc_feature: PFam Name: Aa_trans; PFam Description: Transmembrane amino
  misc_feature: PFam Name: Trp_Tyr_perm; PFam Description:
  misc_feature: GI Number: 42569800; NR Description: amino acid transporter
  misc_feature: GI Number: 51535770; NR Description: putative system A
  misc_feature: GI Number: 50905855; NR Description: putative amino acid transporter A1 [Oryza sativa (japonica cultivar-group)] >gi|46390972|dbj|BAD16485.1| putative amino acid transporter A1 [Oryza sativa (japonica cultivar-group)] [Oryza sativa (japonica
  misc_feature: GI Number: 15241555; NR Description: amino acid transporter
  misc_feature: GI Number: 9758059; NR Description: amino acid
GAATTTTCAGTTTTCATTACCATTTCCTCTTCACCGGGGAAAATTCTGTTAGTTTCTTTCGCCGGTAGTTGAAAGAAAATGTCTCCTGCGATCAAAGCACCGCTCTTACCAAACCAAGAGCCTTCATCATCATCATCGGAGAACCATGGATCATTCGCCGGAGCTGTGTTTAACATCTCGACAAGCATCGTCGGAGCTGGAATTATGGCGATTCCGGCGGCTTTCAAAGTCCTAGGTGTAATCCCATCTCTATCGATAATCGTAATCATAGCTTGGCTCTCCAATGTATCAGCTGGGTTTTTAATGAAATCCAGTCTCGCCGGAGAATCAACAACTTACGCCGGCGTGATGAAGGAATCGTTCGGAAAATCTGGTGCCGTTGCTGTTACGGTTGTTACAATGGTTGTGACTTTTGGGTCTATGATTATTTTCTCGATTATCATTGGTGATGTTATTTCGGGTAATGAGAAAGATGGAATCATACATTTAGGTCTTCTTCAAGAATGGTTTGGTTCTCATTGGTGGAATACGAGATTCTTTGGTTTGTTGTTCATCTTTGTCTTCCTCTTCCTTCCTTTAGTCTTATGCAGACGTGTAGAAAGATTGGCATTTAGTTCTGCAATTTCGTTTCTGCTTGCGTTACTCTTTGTTGTCATAAGCTCGGTGTTAGCGATTATTGCTCTCGTGCAAGGGAAGACAAAGCCTCCGAGACTCTTCCCTGAACTCAATGATGGTGGATTATCGTTTTTCAGTCTCTTCACTGCTTCCCCTGTCATTGTAACAGCCTTCACCTTTCATTTCAATGTCCATCCAGTAGCATTCGAACTCAAAGATCCATTAAATGTGCTTTCAGCAACAAGGATCTCTGTGATTCTGTGTGCTACGATCTACTCAGCTACTGGTCTCTTTTGTTACCTTCTGTTTGGGGATTCCACTATGACAGATGTTCTAATGAACTTTGATCAAAGCACCAGTTCTTCGGTTGGTTCATTACTAAATGATATTGTTAGACTCAGCTACGCGATTCACCTCATGCTCGTGTTTCCTCTGCTCAACTTCTCGCTTAGAGCCAACCTCGACGAACTCTTGTTCCCTATGAAGCTTTCTTTAGTGGAAGACAACAAAAGATTCTTCGCACTCACTTTTCCATTACTGATATCTTGTTTCTTGGGTGCAATTGCCATACCAGACATTTGGTACTTCTTTCAGTTCTTGGGATCAACTTCTACAGTCTCTATAGCATTCATCTTTCCAGCTGCAATTGTCCTACGGAATGTAAATGGTTTCTCGACTTTAAGAGAGAAGATTGTAGCTTCAGTAATGCTTGTTCTTGCTGTTGCCACAAGTATCATCGCTATTTCGACAAATATATACACTTTCACAGCAACAGAAGAAACATGA

SEQ ID NO: 2765 - DNA, 1331 bp, Arabidopsis thaliana
  misc_feature (1)..(1331): Ceres cDNA ID no. 13649303
  misc_feature (1)..(1331): Ceres CLONE  ID no. 1370016
  misc_feature (1)..(1331): Also known as  Ceres CDNA ID no. 23660853
ggtgaacatagaaacactcaaaacttcaaaccaaaaaaaataaatgggagaggaagagaagaaaccagaagcagcagaggaaaagaaaatggaagagaagaaaccagaagagaaaaaagaaggagaagacaagaaagtggatgctgagaaaaaaggagaagattctgacaagaagcctcaagaaggagaatctaacaaagattccaaagaagattctgctccggcggcgcctgaggctccagcaccgcctcctccgccgcaagaggttgttcttaaggtttacatgcactgtgaaggatgtgctagaaaagtccgccgttgtctcaaaggcttcgaaggagtggaagatgtgatgactgattgtaaaacggggaaagtggtggtgaaaggtgagaaagctgatccattgaaagtattagctagagttcagaggaagacccaccgtcaagttcagcttctgtctccgattcctcctccgcctccgccgccggagaagaaagcagaggaggataaacccattgtggaagagaagaaagtggagcctccggtggttgtgacggtggttcttaaggttcacatgcactgtgaagcttgtgcgacagagatcaagaaacggatcatgagaatgaaaggagtggaatctgctgaatccgacttaaagagttctcaagtgacggtgaaaggagtttttgaaccacaaaagcttgtagaatacgtttataagcgaaccggaaaacatgctgcgatcatgaaaatcgacccaccgcctccaccaccacctgaggaggcggctgcggcagcggaaggagagaagaaggaagaagaaaagggagaaggagaatccaaaggcgaagaagggaaggatgataaggcgaagacggacgaagaaaagaaagaaggggatggtggtaaaggggaaggcgaagcagcggataatggcggtggggaggaagaaggcaaagttgtggaggtgagaaagatagagaatccttattactactactattaccaaccaccgcgtgtggcgattccgcctatggaaatgccgccacacgcttatccgcctcaattgttcagcgacgagaatccaaatgcatgtactgtaatgtaacaaagaaaaacgcaaatgctataaagggtataatggggaatattttgaacaattttgatgaagtgggtacatggcatttgctgtctctcatagcatgtggtttctttctaatgtgtttgtgcagctcttttcttttaactgtaatttacattttaaaaaactcgcaacacgagttatttttaatggctatatataaacaataaaataataaatttactct

SEQ ID NO: 2766 - protein, 1331 aa, Arabidopsis thaliana
  misc_feature: PFam Name: Ribosomal_S25; PFam Description: S25 ribosomal protein
  misc_feature: PFam Name: HMA; PFam Description: Heavy-metal-associated domain
  misc_feature: PFam Name: ig; PFam Description: Immunoglobulin domain
  misc_feature: PFam Name: I-set; PFam Description: Immunoglobulin I-set domain
  misc_feature: PFam Name: HSP90; PFam Description: Hsp90 protein
  misc_feature: GI Number: 4097547; NR Description: ATFP3 [Arabidopsis thaliana]
  misc_feature: GI Number: 24417342; NR Description: unknown [Arabidopsis thaliana]
  misc_feature: GI Number: 50908877; NR Description: putative farnesylated protein [Oryza sativa (japonica cultivar-group)] >gi|48716470|dbj|BAD23076.1| putative farnesylated protein [Oryza
  misc_feature: GI Number: 42573467; NR Description: copper-binding family
  misc_feature: GI Number: 21594005; NR Description: unknown [Arabidopsis thaliana]
GGTGAACATAGAAACACTCAAAACTTCAAACCAAAAAAAATAAATGGGAGAGGAAGAGAAGAAACCAGAAGCAGCAGAGGAAAAGAAAATGGAAGAGAAGAAACCAGAAGAGAAAAAAGAAGGAGAAGACAAGAAAGTGGATGCTGAGAAAAAAGGAGAAGATTCTGACAAGAAGCCTCAAGAAGGAGAATCTAACAAAGATTCCAAAGAAGATTCTGCTCCGGCGGCGCCTGAGGCTCCAGCACCGCCTCCTCCGCCGCAAGAGGTTGTTCTTAAGGTTTACATGCACTGTGAAGGATGTGCTAGAAAAGTCCGCCGTTGTCTCAAAGGCTTCGAAGGAGTGGAAGATGTGATGACTGATTGTAAAACGGGGAAAGTGGTGGTGAAAGGTGAGAAAGCTGATCCATTGAAAGTATTAGCTAGAGTTCAGAGGAAGACCCACCGTCAAGTTCAGCTTCTGTCTCCGATTCCTCCTCCGCCTCCGCCGCCGGAGAAGAAAGCAGAGGAGGATAAACCCATTGTGGAAGAGAAGAAAGTGGAGCCTCCGGTGGTTGTGACGGTGGTTCTTAAGGTTCACATGCACTGTGAAGCTTGTGCGACAGAGATCAAGAAACGGATCATGAGAATGAAAGGAGTGGAATCTGCTGAATCCGACTTAAAGAGTTCTCAAGTGACGGTGAAAGGAGTTTTTGAACCACAAAAGCTTGTAGAATACGTTTATAAGCGAACCGGAAAACATGCTGCGATCATGAAAATCGACCCACCGCCTCCACCACCACCTGAGGAGGCGGCTGCGGCAGCGGAAGGAGAGAAGAAGGAAGAAGAAAAGGGAGAAGGAGAATCCAAAGGCGAAGAAGGGAAGGATGATAAGGCGAAGACGGACGAAGAAAAGAAAGAAGGGGATGGTGGTAAAGGGGAAGGCGAAGCAGCGGATAATGGCGGTGGGGAGGAAGAAGGCAAAGTTGTGGAGGTGAGAAAGATAGAGAATCCTTATTACTACTACTATTACCAACCACCGCGTGTGGCGATTCCGCCTATGGAAATGCCGCCACACGCTTATCCGCCTCAATTGTTCAGCGACGAGAATCCAAATGCATGTACTGTAATGTAACAAAGAAAAACGCAAATGCTATAAAGGGTATAATGGGGAATATTTTGAACAATTTTGATGAAGTGGGTACATGGCATTTGCTGTCTCTCATAGCATGTGGTTTCTTTCTAATGTGTTTGTGCAGCTCTTTTCTTTTAACTGTAATTTACATTTTAAAAAACTCGCAACACGAGTTATTTTTAATGGCTATATATAAACAATAAAATAATAAATTTACTCT

SEQ ID NO: 2767 - DNA, 2124 bp, Arabidopsis thaliana
  misc_feature (1)..(2124): Ceres cDNA ID no. 13649412
  misc_feature (1)..(2124): Ceres CLONE  ID no. 1359803
  misc_feature (1)..(2124): Also known as  Ceres CDNA ID no. 23481452
gaattttgatttatcaaagaaaactcctttgtgagagattatttatgtactcttgattcagagaggataatccaattccgagttttctgagtcgtaatttagagagaatccaattcgatggatttagatatgaacggaggaaacaagagagtctttcaaagactgggcggtggctctaatcggccgacgacggactcaaatcagaaggtttgtttccactggcgagctggccggtgcaatcgttacccatgcccttacctgcatagagaattgccgggtccgggttcgggtccagtagcagcttcttcaaataaaagggtcgctgatgaatctgggtttgcgggtccgagtcaccggagagggcctgggttcagcgggactgctaataactggggaagatttggtgggaacagaacggtgaccaagacggagaaactttgcaaattctgggttgatggaaattgcccttatggtgataaatgtagatacttgcattgctggagcaaaggagatagtttctccttgttgacgcagcttgacgggcatcagaaggttgttactgggattgctctgccttcaggatcagataagctttacacggcgagtaaagatgaaactgtgcgaatatgggattgtgcttctggacagtgtacaggtgtactcaatcttggtggggaagttggctgcatcattagtgaaggtccctggctattggttggcatgccaaatcttgttaaggcgtggaatatccaaaacaatgcagacctgagcctcaatggacctgttggccaagtatattcattggttgtgggtactgatctattgttcgctggcacacaagatggctctattttggtttggagatacaatagcaccactagctgttttgatccagctgcatcactattgggtcacacgcttgcagttgtctctttatatgttggggcaaacagactctattctggtgccatggacaattctataaaagtttggagcctggataatctgcagtgtattcaaacgcttacagagcatacatcagttgttatgtctctcatttgctgggatcagtttcttctgtcatgttcattggacaataccgtcaagatatgggctgctactgaaggtggaaacttagaagtgacatatactcacaaagaagaatacggcgtgctagctctctgtggcgtccatgatgcagaagccaagccagtattgctatgttcgtgcaatgacaattcgttgcacctctatgatttgccatccatgtcagaccaagaggctcctctgcgtaatggagtagaacacaagattttcgaagtacttccgtttgtggatgatgattacggtggagtcatcgtggagatgaaaactcctatggatactaagaatttcgttgcagcgcttagagattcattcgagcagtggcgcttacagggtaaaaagggagtctggttgaacttgcctctctcacacgtaaacctcgtggaacccgcggttaaggaaggtttccggtatcaccatgctgagccaacttacctgatgctagtttattggattccggaagccgagagtactattcctttgaatgcttcccatcgtgttcgtgtaggtgctgttgtcttgaaccataacaaagaggaaaaatacggttcattatgcggatcaggtatctggaagatcccaacaggagttgttgacgagggtgaggagattttcgccgcagccattagagaagtaaaagaagaaacaggcgtaagaagatccatatatcttaatatcgacactgagtttttggagattctagctttctgccaaacccacgagtcattttttgcaaagtcagatttattcttcgtttgtctcttgagacctacctccttcgatattcaaaaacaggacttagagatcgaagcagctcaatggatgcggttcgaggactctgcctctcaacctatcacacacaagaacgatctcttcaaagatattcaccacatttgctcaatgaaaatggagaagagctatagtggtttttcaaaaaaacctattacaactttctttgacgacaagttaggttatctctacttgaataaacaagaagatatggaacaacctatttcttaa

SEQ ID NO: 2768 - protein, 2124 aa, Arabidopsis thaliana
  misc_feature: PFam Name: WD40; PFam Description: WD domain, G-beta repeat
  misc_feature: PFam Name: zf-CCCH; PFam Description: Zinc finger
  misc_feature: GI Number: 12057164; NR Description: zfwd1 protein [Arabidopsis thaliana] >gi|30686888|ref|NP_194274.2| WD-40 repeat
  misc_feature: GI Number: 12057166; NR Description: zfwd2 protein
  misc_feature: GI Number: 12057168; NR Description: zfwd3 protein
  misc_feature: GI Number: 50919691; NR Description: Putative zfwd1 protein [Oryza sativa (japonica cultivar-group)] >gi|15451619|gb|AAK98743.1| Putative zfwd1 protein with similarity to myosin heavy chain proteins [Oryza sativa]
  misc_feature: GI Number: 60463414; NR Description: myosin heavy chain
GAATTTTGATTTATCAAAGAAAACTCCTTTGTGAGAGATTATTTATGTACTCTTGATTCAGAGAGGATAATCCAATTCCGAGTTTTCTGAGTCGTAATTTAGAGAGAATCCAATTCGATGGATTTAGATATGAACGGAGGAAACAAGAGAGTCTTTCAAAGACTGGGCGGTGGCTCTAATCGGCCGACGACGGACTCAAATCAGAAGGTTTGTTTCCACTGGCGAGCTGGCCGGTGCAATCGTTACCCATGCCCTTACCTGCATAGAGAATTGCCGGGTCCGGGTTCGGGTCCAGTAGCAGCTTCTTCAAATAAAAGGGTCGCTGATGAATCTGGGTTTGCGGGTCCGAGTCACCGGAGAGGGCCTGGGTTCAGCGGGACTGCTAATAACTGGGGAAGATTTGGTGGGAACAGAACGGTGACCAAGACGGAGAAACTTTGCAAATTCTGGGTTGATGGAAATTGCCCTTATGGTGATAAATGTAGATACTTGCATTGCTGGAGCAAAGGAGATAGTTTCTCCTTGTTGACGCAGCTTGACGGGCATCAGAAGGTTGTTACTGGGATTGCTCTGCCTTCAGGATCAGATAAGCTTTACACGGCGAGTAAAGATGAAACTGTGCGAATATGGGATTGTGCTTCTGGACAGTGTACAGGTGTACTCAATCTTGGTGGGGAAGTTGGCTGCATCATTAGTGAAGGTCCCTGGCTATTGGTTGGCATGCCAAATCTTGTTAAGGCGTGGAATATCCAAAACAATGCAGACCTGAGCCTCAATGGACCTGTTGGCCAAGTATATTCATTGGTTGTGGGTACTGATCTATTGTTCGCTGGCACACAAGATGGCTCTATTTTGGTTTGGAGATACAATAGCACCACTAGCTGTTTTGATCCAGCTGCATCACTATTGGGTCACACGCTTGCAGTTGTCTCTTTATATGTTGGGGCAAACAGACTCTATTCTGGTGCCATGGACAATTCTATAAAAGTTTGGAGCCTGGATAATCTGCAGTGTATTCAAACGCTTACAGAGCATACATCAGTTGTTATGTCTCTCATTTGCTGGGATCAGTTTCTTCTGTCATGTTCATTGGACAATACCGTCAAGATATGGGCTGCTACTGAAGGTGGAAACTTAGAAGTGACATATACTCACAAAGAAGAATACGGCGTGCTAGCTCTCTGTGGCGTCCATGATGCAGAAGCCAAGCCAGTATTGCTATGTTCGTGCAATGACAATTCGTTGCACCTCTATGATTTGCCATCCATGTCAGACCAAGAGGCTCCTCTGCGTAATGGAGTAGAACACAAGATTTTCGAAGTACTTCCGTTTGTGGATGATGATTACGGTGGAGTCATCGTGGAGATGAAAACTCCTATGGATACTAAGAATTTCGTTGCAGCGCTTAGAGATTCATTCGAGCAGTGGCGCTTACAGGGTAAAAAGGGAGTCTGGTTGAACTTGCCTCTCTCACACGTAAACCTCGTGGAACCCGCGGTTAAGGAAGGTTTCCGGTATCACCATGCTGAGCCAACTTACCTGATGCTAGTTTATTGGATTCCGGAAGCCGAGAGTACTATTCCTTTGAATGCTTCCCATCGTGTTCGTGTAGGTGCTGTTGTCTTGAACCATAACAAAGAGGAAAAATACGGTTCATTATGCGGATCAGGTATCTGGAAGATCCCAACAGGAGTTGTTGACGAGGGTGAGGAGATTTTCGCCGCAGCCATTAGAGAAGTAAAAGAAGAAACAGGCGTAAGAAGATCCATATATCTTAATATCGACACTGAGTTTTTGGAGATTCTAGCTTTCTGCCAAACCCACGAGTCATTTTTTGCAAAGTCAGATTTATTCTTCGTTTGTCTCTTGAGACCTACCTCCTTCGATATTCAAAAACAGGACTTAGAGATCGAAGCAGCTCAATGGATGCGGTTCGAGGACTCTGCCTCTCAACCTATCACACACAAGAACGATCTCTTCAAAGATATTCACCACATTTGCTCAATGAAAATGGAGAAGAGCTATAGTGGTTTTTCAAAAAAACCTATTACAACTTTCTTTGACGACAAGTTAGGTTATCTCTACTTGAATAAACAAGAAGATATGGAACAACCTATTTCTTAA

SEQ ID NO: 2769 - DNA, 1907 bp, Arabidopsis thaliana
  misc_feature (1)..(1907): Ceres cDNA ID no. 13649492
  misc_feature (1)..(1907): Ceres CLONE  ID no. 1360425
  misc_feature (1)..(1907): Also known as  Ceres CDNA ID no. 23659740
gtaaactttttaagatcctttacattttctttaagtctttatcaaatacttgtcatattgtagattcttatataggtgtctatatacatgcacataaagctgtgtaatatgtaatcataagttagagaaacagatttggcttttcctctcttgttctctgttgagtattcttcttggcatctcctctatattaaactcgaaagagaaacaaaacagagaaacctctaaagctttcttttttgttctcatgacattttcttgtcacaaaccaaactcgagaagaaaagttcttgtatacaaatcaaccaacattcattgtttttaaaagggtcccatgacccattgtggagatagctttgttttcatcttccaacattaacacccaccccaaaatcttgattacttttgatagaaacatatgcaacaagtggaataattccaatacagataagatccacacaacacttttttctccttctattctcttgtatcttctcattatagtctcgatgaagatgctgagacttagaaagaagcaacatttggtgtttctactatgcgtgtggtgtttggtggtggattggagcaaagcagaaacagaggaaagtgatggaagtcccatggagaaaacagagcaagctgctctatactctaccattcaaggctttgttggtgaatcttggaatggctcttatctttatcctgacccttgtggctggactcctatccagggtgtgacttgtgatatctatgatgagctttggtatgtaactgctctaagctttgggactatgaaagacaactctcttgcttgttctgaaagtccagtgatcagaccacaactctttgagctcaagcacctcaagtctctctctcttttcaactgcttcacaacgcctaaccgatatctagcttcaatctccgatgaaaagtggttggatctctctaaaagcttggagagacttgagatcagatcaaacccgggactgataggtgaactcccttctgtcatcactaacctcaccaaccttcaatctctggtggtgctagaaaacaagttaacaggtccattgccagtgaatttggccaagttaaccagattgagacgtttagtactgtctggaaaccggttcacagggagaatacctgaggtctacgggttaaccggattgttgatattggatgtgagcaggaatttcttatctggggcgttgcctttaagcgttggaggattgtattctctgctgaaacttgatcttagtaacaattacttggaaggaaagttacctagagagctagagtccttgaagaatctcactctattggacttgagaaacaacagattatcaggtgggttgagtaaagagatccaagagatgacttctttggtagaactggttctgtccaataatcgcctagccggggacttgacaggaataaagtggagaaatctgaagaatttagtggttcttgatctctccaacacaggcttaaaaggggagattcctggttcaatcttggagctcaagaaactgaggtttttgggtttgagcaacaacaatctcggaggcaaactcattccacaaatggaaaccgaaatgcctagtctcagcgcgctttacgtgaatggaaataacatcagcggagagttggaattctctaggtacttttatgagagaatgggaaggagacttggtgtttgggggaaccctaatctgtgttacaacggagatgagaccaagaaccttagcgatcatgttcctttcggagtgaaccaatgtaagagaattaaggcagataaatattagaaccctcgttctgaatcaaagggtttgtgataacaaaaacttggaatgatacaaagctgtggtcttttcaattttgttattgcatcttatttctatagc

SEQ ID NO: 2770 - protein, 1907 aa, Arabidopsis thaliana
  misc_feature: PFam Name: LRR_1; PFam Description: Leucine Rich Repeat
  misc_feature: GI Number: 15230865; NR Description: leucine rich repeat
  misc_feature: GI Number: 34894182; NR Description: P0439B06.12 [Oryza
  misc_feature: GI Number: 34910824; NR Description: putative Hcr2-0B [Oryza sativa (japonica cultivar-group)] >gi|12328502|dbj|BAB21161.1| putative Hcr2-0B [Oryza sativa (japonica cultivar-group)] >gi|15289814|dbj|BAB63512.1| putative Hcr2-0B [Oryza sativa
  misc_feature: GI Number: 51535694; NR Description: leucine-rich repeat protein-like [Oryza sativa (japonica cultivar-group)] >gi|51535491|dbj|BAD37387.1| leucine-rich repeat protein-like
  misc_feature: GI Number: 3894387; NR Description: Hcr2-0B [Lycopersicon
GTAAACTTTTTAAGATCCTTTACATTTTCTTTAAGTCTTTATCAAATACTTGTCATATTGTAGATTCTTATATAGGTGTCTATATACATGCACATAAAGCTGTGTAATATGTAATCATAAGTTAGAGAAACAGATTTGGCTTTTCCTCTCTTGTTCTCTGTTGAGTATTCTTCTTGGCATCTCCTCTATATTAAACTCGAAAGAGAAACAAAACAGAGAAACCTCTAAAGCTTTCTTTTTTGTTCTCATGACATTTTCTTGTCACAAACCAAACTCGAGAAGAAAAGTTCTTGTATACAAATCAACCAACATTCATTGTTTTTAAAAGGGTCCCATGACCCATTGTGGAGATAGCTTTGTTTTCATCTTCCAACATTAACACCCACCCCAAAATCTTGATTACTTTTGATAGAAACATATGCAACAAGTGGAATAATTCCAATACAGATAAGATCCACACAACACTTTTTTCTCCTTCTATTCTCTTGTATCTTCTCATTATAGTCTCGATGAAGATGCTGAGACTTAGAAAGAAGCAACATTTGGTGTTTCTACTATGCGTGTGGTGTTTGGTGGTGGATTGGAGCAAAGCAGAAACAGAGGAAAGTGATGGAAGTCCCATGGAGAAAACAGAGCAAGCTGCTCTATACTCTACCATTCAAGGCTTTGTTGGTGAATCTTGGAATGGCTCTTATCTTTATCCTGACCCTTGTGGCTGGACTCCTATCCAGGGTGTGACTTGTGATATCTATGATGAGCTTTGGTATGTAACTGCTCTAAGCTTTGGGACTATGAAAGACAACTCTCTTGCTTGTTCTGAAAGTCCAGTGATCAGACCACAACTCTTTGAGCTCAAGCACCTCAAGTCTCTCTCTCTTTTCAACTGCTTCACAACGCCTAACCGATATCTAGCTTCAATCTCCGATGAAAAGTGGTTGGATCTCTCTAAAAGCTTGGAGAGACTTGAGATCAGATCAAACCCGGGACTGATAGGTGAACTCCCTTCTGTCATCACTAACCTCACCAACCTTCAATCTCTGGTGGTGCTAGAAAACAAGTTAACAGGTCCATTGCCAGTGAATTTGGCCAAGTTAACCAGATTGAGACGTTTAGTACTGTCTGGAAACCGGTTCACAGGGAGAATACCTGAGGTCTACGGGTTAACCGGATTGTTGATATTGGATGTGAGCAGGAATTTCTTATCTGGGGCGTTGCCTTTAAGCGTTGGAGGATTGTATTCTCTGCTGAAACTTGATCTTAGTAACAATTACTTGGAAGGAAAGTTACCTAGAGAGCTAGAGTCCTTGAAGAATCTCACTCTATTGGACTTGAGAAACAACAGATTATCAGGTGGGTTGAGTAAAGAGATCCAAGAGATGACTTCTTTGGTAGAACTGGTTCTGTCCAATAATCGCCTAGCCGGGGACTTGACAGGAATAAAGTGGAGAAATCTGAAGAATTTAGTGGTTCTTGATCTCTCCAACACAGGCTTAAAAGGGGAGATTCCTGGTTCAATCTTGGAGCTCAAGAAACTGAGGTTTTTGGGTTTGAGCAACAACAATCTCGGAGGCAAACTCATTCCACAAATGGAAACCGAAATGCCTAGTCTCAGCGCGCTTTACGTGAATGGAAATAACATCAGCGGAGAGTTGGAATTCTCTAGGTACTTTTATGAGAGAATGGGAAGGAGACTTGGTGTTTGGGGGAACCCTAATCTGTGTTACAACGGAGATGAGACCAAGAACCTTAGCGATCATGTTCCTTTCGGAGTGAACCAATGTAAGAGAATTAAGGCAGATAAATATTAGAACCCTCGTTCTGAATCAAAGGGTTTGTGATAACAAAAACTTGGAATGATACAAAGCTGTGGTCTTTTCAATTTTGTTATTGCATCTTATTTCTATAGC

SEQ ID NO: 2771 - DNA, 704 bp, Arabidopsis thaliana
  misc_feature (1)..(704): Ceres cDNA ID no. 13649572
  misc_feature (1)..(704): Ceres CLONE  ID no. 1361819
  misc_feature (1)..(704): Also known as  Ceres CDNA ID no. 23481558
aaattcattccctcctcctcttcatctcttttgcagatatggatggttattattctctgtctcccatctctgtcctccaccggattaaagattccttccatttcgccgtctctgcccttctcgccaacctcttctccgctctcttcaccttcttcttcgctttagtggggactttgctgggagcattgacaggggctttgatcggccaagaaacagagagcggtttcatcagaggagccgccgttggtgctatctcaggcgccgtcttctccatcgaagtctttgaatcttccctcctcctttggcaatccgatgagtctggaattggatgccttctctacttgattgatgtcattgctagccttttgagcgggaggcttgttcgtgagcgtatcggtcctgcaatgctaagtgccgtccagagtcagatgggagctgtggagtcccagttccaagatcatacagacatctttgacactgccatttcaaagggtctcactggggactctctcaacaggatccctaaggtccgaatcacagacacctctccggagattgtctcttgctctgtctgccttcaggactttcaggtgggagagacagttagaagtttgccgcactgccatcatatgttccacctaccatgcatcgacaaatggcttcgcaggcatgcttcttgtcccttgtgcagaagacatctttga

SEQ ID NO: 2772 - protein, 704 aa, Arabidopsis thaliana
  misc_feature: PFam Name: zf-C3HC4; PFam Description: Zinc finger, C3HC4
  misc_feature: GI Number: 27524904; NR Description: NEP1-interacting protein 2 [Arabidopsis thaliana] >gi|30680091|ref|NP_179364.2| zinc finger
  misc_feature: GI Number: 27524902; NR Description: NEP1-interacting protein
  misc_feature: GI Number: 18855037; NR Description: putative zinc finger
  misc_feature: GI Number: 50937111; NR Description: putative NEP1-interacting protein 2 [Oryza sativa (japonica cultivar-group)] >gi|33146606|dbj|BAC79837.1| putative NEP1-interacting protein 2 [Oryza sativa (japonica cultivar-group)] [Oryza sativa (japonica
  misc_feature: GI Number: 38228693; NR Description: zinc finger protein
AAATTCATTCCCTCCTCCTCTTCATCTCTTTTGCAGATATGGATGGTTATTATTCTCTGTCTCCCATCTCTGTCCTCCACCGGATTAAAGATTCCTTCCATTTCGCCGTCTCTGCCCTTCTCGCCAACCTCTTCTCCGCTCTCTTCACCTTCTTCTTCGCTTTAGTGGGGACTTTGCTGGGAGCATTGACAGGGGCTTTGATCGGCCAAGAAACAGAGAGCGGTTTCATCAGAGGAGCCGCCGTTGGTGCTATCTCAGGCGCCGTCTTCTCCATCGAAGTCTTTGAATCTTCCCTCCTCCTTTGGCAATCCGATGAGTCTGGAATTGGATGCCTTCTCTACTTGATTGATGTCATTGCTAGCCTTTTGAGCGGGAGGCTTGTTCGTGAGCGTATCGGTCCTGCAATGCTAAGTGCCGTCCAGAGTCAGATGGGAGCTGTGGAGTCCCAGTTCCAAGATCATACAGACATCTTTGACACTGCCATTTCAAAGGGTCTCACTGGGGACTCTCTCAACAGGATCCCTAAGGTCCGAATCACAGACACCTCTCCGGAGATTGTCTCTTGCTCTGTCTGCCTTCAGGACTTTCAGGTGGGAGAGACAGTTAGAAGTTTGCCGCACTGCCATCATATGTTCCACCTACCATGCATCGACAAATGGCTTCGCAGGCATGCTTCTTGTCCCTTGTGCAGAAGACATCTTTGA

SEQ ID NO: 2773 - DNA, 1298 bp, Arabidopsis thaliana
  misc_feature (1)..(1298): Ceres cDNA ID no. 13650391
  misc_feature (1)..(1298): Also known as  Ceres CDNA ID no. 23481558
aatttttcaaaaaaaaaaaaaaaaaaggtcgactcatcctccggcgggagtagaaaattcttcttggttctgcagggtttttgaatagtttgtgtattgaagattgtctgaaatggaagcagctattactcagaggattcagtacccatcatgggttgattgtagaaaagttgagtgtaagccgcagcgtggttcattgcggtattctcagcaggttaaggtagatagaaggtttagaggtctttctttggctcgcttgcaacctgaaagaagaaatgatcaacgaagagcagtttctccagcggtttcctgttctgataacaattcctcagcgttgttggagactggaagtgtttatccatttgatgaagatattctcaagagaaaagcagaagaggttaaaccgtatttgaatggacgatctatgtaccttgtcggaatgatgggttctgggaaaacaactgtgggaaagttaatgtccaaagtgctcggttatacgttctttgactgcgacactttgattgaacaggcgatgaatggaacttctgttgcagagatatttgttcatcacggagagaatttttttagaggaaaggagaccgatgcgcttaagaagctctcttcgaggtatcaagttgttgtttccacaggtggaggtgcagttataagacccattaactggaagtatatgcataaaggaatcagcatttggctagatgtgcctctagaagcattagcccatagaatcgctgctgttggaactgattcacgaccactgctacacgatgaatcaggagatgcatactcagtggctttcaaacgtctctcggctatttgggacgagcgcggtgaagcatacacaaacgcaaatgccagagtctccttagaaaatattgcagcaaagcgtggctataaaaatgtctcagatctcacaccaactgaaattgctatcgaggccttcgagcaagttctgagctttctagagaaagaagaaactatggagatcccagacggcgacctctaatttcccagccttcttttctccgtctcttcatttatctgtttaatcaactaaacgaagcaatcactcatcaccaggccattgagcaagttcagagacaaagaagacctctagttactggttccgggtcattggagcttacacgagcctaattttgactggaactatggtttattgaaagaagattcaatacatgtatatataaaatatatacttttttttttgtttcagtatcatccttcttctcttttccttacaataagaattaagaaaaagg

SEQ ID NO: 2774 - protein, 1298 aa, Arabidopsis thaliana
  misc_feature: PFam Name: zf-C3HC4; PFam Description: Zinc finger, C3HC4
  misc_feature: GI Number: 27524904; NR Description: NEP1-interacting protein 2 [Arabidopsis thaliana] >gi|30680091|ref|NP_179364.2| zinc finger
  misc_feature: GI Number: 27524902; NR Description: NEP1-interacting protein
  misc_feature: GI Number: 18855037; NR Description: putative zinc finger
  misc_feature: GI Number: 50937111; NR Description: putative NEP1-interacting protein 2 [Oryza sativa (japonica cultivar-group)] >gi|33146606|dbj|BAC79837.1| putative NEP1-interacting protein 2 [Oryza sativa (japonica cultivar-group)] [Oryza sativa (japonica
  misc_feature: GI Number: 38228693; NR Description: zinc finger protein
AATTTTTCAAAAAAAAAAAAAAAAAAGGTCGACTCATCCTCCGGCGGGAGTAGAAAATTCTTCTTGGTTCTGCAGGGTTTTTGAATAGTTTGTGTATTGAAGATTGTCTGAAATGGAAGCAGCTATTACTCAGAGGATTCAGTACCCATCATGGGTTGATTGTAGAAAAGTTGAGTGTAAGCCGCAGCGTGGTTCATTGCGGTATTCTCAGCAGGTTAAGGTAGATAGAAGGTTTAGAGGTCTTTCTTTGGCTCGCTTGCAACCTGAAAGAAGAAATGATCAACGAAGAGCAGTTTCTCCAGCGGTTTCCTGTTCTGATAACAATTCCTCAGCGTTGTTGGAGACTGGAAGTGTTTATCCATTTGATGAAGATATTCTCAAGAGAAAAGCAGAAGAGGTTAAACCGTATTTGAATGGACGATCTATGTACCTTGTCGGAATGATGGGTTCTGGGAAAACAACTGTGGGAAAGTTAATGTCCAAAGTGCTCGGTTATACGTTCTTTGACTGCGACACTTTGATTGAACAGGCGATGAATGGAACTTCTGTTGCAGAGATATTTGTTCATCACGGAGAGAATTTTTTTAGAGGAAAGGAGACCGATGCGCTTAAGAAGCTCTCTTCGAGGTATCAAGTTGTTGTTTCCACAGGTGGAGGTGCAGTTATAAGACCCATTAACTGGAAGTATATGCATAAAGGAATCAGCATTTGGCTAGATGTGCCTCTAGAAGCATTAGCCCATAGAATCGCTGCTGTTGGAACTGATTCACGACCACTGCTACACGATGAATCAGGAGATGCATACTCAGTGGCTTTCAAACGTCTCTCGGCTATTTGGGACGAGCGCGGTGAAGCATACACAAACGCAAATGCCAGAGTCTCCTTAGAAAATATTGCAGCAAAGCGTGGCTATAAAAATGTCTCAGATCTCACACCAACTGAAATTGCTATCGAGGCCTTCGAGCAAGTTCTGAGCTTTCTAGAGAAAGAAGAAACTATGGAGATCCCAGACGGCGACCTCTAATTTCCCAGCCTTCTTTTCTCCGTCTCTTCATTTATCTGTTTAATCAACTAAACGAAGCAATCACTCATCACCAGGCCATTGAGCAAGTTCAGAGACAAAGAAGACCTCTAGTTACTGGTTCCGGGTCATTGGAGCTTACACGAGCCTAATTTTGACTGGAACTATGGTTTATTGAAAGAAGATTCAATACATGTATATATAAAATATATACTTTTTTTTTTGTTTCAGTATCATCCTTCTTCTCTTTTCCTTACAATAAGAATTAAGAAAAAGG

SEQ ID NO: 2775 - DNA, 1526 bp, Arabidopsis thaliana
  misc_feature (1)..(1526): Ceres cDNA ID no. 13650807
catcggtgtctggaacagcgatgaactcttgcaagaaggcaactgtgataagggtggatagtgcaaatgaatatgggattcttcttgaagttgtacaaatccttactgatcttaaccttactatcactaaggcgtacatatcttctgatggtggttggtttatggatgtatttaatgtcactgatcaagatggtaacaaagtcactgatgaagttgttctagactatatccaaaagtctcttgggcctgaagcttgtttctccacttccatgagatcagttggtgtcataccatcaacagacagcacggttattgagttaactggatgtgacagaccaggtctgctgtctgaactgtcagctgttttgacccatctcaaatgcagtgtcctcaacgctgagatttggacacacaacaccagagcagctgctgtgatgcaggtcacagatgacttaaccgggtgtggcatttctgatccagagaggttgtctcggatcaagaaccttctcagaaatgtgcttaagggaagcaacacaccaagggaagctaaaaccgtagtgtctcatggggaggtccacacggataggaggcttcatcagatgatgtttgaggatagagactatgaacaccgtttggtggatgatgattcctctatccaagatgaaaggcaaagaccagatgtttgtgttgataattggctcgataaggattactctgtggtcacagttagatgtaaagacagaccaaagcttctgttcgacacagtctgcactttgactgatatgcagtatgtggttttccatggaagtgttgatactgagggcaccgaggcgtttcaggagtattatgtgagacatatagatggatcccctgtgaaatcagaggcagagaagcaaagagtcatacaatgtcttgaagcagctatcaaaagaagagtatctgagggattgaagttggaactgtgcacgacggatagagtaggcttattgtcaaacgtgactcgcatattccgtgaaaacagcctaacggtcacaagagctgaagtgaaaaccaaaggaggcaaagctctaaacacattctatgtcagtgatgcatctggttactcaatcgatgctaagaccatagattccataagacaaaccataggccaaactattctcaaagtcaagaacaaccctcaagaacaacaacaaagacagaaatcgccttctcacgaatcaccgacaagatttctctttgggggtctcttcaagtcgaaatcttttgtcaactttggcttggtccgttcctactcttgaagaacaacttcacttagctgtgaggtttcaatctcatctaggttttaactgctttaaacttgagaagaatctgtaaatctatcgccagatataatcttaaattcttggtctaggatccaactttgggtagggaaaaaaagacaaaagagttttagttgatgtcatgactaagtgttaagtgttaacctactcttcttgtatatatatcaaatcctcattatcttcttc

SEQ ID NO: 2776 - protein, 431 aa, Arabidopsis thaliana
  misc_feature: PFam Name: ACT; PFam Description: ACT domain
  misc_feature: GI Number: 42572033; NR Description: ACT domain containing
  misc_feature: GI Number: 25370627; NR Description: protein F4N2.2 [imported] - Arabidopsis thaliana
  misc_feature: GI Number: 34896992; NR Description: putative ACT domain repeat protein [Oryza sativa (japonica cultivar-group)] >gi|28875985|gb|AAO59994.1| putative ACT domain repeat protein
  misc_feature: GI Number: 21593552; NR Description: unknown [Arabidopsis thaliana]
  misc_feature: GI Number: 51964082; NR Description: PREDICTED P0470G10.34 gene product [Oryza sativa (japonica cultivar-group)] >gi|50909425|ref|XP_466201.1| putative ACT domain-containing protein [Oryza sativa (japonica cultivar-group)] [Oryza sativa
SVSGTAMNSCKKATVIRVDSANEYGILLEVVQILTDLNLTITKAYISSDGGWFMDVFNVTDQDGNKVTDEVVLDYIQKSLGPEACFSTSMRSVGVIPSTDSTVIELTGCDRPGLLSELSAVLTHLKCSVLNAEIWTHNTRAAAVMQVTDDLTGCGISDPERLSRIKNLLRNVLKGSNTPREAKTVVSHGEVHTDRRLHQMMFEDRDYEHRLVDDDSSIQDERQRPDVCVDNWLDKDYSVVTVRCKDRPKLLFDTVCTLTDMQYVVFHGSVDTEGTEAFQEYYVRHIDGSPVKSEAEKQRVIQCLEAAIKRRVSEGLKLELCTTDRVGLLSNVTRIFRENSLTVTRAEVKTKGGKALNTFYVSDASGYSIDAKTIDSIRQTIGQTILKVKNNPQEQQQRQKSPSHESPTRFLFGGLFKSKSFVNFGLVRSYS

SEQ ID NO: 2777 - DNA, 2003 bp, Arabidopsis thaliana
  misc_feature (1)..(2003): Ceres cDNA ID no. 13651026
  misc_feature (1)..(2003): Also known as  Ceres CDNA ID no. 23481558
agtctctctctcggctttatccaaaggttccttcgtttactccgcttctatggaagaagcttgaatccttctctcttcttcttctccttcttcccttgacatttttgttctgagaagcaacatggccctcggtggcttgatttcaaatcggaacttcggttccttcatcggctcaggcaatggttgtcagagacttggaaaaagtggtgcagaggtttccaagctttttccaaatgcattgttgtgccgtaatcatcaacctctgcaagctagtttacatcatgaatcgggacacatgagaagaagttttggatgtttccttcaaccaagaatggacagtgtaattaggtttaggaacagtatcaagatcaacagatctcgtgcttactacaaatcagaggagtcagatatcacggaaggagttgtgccatcggctgatggctcagctgaagctattttagttgaaggaaatctacagaacgcatctccatggtggcagcagtttcctagacgctgggtgatcgtcttgttatgcttttcgtcttttcttctttgcaatatggaccgtgtgaacatgagcattgcaattcttcccatgtcacaagaatataactggagtagtgcaactgttggcttaattcagtcctctttcttctggggctatttacttactcagattctgggaggtatatgggcagataagtttggcgggaaggttgttttaggttttggtgttgtctggtggtcctttgccactattatgacacctattgctgctagacttggtcttccttttttgcttgtagtgcgggcgttcatgggcattggcgagggtgttgcaatgcctgctatgaacaacatgctttctaaatggatccctgtctcagagagaagcagatcgcttgcactggtctatagtggcatgtatcttggttccgtcacaggattggcattctctcctatgctaatcaccaagttcggatggccatctgttttctactcgtttggctccctcggaagtatatggtttttgctatggctaaaatttgcatatagctctcccaaggatgacccggacctaagtgaagaagaaaaaaaggttatactgggaggtagcaaaccaagggaacctgttacagtgattccatggaagctaatactgtctaaacccccagtctgggctctcataatttcccacttctgccataattggggaactttcatactattgacatggatgcccacatattacaatcaggtcttgaagttcaacctcactgaatccgggctactatgcgttttgccatggctaaccatggctgtttttgctaatattggaggttggattgctgatactcttgtgagcagaggtctttcaattacaaacgttcgaaagattatgcaatcaattggttttctaggccctgccttcttcctgagtcagctgagccatgtcaaaactccagcaatggcagttctctgcatggcatgcagtcagggctctgatgcattctctcagtcgggtctctactctaatcatcaagacattggcccacgatacgctggtgtactcttaggactatcaaacacagcaggagtcctagctggtgtctttggcactgcagctactggttacatcctccaacgaggttcatgggatgatgtgttcaaagtagcagttgcactgtatctaattggaactctggtctggaacttgttcgcaaccggagaaaaaattctcgactagaaccaagaaactaatagctgcagtgaaattgtgtgaggaagctttatatttgttctttctctgcttataaatttgatctgatagtgagatcaaaatggttcgctggtctgtttcataaagtaacatgttaaagaaaagatgtatttttttggaacttgactcttttgaagcttacaatttgatggggatggagaaaaagaaaccaaaacaaaaacaatcaaacttttttactttaggaagaagagtatttgcttac

SEQ ID NO: 2778 - protein, 2003 aa, Arabidopsis thaliana
  misc_feature: PFam Name: zf-C3HC4; PFam Description: Zinc finger, C3HC4
  misc_feature: GI Number: 27524904; NR Description: NEP1-interacting protein 2 [Arabidopsis thaliana] >gi|30680091|ref|NP_179364.2| zinc finger
  misc_feature: GI Number: 27524902; NR Description: NEP1-interacting protein
  misc_feature: GI Number: 18855037; NR Description: putative zinc finger
  misc_feature: GI Number: 50937111; NR Description: putative NEP1-interacting protein 2 [Oryza sativa (japonica cultivar-group)] >gi|33146606|dbj|BAC79837.1| putative NEP1-interacting protein 2 [Oryza sativa (japonica cultivar-group)] [Oryza sativa (japonica
  misc_feature: GI Number: 38228693; NR Description: zinc finger protein
AGTCTCTCTCTCGGCTTTATCCAAAGGTTCCTTCGTTTACTCCGCTTCTATGGAAGAAGCTTGAATCCTTCTCTCTTCTTCTTCTCCTTCTTCCCTTGACATTTTTGTTCTGAGAAGCAACATGGCCCTCGGTGGCTTGATTTCAAATCGGAACTTCGGTTCCTTCATCGGCTCAGGCAATGGTTGTCAGAGACTTGGAAAAAGTGGTGCAGAGGTTTCCAAGCTTTTTCCAAATGCATTGTTGTGCCGTAATCATCAACCTCTGCAAGCTAGTTTACATCATGAATCGGGACACATGAGAAGAAGTTTTGGATGTTTCCTTCAACCAAGAATGGACAGTGTAATTAGGTTTAGGAACAGTATCAAGATCAACAGATCTCGTGCTTACTACAAATCAGAGGAGTCAGATATCACGGAAGGAGTTGTGCCATCGGCTGATGGCTCAGCTGAAGCTATTTTAGTTGAAGGAAATCTACAGAACGCATCTCCATGGTGGCAGCAGTTTCCTAGACGCTGGGTGATCGTCTTGTTATGCTTTTCGTCTTTTCTTCTTTGCAATATGGACCGTGTGAACATGAGCATTGCAATTCTTCCCATGTCACAAGAATATAACTGGAGTAGTGCAACTGTTGGCTTAATTCAGTCCTCTTTCTTCTGGGGCTATTTACTTACTCAGATTCTGGGAGGTATATGGGCAGATAAGTTTGGCGGGAAGGTTGTTTTAGGTTTTGGTGTTGTCTGGTGGTCCTTTGCCACTATTATGACACCTATTGCTGCTAGACTTGGTCTTCCTTTTTTGCTTGTAGTGCGGGCGTTCATGGGCATTGGCGAGGGTGTTGCAATGCCTGCTATGAACAACATGCTTTCTAAATGGATCCCTGTCTCAGAGAGAAGCAGATCGCTTGCACTGGTCTATAGTGGCATGTATCTTGGTTCCGTCACAGGATTGGCATTCTCTCCTATGCTAATCACCAAGTTCGGATGGCCATCTGTTTTCTACTCGTTTGGCTCCCTCGGAAGTATATGGTTTTTGCTATGGCTAAAATTTGCATATAGCTCTCCCAAGGATGACCCGGACCTAAGTGAAGAAGAAAAAAAGGTTATACTGGGAGGTAGCAAACCAAGGGAACCTGTTACAGTGATTCCATGGAAGCTAATACTGTCTAAACCCCCAGTCTGGGCTCTCATAATTTCCCACTTCTGCCATAATTGGGGAACTTTCATACTATTGACATGGATGCCCACATATTACAATCAGGTCTTGAAGTTCAACCTCACTGAATCCGGGCTACTATGCGTTTTGCCATGGCTAACCATGGCTGTTTTTGCTAATATTGGAGGTTGGATTGCTGATACTCTTGTGAGCAGAGGTCTTTCAATTACAAACGTTCGAAAGATTATGCAATCAATTGGTTTTCTAGGCCCTGCCTTCTTCCTGAGTCAGCTGAGCCATGTCAAAACTCCAGCAATGGCAGTTCTCTGCATGGCATGCAGTCAGGGCTCTGATGCATTCTCTCAGTCGGGTCTCTACTCTAATCATCAAGACATTGGCCCACGATACGCTGGTGTACTCTTAGGACTATCAAACACAGCAGGAGTCCTAGCTGGTGTCTTTGGCACTGCAGCTACTGGTTACATCCTCCAACGAGGTTCATGGGATGATGTGTTCAAAGTAGCAGTTGCACTGTATCTAATTGGAACTCTGGTCTGGAACTTGTTCGCAACCGGAGAAAAAATTCTCGACTAGAACCAAGAAACTAATAGCTGCAGTGAAATTGTGTGAGGAAGCTTTATATTTGTTCTTTCTCTGCTTATAAATTTGATCTGATAGTGAGATCAAAATGGTTCGCTGGTCTGTTTCATAAAGTAACATGTTAAAGAAAAGATGTATTTTTTTGGAACTTGACTCTTTTGAAGCTTACAATTTGATGGGGATGGAGAAAAAGAAACCAAAACAAAAACAATCAAACTTTTTTACTTTAGGAAGAAGAGTATTTGCTTAC

SEQ ID NO: 2779 - DNA, 2428 bp, Arabidopsis thaliana
  misc_feature (1)..(2428): Ceres cDNA ID no. 13651220
  misc_feature (1)..(2428): Ceres CLONE  ID no. 1208120
aaaataaaagcttataattaaagaaccataaagacgaacacaaaagaaactctcacattctcaagagtttctttcttctttcaatggctttactaactttcttgccggagaacgcagaggcgccacaaaaacacaagccaacgtctagcaaacgaaagaaacgcgataatcccaccgaccaaacgcagacacagaaacataaaccgcagaaaccgaagaaagcagtacctccgaagcagccatcttcatgggaccaaatcaagaacctattgacttgcaaacaaatcgaagggtcaagagtccatgatccttccaagaactctcaatctggtccgtccatgacaactaacttatctccttccaagcttggctcgtcgtgcagctccatttgcagctttagagacgtggctcacggcaacactcgtgtggttcatagagctgatcactcaccagacgtaggtaactcggctactcctaactcggagactcggcttctgactcggaaacctggtcaacacggttcttcttcgtctcggtctcttacatctggctcaacgagatctaacgccagtgggagttacacgtcatcgtcaacgacttcgtttagagccatgcagttccgtaaactctccggatgttacgaatgtcacatgatcgttgacccgagcaggtatccgatttcgcctagggtttgtgcttgttcccaatgtggagaagttttccccaagcttgaaagcttagagcttcatcaagcagttcgtcacgcaggtaaggctttttttttccttttaacaaaaattgtttgactttatcacttacctcaaattaattaattacgctttagctacaattttttattttttggtgtgtggtagtcacatttttaaatttaaccctaagtatctagtgagattttcgtaaatgcgaatggcttggcaaagtaagattatgttttgtatccttggaaaaaaacttaagatctcagtccatgatttgacttgtgaatgatgatacaacctttgtttgtttagtattgattgaataattagcattaacacatgttttccggcgtataggcccttggatttatcgatagatttaccataatgctaagcaaataattaacgaacatgctttcattaatatatatcttagacttcgttgtttcttaatggaatcaagatctcagtgttattgtcggtgattatatcgatcaaataagttaggatgatttggccgtatgttacagattgtttttggaatagagattcatacgtatttttagagaaagatacaaaagagaataggaatataactggagaacaagatatattctatggtctccaaatccgtcgttttgcttggaaacacttaccatgcgatgggaccattgtactataaaaagaaacagctgtctctgctcttaactaaattcaatgtccccctgaaatattacgtgtcatttttcaattcgacagtatcagaattaaaacccctcacctgacaaaaaccgaattatagaactgtctttaatgtcccaaaaactcagatttttgttttgacttgcatatttttcctgattttatgagcaaaaacgttgtcgtttaattgcagtttcggagttaggtccggaggattcgggtcgaaacatagtggagatcatattcaaatcaagctggcttaaaaaagacagtcccatctgtcagatcgaacggatattaaaagtccacaacactcaacgtacgatccaacggtttgaggattgccgagacgcagtgaaggcgcgtgcacttcaagcaaccagaaaagatgctcgttgtgccgccgacggcaacgagctcttacgttttcactgcaccactctcacttgttcactcggagctcgtggctcttcttctctctgctctaacctccctgtttgtggcgtctgcaccgtgattcgccacggtttccaaggaaaatctggtggcggaggagccaacgtcgcaaacgccggtgtgaggacgacggcgagcagcggaagagctgatgatttgctgaggtgtagcgatgatgcgaggagagtgatgcttgtgtgccgtgtgatcgctgggagagttaagcgagttgatttaccggcggcggatgcttcggctacagcggagaagaagtcaacggtggaggataactcggtggttggagtttcttcgagtggtggtacgtttgactcggtggcggtcaatgctggagtttattcgaatcttgaggagcttgtggtttataacccgagagctatattaccttgcttcgtggttatttacaaagttttagaatcttgaatttgtaattttaacttgagaaataatgtttgttttttgtacttctaactttttaatattatagggagagattagggataatcatcaacctgcatcataattcccatctt

SEQ ID NO: 2780 - protein, 240 aa, Arabidopsis thaliana
  misc_feature: PFam Name: zf-C2H2; PFam Description: Zinc finger, C2H2 type
  misc_feature: GI Number: 9802582; NR Description: T2E6.3 [Arabidopsis thaliana]
  misc_feature: GI Number: 5777616; NR Description: CAA30374.1 protein [Oryza
  misc_feature: GI Number: 62701936; NR Description: Zinc finger, C2H2 type,
  misc_feature: GI Number: 34910152; NR Description: B1070A12.19 [Oryza sativa (japonica cultivar-group)] >gi|20804915|dbj|BAB92595.1|
  misc_feature: GI Number: 52076893; NR Description: zinc finger (C2H2 type) protein-like [Oryza sativa (japonica cultivar-group)] >gi|52076647|dbj|BAD45547.1| zinc finger (C2H2 type) protein-like
MALLTFLPENAEAPQKHKPTSSKRKKRDNPTDQTQTQKHKPQKPKKAVPPKQPSSWDQIKNLLTCKQIEGSRVHDPSKNSQSGPSMTTNLSPSKLGSSCSSICSFRDVAHGNTRVVHRADHSPDVGNSATPNSETRLLTRKPGQHGSSSSRSLTSGSTRSNASGSYTSSSTTSFRAMQFRKLSGCYECHMIVDPSRYPISPRVCACSQCGEVFPKLESLELHQAVRHAGKAFFFLLTKIV

SEQ ID NO: 2781 - DNA, 1294 bp, Arabidopsis thaliana
  misc_feature (1)..(1294): Ceres cDNA ID no. 13651673
atacattctccgatttcatttgtctttgcattgattgtttatgcagaatttggatttgtttattccttaaaactctttcttttactattattactcacgaagtttcttcaaaagtgtcatctgcaattagtttaattctcagaaaggaaatggttccattgatgatatttggcgttgaagatgagtaatagattttgctgaattcatgtactgtgcatttgcagaatatggaagcagctactgttcagaggtttcagtactcatcatggaatgatttgagaaattttgaagggaagcctcgtggttctctgaggtataatacacagcgaattaaggaagataaaaggtttagagttgttgctttaactcttgacaaaagaagggatcatcgacttagatcagtttctgataagaactcctcagcattgttggaaactggaagtcttcttcattctccatttgatgaagaacaacagattttgaagaaaaaagctgaagaggttaaaccgtatttaaatggacgatcgatgtatcttgttggtatgatgggttccgggaaaacgactgtagggaagattatggcaagatcgcttggttatacattctttgattgtgacactttgatcgagcaggctatgaagggaacttctgtagctgagatatttgagcatttcggtgagagtgtcttcagagaaaaagagactgaagcgttaaagaaactctctttgatgtaccaccaagttgttgtttcaaccgggggaggggcagttataagacccatcaattggaagtacatgcataaaggtattagtatttggcttgatgtacctctagaagccttagcgcatagaatagctgctgtaggaactggttcaagaccattgctacatgatgatgagtcaggggacacatacacagcggctttaaaccgtctttcaacgatttgggatgcacgtggtgaagcatacactaaagccagcgcaagagtttccttggagaatattactttgaagctcggttatagaagtgtctcagatcttacaccagctgaaatcgccattgaggcctttgagcaagttcagagctatttagagaaagaagatggtatggctagaccagatggactctagttccagaaagttatgtttccccgcaacatctcatgaatttgtgcctagttttgaatgttgtatataaatgaataatactctgtttgagcacattgtcttcttttcaaattgacccaaaaaatgaaaaggagccatttgcatttttataaaaagacggtaagaag

SEQ ID NO: 2782 - protein, 300 aa, Arabidopsis thaliana
  misc_feature: PFam Name: SKI; PFam Description: Shikimate kinase
  misc_feature: GI Number: 7270938; NR Description: shikimate kinase-like protein [Arabidopsis thaliana] gi|5042170|emb|CAB44689.1| shikimate kinase-like protein [Arabidopsis thaliana] gi|7434489|pir||T09370
  misc_feature: GI Number: 30681570; NR Description: shikimate kinase, putative [Arabidopsis thaliana] >gi|26452806|dbj|BAC43483.1|
  misc_feature: GI Number: 39104605; NR Description: putative shikimate
  misc_feature: GI Number: 42570867; NR Description: shikimate kinase,
  misc_feature: GI Number: 56805577; NR Description: shikimate kinase 1
MEAATVQRFQYSSWNDLRNFEGKPRGSLRYNTQRIKEDKRFRVVALTLDKRRDHRLRSVSDKNSSALLETGSLLHSPFDEEQQILKKKAEEVKPYLNGRSMYLVGMMGSGKTTVGKIMARSLGYTFFDCDTLIEQAMKGTSVAEIFEHFGESVFREKETEALKKLSLMYHQVVVSTGGGAVIRPINWKYMHKGISIWLDVPLEALAHRIAAVGTGSRPLLHDDESGDTYTAALNRLSTIWDARGEAYTKASARVSLENITLKLGYRSVSDLTPAEIAIEAFEQVQSYLEKEDGMARPDGL

SEQ ID NO: 2783 - DNA, 1374 bp, Arabidopsis thaliana
  misc_feature (1)..(1374): Ceres cDNA ID no. 13652247
gcagccgtgccgagcactcatctcttcttctctctcagtctcgctcgccatctccgtggagatcctcggacatggtcatgagatcgtaagagagaatcttcaaaaaattgaaattggaaatcgataagctaggagctarggagaaatgtcggggaaactttggatcccgagatttattctcatcactctactgtttattagctcacgagttaactctcaatgtgaattcagtttcactggacgcaacaaggtctttcatttcaacctagcatcttcgattcggaattatcctcacggtgtgctcagcgaagatgggttttataaagtggaagcgaacagttccgtgttatggtttcaggttgtcttctacatcagctttgtgacgtgctgattttcaatcatgatccccctcgatgtgttggttgcgaagattgtggaggtccatctcactgcggaacgtcatgtagtgcacttgtgtcagaaaatgtaagagggtatgatgtatgcacttctctagggcatgcctcaagcacaaaagttgatattattgataaagaggatcctggcaaaggcgtcattgttcagatgtcaactggaaataggaaccaaaattgctcgctttcagtttctgttatttgccrgaaaactaaagttgatggaccactcactttggcgaaatctggtacctgtcagtatgctactcagctgcgacatcctgccggttgtgcagcagctatatccggccatagtagtggatggggctggtttagtaccttactaatcattatcttgtgcctgtttggagcttatctggtgggtggtgcagtatatcggtatttctcccttggaattcgtggcatagatgtaatcccgaatatggattactgggccactgtaccgcacagtatacagagctgttttggctcactattttcaagattcggggggtctattcgtggtcagcaaacctcatattctcaagtcaacttctgagcagtcccagcatcttctctgatccatggtctggagacacatccccaaactttccttgactggttcaaccaattgcaaacgccgctagattgttataccctgagtactcttttggccattatatgactgcaagttataaggtgcctctccttttcagcttgttatgtcatggatccctgtagaaacaaaagaatcttgttcattggatagaaacaatgtcaagccattgcaatctgcagcctttcccatttcgtgtgtttgctctttggagattgtttcaatttcttgatgctgattttgagtaatggtaaccgatgtgttgatgttttagcacattttgcatccgcttggcgttggataagtggatatctcttttctttc

SEQ ID NO: 2784 - protein, 213 aa, Arabidopsis thaliana
  misc_feature: PFam Name: Man-6-P_recep; PFam Description: Cation-dependent
MVSGCLLHQLCDVLIFNHDPPRCVGCEDCGGPSHCGTSCSALVSENVRGYDVCTSLGHASSTKVDIIDKEDPGKGVIVQMSTGNRNQNCSLSVSVICKTKVDGPLTLAKSGTCQYATQLRHPAGCAAAISGHSSGWGWFSTLLIIILCLFGAYLVGGAVYRYFSLGIRGIDVIPNMDYWATVPHSIQSCFGSLFSRFGGSIRGQQTSYSQVNF

SEQ ID NO: 2785 - DNA, 1455 bp, Arabidopsis thaliana
  misc_feature (1)..(1455): Ceres cDNA ID no. 13652250
attggagttatattcaaaagcttataaatgtcaaatatggatcctaattcagttttacctaagagaagtttcttacaacatgagttgttttcacaattacatatacctggaagcttagctttcgaagcatttagttgtatctctaagtttacaggagctttgctttgttggttttcacatggaaacttgcaaaaagaagtatctaaacatcaatggggattaacttgtaagagccgtgattctttaaaacatgtgtttgaacataggaacgtctctgtgttcccatttcactatgtatcaaaagatattagtcctggcttctttggaaacatatctaaatccactattcagcattttgttaatgaagctgagaggctacattcgtgttctttgctctctttggcggctgcgatgataccgtctttgaatgtcatgtctgcaaatggacttgctctgccactagggagtaatgatgttaaacttagggagaacattgaacataggacttgtccggagaacactgaacataggacttgtcaggtgggatgtgaagaatatagtggtttgagttttcaaaaattagactggacaagacaatcagtggagcctaggacggggatcgagttcccgatgttgttgaaggagaatgcttcgcgatcgaattctgaggtgcttgttgcaacgggatctcggacaatgaaaattatcagaattaaatctctaaaagtatatgcatttggtttttatgttcacccttcctcggtctgtcagaagcttggccgaaagtatgcctcggttccagcaagcaaacttgacaaatgcgatgacttatacaaagaccttcttagggaggatattgttatgagtgtgaggcttgtggttaactacaatggcttgaagatcaatactgtgagagatgttttcgagaaatctctgcgtgctcgcttggttaaggcaaatccaaaaactgatttcaattgtttgaatgattttggttcattctttagacaagacattgcaatacccgcgggaacaataatagactttcggcgaacagaagatggacagctaatcacagagattggtggtaacctgattggagctgtccgaagcaaggatctttgcagagcattttttggtatgtacattggagatgttccggtgtcagagcagacaaaggaggagattggtagaaaagtggtgggaatcataaagagatgctgaaatcaattacttgttagatttccaattgcctctgagttttagaagaagacaattgggttagatttacgcggtcatgtctagatattgtcaatcaaaatactttgtaagcagcttggaggaagttatgtcttaagttgtattagatagtctcgatttttatgttctagttcgttatgattgtccaatatgcaaattgtgaaactggttgacaagaaatgagatccaacattt

SEQ ID NO: 2786 - protein, 398 aa, Arabidopsis thaliana
  misc_feature: GI Number: 33867695; NR Description: putative chalcone
MSNMDPNSVLPKRSFLQHELFSQLHIPGSLAFEAFSCISKFTGALLCWFSHGNLQKEVSKHQWGLTCKSRDSLKHVFEHRNVSVFPFHYVSKDISPGFFGNISKSTIQHFVNEAERLHSCSLLSLAAAMIPSLNVMSANGLALPLGSNDVKLRENIEHRTCPENTEHRTCQVGCEEYSGLSFQKLDWTRQSVEPRTGIEFPMLLKENASRSNSEVLVATGSRTMKIIRIKSLKVYAFGFYVHPSSVCQKLGRKYASVPASKLDKCDDLYKDLLREDIVMSVRLVVNYNGLKINTVRDVFEKSLRARLVKANPKTDFNCLNDFGSFFRQDIAIPAGTIIDFRRTEDGQLITEIGGNLIGAVRSKDLCRAFFGMYIGDVPVSEQTKEEIGRKVVGIIKRC

SEQ ID NO: 2787 - DNA, 1177 bp, Arabidopsis thaliana
  misc_feature (1)..(1177): Ceres cDNA ID no. 13652273
ggagctttgctttgttggttttcacatggaaacttgcaaaaagaagtatctaaacatcaatggggattaacttcattttgttaatgaagctgagaggctacattcgtgttctttgctctctttggcggctgcgatgataccgtctttgaatgtcatgtctgcaaatggacttgctctgccactagggagtaatgatgttaaacttagggagaacattgaacataggacttgtccggaraacactgaacataggacttgtcaggtgggatgtgaagaatatagtggtttgagttttcaaaaattagactggacaagacaatcagtggagcctaggacggggatcgagttcccgatgttgttgaaggagaatgcttcgcgatcgaattctgaggtgcttgttgcaacgggatctcggacaatgaaaattatcagaattaaatctctaaaagtatatgcatttggtttttatgttcacccttcctcggtctgtcagaagcttggccgaaagtatgcctcggttccagcaagcaaacttgacaaatgcgatgacttatacaaagaccttcttagggaggatattgttatgagtgtgaggcttgtggttaactacaatggcttgaagatcaatactgtgagagatgttttcgagaaatctctgcgtgctcgcttggttaaggcaaatccaaaaactgatttcaattgtttgaatgattttggttcattctttagacaagacattccaatacccgcgggaacaataatagactttcggcgaacagaagatggacagctaatcacagagattggtggtaacctgattggagctgtccgaagcaaggatctttgcagagcattttttggtatgtacattggagatgttccggtgtcagagcagacaaaggaggagattggtagaaaagtggtgggaatcataaagagatgctgaaatcaattacttgttagatttccaattgcctctgagttttagaagaagacaattgggttagatttacgcggtcatgtctagatattgtcaatcaaaatactttgtaagcagcttggaggaagttatgtcttaagttgtattagatagtctcgatttttatgttctagttcgttatgattgtccaatatgcaaattgtgaaactggttgacaagaaatgagatccaacattt

SEQ ID NO: 2788 - protein, 269 aa, Arabidopsis thaliana
  misc_feature: GI Number: 33867695; NR Description: putative chalcone
MIPSLNVMSANGLALPLGSNDVKLRENIEHRTCPNTEHRTCQVGCEEYSGLSFQKLDWTRQSVEPRTGIEFPMLLKENASRSNSEVLVATGSRTMKIIRIKSLKVYAFGFYVHPSSVCQKLGRKYASVPASKLDKCDDLYKDLLREDIVMSVRLVVNYNGLKINTVRDVFEKSLRARLVKANPKTDFNCLNDFGSFFRQDIPIPAGTIIDFRRTEDGQLITEIGGNLIGAVRSKDLCRAFFGMYIGDVPVSEQTKEEIGRKVVGIIKRC

SEQ ID NO: 2789 - DNA, 1673 bp, Arabidopsis thaliana
  misc_feature (1)..(1673): Ceres cDNA ID no. 13652891
ataacgtttcggcttcccgacctcaaccgtcttctgctcctccgccccgccacagtttcttagggttcttccgcattgtttctccgaattgcaatcccctcattctccacaataaacagatagctaatataattgagtttggatactcgcaagtgaaaatatgtcggtcacagcgggagtgagtgaatctgcaattgctgtaagggagaaactaaaaggtggtattggacagactaaagtgcgaaggtattggccaggaaaagctccggagtgggctgaggaagctgaagaagatgatgatgttaggatgcagaaggtttctgttttggatagagcttttccaaagaatgatgatttgggtgttgctaggaaggatgatccaaggctgcgccgtttagctaagactaaagttgaaaaccgtgacgaagttagagctgatcatcggcggataagacaggctgagattatttatacggaagaagaagaatcgaggaatcaagagaatagagacgaggacgatgatgaagatgccttggaagagagaagaagaagaattagagagaaaaatcttagaagagcgcaagaggaggctgctttacttcctttagaagaagaagatgagatacaagaggaagaagaggaggaggaggagtctgagtacgagactgattcggaagatgatatgcctggtattgccatgattaagcctgtttttgtaccgaaagctgagagagatacaattgcagagcgagagaggcttgaggctgaagaagaagctcttgaagaattagcaaagagaaaattggagcaaagaaaattagagacaaagcaaatagtggttgaggaagttaggaaagatgaagagatacggaagaacattctattggaggaagcaaatattggagatgtggaaactgatgatgaactcaatgaagctgaggagtatgaagtttggaagacaagagagattggtaggatcaagagagaaagagatgcaagggaagctatgctgagagagagggaagaaatagagaagttgaggaatatgacagagcaggagaggagagattgggagaggaagaatccgaaacctttgtcagctcaaccgaaaaagaaatggaactttatgcagaaatattaccacaagggtgccttcttccaggcagatcctgatgatgaggcaggttctgctggaaccgatggtatatttcagcgcgacttctctgctccaactggagaagataggttggacaaatcgattctccccaaagttatgcaagtcaagcactttggtcgtagtggaagaactaaatggactcaccttgtcaatgaggacacaacagattggagtaacccgtggacttccaatgatcctctacgtgaaaaatacaacaagaaaatggcaggcatggatgctcctatcgcaaaaccaaaagggagcaagaagatgaaagattgggagtcttaaaccgcaccaacatttagtttgctttttaaaaaaaatccaaaacgatacagaagtgttatgtggtagtaaaaaacatcgtaacatcttactcagttatgtcttgagtcctctaaatcgtagtaattaaaaatattgctttgtggaagacatctagtcttttgtatcgggatcaattatgcatcaatcaaagctgtctgcttgtatt

SEQ ID NO: 2790 - protein, 435 aa, Arabidopsis thaliana
  misc_feature: PFam Name: MFAP1_C; PFam Description:
  misc_feature: PFam Name: Plasmodium_HRP; PFam Description: Plasmodium
  misc_feature: PFam Name: Caldesmon; PFam Description: Caldesmon
  misc_feature: PFam Name: E-MAP-115; PFam Description: E-MAP-115 family
  misc_feature: PFam Name: TolA; PFam Description: TolA protein
  misc_feature: GI Number: 7267500; NR Description: putative microfibril-associated protein [Arabidopsis thaliana] gi|2565010|gb|AAB81880.1| putative microfibril-associated protein [Arabidopsis thaliana] gi|3377811|gb|AAC28184.1| contains 11.71)
  misc_feature: GI Number: 66551430; NR Description: PREDICTED: similar to
  misc_feature: GI Number: 48104934; NR Description: similar to
  misc_feature: GI Number: 60810075; NR Description: microfibrillar-associated protein 1 [synthetic construct] gi|60810073|gb|AAX36092.1| microfibrillar-associated protein 1
  misc_feature: GI Number: 62656271; NR Description: PREDICTED: similar to
MSVTAGVSESAIAVREKLKGGIGQTKVRRYWPGKAPEWAEEAEEDDDVRMQKVSVLDRAFPKNDDLGVARKDDPRLRRLAKTKVENRDEVRADHRRIRQAEIIYTEEEESRNQENRDEDDDEDALEERRRRIREKNLRRAQEEAALLPLEEEDEIQEEEEEEEESEYETDSEDDMPGIAMIKPVFVPKAERDTIAERERLEAEEEALEELAKRKLEQRKLETKQIVVEEVRKDEEIRKNILLEEANIGDVETDDELNEAEEYEVWKTREIGRIKRERDAREAMLREREEIEKLRNMTEQERRDWERKNPKPLSAQPKKKWNFMQKYYHKGAFFQADPDDEAGSAGTDGIFQRDFSAPTGEDRLDKSILPKVMQVKHFGRSGRTKWTHLVNEDTTDWSNPWTSNDPLREKYNKKMAGMDAPIAKPKGSKKMKDWES

SEQ ID NO: 2791 - DNA, 2064 bp, Arabidopsis thaliana
  misc_feature (1)..(2064): Ceres cDNA ID no. 13653082
actcatcacttacttaacatactaagagagttattacaacttgaaaaacatggcatccaaggctttgattctgttgggtctcttcgcaattcttctggtggtctccgaagtttctgccgcaagacagtcgggcatggtgaagccagagagtgaggcaactgtgcaacctgaaggttatcacggaggacatggtggtcacggagggggaggccactacggaggaggaggccacgggcatggaggacacaacggaggagggggccacggacttgacggatacggaggaggacatggaggacactacggaggaggaggaggacactacggaggaggaggaggccacggtggtggtggacactacggaggtggaggacaccatggaggaggaggccacgggcttaacgaacctgttcagacgaaaccgggtgtttaaaagttaaaactataaaataaattcaccaccagtccaccatgcataattgcatctctatatacacttatgtcttataagtatgcatcaaaataaaccatggtgagtttgtaatgcagttccttcagaaaaaaaaaaaaaacaatccagggttggatccaacctggatagtttttttttttttttttatgtaaatttggtccgtcgattgcagttcaattaaacagttacagacaatagagagacagatagagagtaacaaaactcaagaagagcgtttggcatttgaacagagattgttccagagatagcgaccacttgccatgtcaacgcatgtccaaaatccagacttcattgccattcccaccttggagaatccagagactgaatcgtcgtcggcgtgttcagcgtcggtgaaggaatcatcgagaggatcgtcagaggtagagttgagcttctggaggacgaagaagccagcgagagtcgctgaaaggaatatgaggataagccttaacggacacatctgcttcttcttctcttttcttgatttgctttttccagtttttgatgaagacaatcagcggttctcgagaaccgatggaatcaacaaagaagcaagtctcgttggagctacttccatggttagttgtccacaccgatggaacggtagagagactagcgggaaccgaggtttgtcctcccggtttggatccaataaccggggttttctctaaagatatcattatcgaaccgaaaaccggtttatctgcccgaatctatcgacccttctcgattcaacccggtcagaagattcctctcatgctctattttcatggcggtgcatttctcatctcctccacttccttcccctcttaccacaccagtcttaacaaaattgtcaatcaggctaacgtcatagccgtctctgtcaattacagactagcaccagaacatccacttcctacagcgtacgaagactcatggactgcgctaaagaatatccaagccataaacgagccgtggatcaacgactacgccgacttggacagtttattcctagtgggagatagcgcgggagctaatatctcgcaccacctcgcatttcgagccaaacaatctgaccaaaccttgaaaatcaaaggcattggaatgatccacccatatttttgggggacacaacctatcggagcagagatcaaagacgaagcgaggaaacaaatggtggacggatggtgggaattcgtgtgcccatccgagaaaggatccgatgacccgtggattaatccgtttgcggacgggtcaccggatcttggagggttagggtgtgagagagtgatgattactgtggcggagaaagatatattgaatgagagagggaagatgtattacgaaagattggtgaagagtgagtggaaaggaaaggttgagattatggagacgaaagagaaagatcatgtttttcatattttcgagccagattgtgatgaagctatggagatggtacgatgcttggctctctttataaaccaagttgaagcttgatattatttgttttgccaaaatttgatggctttttttaatgtttgtataatttttacatgtttgttaatgttgttgttattgtcttttctttt

SEQ ID NO: 2792 - protein, 324 aa, Arabidopsis thaliana
  misc_feature: PFam Name: Abhydrolase_3; PFam Description: alpha/beta
  misc_feature: PFam Name: GRP; PFam Description: Glycine rich protein family
  misc_feature: PFam Name: COesterase; PFam Description: Carboxylesterase
  misc_feature: PFam Name: Dehydrin; PFam Description: Dehydrin
  misc_feature: PFam Name: TT_ORF1; PFam Description: TT viral orf 1
  misc_feature: GI Number: 21536771; NR Description: unknown [Arabidopsis thaliana]
  misc_feature: GI Number: 28393060; NR Description: putative esterase
  misc_feature: GI Number: 18086341; NR Description: AT3g48690/T8P19_200
  misc_feature: GI Number: 51535283; NR Description: putative PrMC3 [Oryza
  misc_feature: GI Number: 51535268; NR Description: putative PrMC3 [Oryza
  misc_feature: Utility: Useful for making plants tolerant to high pH or low
  misc_feature: Utility: Useful for making plants tolerant to low nitrogen
  misc_feature: Utility: Useful for making plants with enhanced tolerance to
  misc_feature: Utility: Useful for making plants with increased tolerance to
MKTISGSREPMESTKKQVSLELLPWLVVHTDGTVERLAGTEVCPPGLDPITGVFSKDIIIEPKTGLSARIYRPFSIQPGQKIPLMLYFHGGAFLISSTSFPSYHTSLNKIVNQANVIAVSVNYRLAPEHPLPTAYEDSWTALKNIQAINEPWINDYADLDSLFLVGDSAGANISHHLAFRAKQSDQTLKIKGIGMIHPYFWGTQPIGAEIKDEARKQMVDGWWEFVCPSEKGSDDPWINPFADGSPDLGGLGCERVMITVAEKDILNERGKMYYERLVKSEWKGKVEIMETKEKDHVFHIFEPDCDEAMEMVRCLALFINQVEA

SEQ ID NO: 2793 - DNA, 1604 bp, Arabidopsis thaliana
  misc_feature (1)..(1604): Ceres cDNA ID no. 13653504
  misc_feature (1)..(1604): Ceres CLONE  ID no. 1204072
aacggagctgtaactgtgaggcgccgtctctcttcaacctcttcccctccactttgcttctctctctcctccccgggggttttacagtcatatcatcgtcggagactctgcgattcttcacggaatcgtatttctctctcagcgatttttttcgattctcgaagctgcaaggaccacccatcaaacattgaaactcaagcgggagaaattttctggctcgggagggaaactatggagccctaatgcccattttctgctgtctatgagggttgttgggatatcgattaacggcccctatcgaaaaaaataagggttgttattattttcatttcgcttcatgttcaaggttatgtttggatgatagatacattttgactttctcatacaatgagtacacgaagaaatggcatttccaagcatcagcgaggtgataaattttgtggtgaagggccaaactggatactaattgcagggggtgcattgttgagcacattgtccattcgctttggatacaagctaaagcagtcgcttgattcgaaacctcaatcaaatggctctgctggattaaaacctaatggaacatctgagaggcaaaaatctacaagctgttgcttacactctaccacatcttcctgtacacaaaataatgatttttgttgcttccgctccattccaggaactgagagtgtggaaggaaaagaggtgacaagcgagcaaatgatatccgcatctgacacttcactgcctcttgtgacagttcctgctccatcgagcaaagagaatggagtcatgtgggcaacttctcctgatcgcctggaacttcccccaagaccatacaatcacaattcaaactgctcagattctccttgcgtatctgaaaccagctcagacattttcagcaaacgagaagtaatacagaaactaaggcagcagctgaagagacgggatgacatgatacaggaaatgcaagaacagattctagagctgcaaaactcgtataacgcacagacggcacactcaagccatctccaggcacagctagacacactgaacagagatctgtttgaatcagaaagagaagttcaaagactgagaaaggcaattgctgatcacagcgtgggatgtggcgcggacagcaatggcaagacatctccggttggaccttggaatggcgggtttatggacagcgaaagcaattatgagtcacaagaaaagagcctaagggatggagaaagagtagagatgttgagaaaggaagtgagtgagcttaaagaagtgatagatgggaaagagtatctacttagaagctataaggagcagaagattgagctttcgcagaaggtaaaagagttgcagcagagactggactcacagctccaaaacttattgtaggtggaaaggttaggcattgtgcatacttgcgtctcttattttttttttcggttctttttcctttttcgagaaaatgaatcttagtatgtactaagaacggtggagatcaagattttcaggttctttctggctttctgctttcgtttttgaatgtcttgattctgttttttctttcaacatttggtgtaaaggtaaatagatagttgttgaag

SEQ ID NO: 2794 - protein, 334 aa, Arabidopsis thaliana
  misc_feature: GI Number: 21536672; NR Description: unknown [Arabidopsis thaliana]
MSTRRNGISKHQRGDKFCGEGPNWILIAGGALLSTLSIRFGYKLKQSLDSKPQSNGSAGLKPNGTSERQKSTSCCLHSTTSSCTQNNDFCCFRSIPGTESVEGKEVTSEQMISASDTSLPLVTVPAPSSKENGVMWATSPDRLELPPRPYNHNSNCSDSPCVSETSSDIFSKREVIQKLRQQLKRRDDMIQEMQEQILELQNSYNAQTAHSSHLQAQLDTLNRDLFESEREVQRLRKAIADHSVGCGADSNGKTSPVGPWNGGFMDSESNYESQEKSLRDGERVEMLRKEVSELKEVIDGKEYLLRSYKEQKIELSQKVKELQQRLDSQLQNLL

SEQ ID NO: 2795 - DNA, 2411 bp, Arabidopsis thaliana
  misc_feature (1)..(2411): Ceres cDNA ID no. 13653703
aaaacccttgagcaaccactatgaatggaaaatagctgaagagcttccactcaaatcgatacttcgagatgcgatttttgcttcgtttaccacaaattcattttcggaaactctcgtgctcgatgtctgtactcatgggttcgaagcaattcctcgaattttgtcttcttccttcttttgcctcatacccttcttctccttcttattcttcaagtagacaagtatcttccgtttctagaagatttcgaccagttttggcctcgagacctgtgtccaaaaacagtccttattaccaaaggaccaatggtttatcatcttacaattcaatccccagagtcccaactcctgttgatactgaagtagaagcagataagagggttgttctatctagattagtgactttgaggcgtaaattggcggaacagggagttgatgctgaaaactgccccccaggacaacatagtggcttgatatgtccgacgtgtgaaggtggaaactctggagaaaaaagcttgtctctttttatagcccctgatggttcatcagctacatggaattgctttagggggaagtgtgggttaaaaggtggagttcgggcggatggtgggttggcatctgctgatcctatagagaaggttgaaagaaaaattacggtggagggtatagagctagaacctctctgtgatgagattcaagattatttcgctgcaagagcgatttcacggaaaacactcgagagaaatcgggttatgcagaaaagaataggtgacgagattgtaattgcgtttacttattggcaaagaggggagcttgtgagttgcaagtaccggtctctaactaagatgttctttcaggaaaggaagacacggaggatcttatatggtcttgatgacatagaaaaaacatctgaagtcattatagttgaaggggagatagataaacttgcaatggaagaagctggttttctcaattgtgtatccgttcctgatggagctccagcgaaggtttcttcgaaggaaatcccatcggaagacaaggacacgaagtataaatttctatggaattgcaatgactatctaaaaaaggcgtctcgaattgttattgctactgacggagatggacctggtcaagctatggcggaagaaattgcacggcgtttgggtaaagaaagatgttggcgtgtcaagtggccgaagaaaagtgaggatgaacattttaaagatgcaaacgaggttcttatgtctaagggacctcatttactcaaggaagctattttagatgctgagccatatcctatactaggattattctccttcaaagatttctttgatgaaattgatgcctactatgatagaacacatgggcacgagtatggtgtttcaacagggtggaaaaatttggacaacttgtatagtgttgtgccaggggagttgacagttgtgacagggatccctaattctggaaagagtgaatggattgatgctatgttgtgcaatcttaaccatagtgttggctggaaatttgcactctgttcaatggagaataaggtacgagatcatgccaggaaacttttggaaaaacatataaagaaaccattctttgatgcagactatgggagatctgtccaacggatgagcgttgaggagaaggatgaagggaaaaagtggttgaatgacaccttctatcccataagatgtgagatggattcacttccaagtattaattgggttctggaacgtgcaaaagcagctgttcttcggtatgggattcgaggacttgttatagatccttacaatgagctcgatcatcaacgtactccacgccagacggagacagagtatgtcagccagatgcttacaaaaatcaaacgcttttcccaacaccactcctgccatgtctggtttgtcgctcatccaaaacagttgcaacattgggatggcggtgcaccaaacctttacgatattagtggcagcgcacattttataaacaaatgtgacaatggtattatagttcacagaaaccgcgacgaaaatgctggacctcttgatctagttcaaattggtgtgaggaaagtacgaaacaaggtggcaggacaaattggtgatgcatacttgtgttatgacaggacaactggttcctactcggattctccagtgacgcctggaatgccagagaggagatcacccaagcggtactgatcagtttggtgaatttaaaggccgtcaaacacggtggacatagcgtatcgataacatttgtcaactaaattttatcccttttgggttaccattggtgaggaaaaagatgatcttgtgagattcttacctttgtgttttaacagactgtcaagattcaagaacaagattatgtctctactatgtaatgtggaattatgaatcatggtgtttctc

SEQ ID NO: 2796 - protein, 709 aa, Arabidopsis thaliana
  misc_feature: PFam Name: Toprim; PFam Description: Toprim domain
  misc_feature: GI Number: 4587524; NR Description: T5I8.13 [Arabidopsis thaliana] gi|25403362|pir||C86432 protein T5I8.13 [imported] -
  misc_feature: GI Number: 4587522; NR Description: T5I8.11 [Arabidopsis thaliana] gi|25403361|pir||A86432 protein T5I8.11 [imported] -
  misc_feature: GI Number: 29346582; NR Description: DNA primase/helicase [Bacteroides thetaiotaomicron VPI-5482] >gi|29338478|gb|AAO76279.1|
  misc_feature: GI Number: 49476113; NR Description: phage related protein [Bartonella henselae str. Houston-1] >gi|49238921|emb|CAF28216.1|
  misc_feature: GI Number: 49474650; NR Description: phage related protein [Bartonella quintana] >gi|49240154|emb|CAF26610.1| phage related
MRFLLRLPQIHFRKLSCSMSVLMGSKQFLEFCLLPSFASYPSSPSYSSSRQVSSVSRRFRPVLASRPVSKNSPYYQRTNGLSSYNSIPRVPTPVDTEVEADKRVVLSRLVTLRRKLAEQGVDAENCPPGQHSGLICPTCEGGNSGEKSLSLFIAPDGSSATWNCFRGKCGLKGGVRADGGLASADPIEKVERKITVEGIELEPLCDEIQDYFAARAISRKTLERNRVMQKRIGDEIVIAFTYWQRGELVSCKYRSLTKMFFQERKTRRILYGLDDIEKTSEVIIVEGEIDKLAMEEAGFLNCVSVPDGAPAKVSSKEIPSEDKDTKYKFLWNCNDYLKKASRIVIATDGDGPGQAMAEEIARRLGKERCWRVKWPKKSEDEHFKDANEVLMSKGPHLLKEAILDAEPYPILGLFSFKDFFDEIDAYYDRTHGHEYGVSTGWKNLDNLYSVVPGELTVVTGIPNSGKSEWIDAMLCNLNHSVGWKFALCSMENKVRDHARKLLEKHIKKPFFDADYGRSVQRMSVEEKDEGKKWLNDTFYPIRCEMDSLPSINWVLERAKAAVLRYGIRGLVIDPYNELDHQRTPRQTETEYVSQMLTKIKRFSQHHSCHVWFVAHPKQLQHWDGGAPNLYDISGSAHFINKCDNGIIVHRNRDENAGPLDLVQIGVRKVRNKVAGQIGDAYLCYDRTTGSYSDSPVTPGMPERRSPKRY

SEQ ID NO: 2797 - DNA, 1880 bp, Arabidopsis thaliana
  misc_feature (1)..(1880): Ceres cDNA ID no. 13653774
tgaaagaagaaaaaaacagagaagaagaagaaaaaatctatctccgccatgaacgcgagagctcttctttgctcttcaaatattcactctctctacacttcaaatcgtccacctgaaaaaacctcttcttctcgcagcctccgtaatctcaaaccatctccaaagtcgttacgggtatggatctacccgcgaaataggtccagtgttttccgggtattagttcggagctccgacaagagtgaaagcagtaattcgtattacgtagaaggagataaagtaagtggaaacaatgacgtcgtttctgattcgcctagctctatcgtcctcccatggtgggaagagtttccgaagcggtgggtgattgtgttactctgtttctcagcttttcttctctgcaatatggacagagtgaatatgagtatagctatacttccgatgtcagctgagtatggttggaatccagcaacagttggtctgattcagtcttctttcttctggggttaccttcttacacagatagctggtggaatttgggcagacactgtaggagggaaaagggttcttggattcggtgttatttggtggtcaatcgctacaattctcactcctgtagctgctaaactcggtcttccttacttgctcgttgttcgtgctttcatgggagttggagagggtgttgcaatgcctgctatgaataatatattgtcgaagtgggttcctgtgcaagagagaagcagatcactcgcgcttgtttacagcggaatgtaccttggatctgtcaccggtttagccttttcgcctttcttgattcatcaatttggatggccttctgtgttttattctttcgggtctcttggaactgtatggttgactctgtggctaactaaggcagagagttcaccattagaagatccaacattgctccctgaagaaagaaagctaattgcagacaactgtgctagcaaagagccagtgaagtcgatcccgtggaggctgatattgtcgaaaccaccggtttgggctctcatcagttgccacttttgtcacaactggggaacattcattctcttaacatggatgccaacttattaccatcaagtgctgaagttcaaccttatggagtcaggacttctctctgtatttccatggatgacaatggcaatatctgcaaatgccggtggatggattgccgatacacttgtcagccgaggtttctctgtcacgaatgtccgcaagtttctatgatgaaattcagataatgcaaacaatagggtttcttggaccagcgttcttcctaacacagctgaaacacatagattctcctacaatggctgttttgtgcatggcttgtagtcaggggactgatgcgttttcacagtctggtctatactctaaccatcaagacatcgctccaagatactctggagtgttacttggtttgtctaatactgctggagtacttgccggagttcttggcacagctgcgactggtcacatactacaacacggttcttgggatgacgttttcacgatttcggtcggtctttacctcgttgggaccgtcatttggaacctattttcaaccggagagaagataatcgattgatccattccgagaatagtaaatagttcggctccaagacctctcatcaggtgcaacttcacctcacgccagtctctgattatacaagtatcattgcagtctgagagctagccggaatattccttttttgccagaaaattcttcaggatctttctgctcgttgatttaggccaaacgcatatgaataatactttgtagatgaaagatatacagatgattttttgtaaataaacaaagctcacactttctcaagattactcaaaatctctcttcagct

SEQ ID NO: 2798 - protein, 398 aa, Arabidopsis thaliana
  misc_feature: PFam Name: Sugar_tr; PFam Description: Sugar (and other)
  misc_feature: PFam Name: MFS_1; PFam Description: Major Facilitator Superfamily
  misc_feature: GI Number: 42570975; NR Description: inorganic phosphate
  misc_feature: GI Number: 21387197; NR Description: putative Na+-dependent inorganic phosphate cotransporter [Arabidopsis thaliana] gi|17064976|gb|AAL32642.1| putative Na+-dependent inorganic
  misc_feature: GI Number: 52077187; NR Description: putative sialin [Oryza
  misc_feature: GI Number: 7267124; NR Description: AT4g00370 [Arabidopsis thaliana] gi|6049889|gb|AAF02804.1| weak similarity to phthalate permease family [Arabidopsis thaliana] gi|2252847|gb|AAB62846.1|
  misc_feature: GI Number: 42569720; NR Description: transporter-related
MNARALLCSSNIHSLYTSNRPPEKTSSSRSLRNLKPSPKSLRVWIYPRNRSSVFRVLVRSSDKSESSNSYYVEGDKVSGNNDVVSDSPSSIVLPWWEEFPKRWVIVLLCFSAFLLCNMDRVNMSIAILPMSAEYGWNPATVGLIQSSFFWGYLLTQIAGGIWADTVGGKRVLGFGVIWWSIATILTPVAAKLGLPYLLVVRAFMGVGEGVAMPAMNNILSKWVPVQERSRSLALVYSGMYLGSVTGLAFSPFLIHQFGWPSVFYSFGSLGTVWLTLWLTKAESSPLEDPTLLPEERKLIADNCASKEPVKSIPWRLILSKPPVWALISCHFCHNWGTFILLTWMPTYYHQVLKFNLMESGLLSVFPWMTMAISANAGGWIADTLVSRGFSVTNVRKFL

SEQ ID NO: 2799 - DNA, 1215 bp, Zea mays
  misc_feature (1)..(1215): Ceres cDNA ID no. 13665996
  misc_feature (1)..(1215): Ceres CLONE  ID no. 306844
  misc_feature (1)..(1215): Also known as  Ceres CDNA ID no. 23760940
accggccaccgcgaatccagagccccacgccccgtccgaaccccagagcagagcaaagcctcctcgacctccctgtccccagccttccccgatggcccgcacgaagcagacggcgcgcaagtcgacgggcgggccatcggggagggctggtcagggattcaaacagaggcttctcagcatatgggggttctacaagcatcatcaatgggctggaatggtgctcctgtacttgctgccactcctgttgtcaagaaagtcatgaggctggatgttccagtagacaagtatcctaactacaactttgttggtcgtttattggggccgcgaggtaactccctgaaaagggttgaagcttcaacccaatgtagagtttacattcgaggacggggttctgtgaaagactctgttaaggaagacaagctgagggataaacctgggtatgaacaccttaatgaacaactgcatgtgcttgtggaagcagagtttccagcagatatggttgatgtgcgtcttaatcaagctgtgtccatcctagaggatcttcttaaaccaattgacgagtccatggactactacaagaagcagcagctgagggagctggcgattctaaatggcacactgagagaggaaagcccaagccctcacctcagccctagtgtgtcccccttcaactccaccgggatgaagcgcgcaaaaacagggcggtaatctctgttccgaaagccttcatccccccaaatcaatcatggttcaatgcccaattattacacaagctactgctggagatgattggtgatgcatatgctgggatcatcagtgatggcctatgcctgtcatgatctgtgcgctttatcgacaagcacacaaacatgcctgtgctgtgcttggacgaatggtctccgggcttgttgtttgactctactattatttattctttgtgcttctgactgcctaagtattattaacattattggtttgggaaagtgttaacaaggcccggttggccagtcgctgtagaaagcttggggagaggaggggggggtgtcaatgtgacggacaataataaggtttcgttggtgtacctgagatagttgtaatatgtcatgtgctgatgcttttgtgtggtgctagtacaagacaaccagacagctatagttgaggcaatgattattttgcgttcataaaatgcatgtcggtgtgctttcttcatggttc

SEQ ID NO: 2800 - protein, 1215 aa, Zea mays
  misc_feature: PFam Name: KH_1; PFam Description: KH domain
  misc_feature: GI Number: 50902256; NR Description: P0408G07.16 [Oryza sativa (japonica cultivar-group)] >gi|20161243|dbj|BAB90170.1| P0408G07.16 [Oryza sativa (japonica cultivar-group)] >gi|21328045|dbj|BAC00630.1| P0434C04.5 [Oryza sativa (japonica
  misc_feature: GI Number: 56785233; NR Description: QUAKING isoform 5-like [Oryza sativa (japonica cultivar-group)] gi|56784311|dbj|BAD82237.1| QUAKING isoform 5-like [Oryza sativa
  misc_feature: GI Number: 19310523; NR Description: At1g09660/F21M12_5 [Arabidopsis thaliana] >gi|16930473|gb|AAL31922.1|
  misc_feature: GI Number: 26452384; NR Description: putative elongation factor [Arabidopsis thaliana] >gi|51971995|dbj|BAD44662.1| putative elongation factor [Arabidopsis thaliana] >gi|51971727|dbj|BAD44528.1| putative elongation factor
  misc_feature: GI Number: 23197752; NR Description: putative RNA-binding protein [Arabidopsis thaliana] >gi|3786011|gb|AAC67357.1| putative RNA-binding protein [Arabidopsis thaliana] >gi|17978787|gb|AAL47387.1| putative RNA-binding protein
ACCGGCCACCGCGAATCCAGAGCCCCACGCCCCGTCCGAACCCCAGAGCAGAGCAAAGCCTCCTCGACCTCCCTGTCCCCAGCCTTCCCCGATGGCCCGCACGAAGCAGACGGCGCGCAAGTCGACGGGCGGGCCATCGGGGAGGGCTGGTCAGGGATTCAAACAGAGGCTTCTCAGCATATGGGGGTTCTACAAGCATCATCAATGGGCTGGAATGGTGCTCCTGTACTTGCTGCCACTCCTGTTGTCAAGAAAGTCATGAGGCTGGATGTTCCAGTAGACAAGTATCCTAACTACAACTTTGTTGGTCGTTTATTGGGGCCGCGAGGTAACTCCCTGAAAAGGGTTGAAGCTTCAACCCAATGTAGAGTTTACATTCGAGGACGGGGTTCTGTGAAAGACTCTGTTAAGGAAGACAAGCTGAGGGATAAACCTGGGTATGAACACCTTAATGAACAACTGCATGTGCTTGTGGAAGCAGAGTTTCCAGCAGATATGGTTGATGTGCGTCTTAATCAAGCTGTGTCCATCCTAGAGGATCTTCTTAAACCAATTGACGAGTCCATGGACTACTACAAGAAGCAGCAGCTGAGGGAGCTGGCGATTCTAAATGGCACACTGAGAGAGGAAAGCCCAAGCCCTCACCTCAGCCCTAGTGTGTCCCCCTTCAACTCCACCGGGATGAAGCGCGCAAAAACAGGGCGGTAATCTCTGTTCCGAAAGCCTTCATCCCCCCAAATCAATCATGGTTCAATGCCCAATTATTACACAAGCTACTGCTGGAGATGATTGGTGATGCATATGCTGGGATCATCAGTGATGGCCTATGCCTGTCATGATCTGTGCGCTTTATCGACAAGCACACAAACATGCCTGTGCTGTGCTTGGACGAATGGTCTCCGGGCTTGTTGTTTGACTCTACTATTATTTATTCTTTGTGCTTCTGACTGCCTAAGTATTATTAACATTATTGGTTTGGGAAAGTGTTAACAAGGCCCGGTTGGCCAGTCGCTGTAGAAAGCTTGGGGAGAGGAGGGGGGGGTGTCAATGTGACGGACAATAATAAGGTTTCGTTGGTGTACCTGAGATAGTTGTAATATGTCATGTGCTGATGCTTTTGTGTGGTGCTAGTACAAGACAACCAGACAGCTATAGTTGAGGCAATGATTATTTTGCGTTCATAAAATGCATGTCGGTGTGCTTTCTTCATGGTTC

SEQ ID NO: 2801 - DNA, 3723 bp, Zea mays
  misc_feature (1)..(3723): Ceres cDNA ID no. 13666073
  misc_feature (1)..(3723): Ceres CLONE  ID no. 695560
  misc_feature (1)..(3723): Also known as  Ceres CDNA ID no. 23485806
  misc_feature (1799)..(1799): n is a, c, t, g, unknown, or other
taggatcaaaaccgtctcgccgctgcaataatcttttgtcaattcttaatccctcgcgtcgacagcgacagcggaaccaactcacgttgccgcggcttcctccatcggtgcggtgccctgtccttttctctcgtccctcctccccccgtatagttaagccccgccccgctactactactactagcagcagcagcgctctcgcagcgggagatgcggtgttgatccgtgccccgctcggatctcgggactggtgccggctctgcccaggccccaggctccaggccagctccctcgacgtttctcggcgagctcgcttgccatggagggcgacgcggacggcgtgaagtcggggaggcgcggtggcggacaggtgtgccagatctgcggcgacggcgtgggcaccacggcggagggggacgtcttcgccgcctgcgacgtctgcgggtttccggtgtgccgcccctgctacgagtacgagcgcaaggacggcacgcaggcgtgcccccagtgcaagaccaagtacaagcgccacaaggggagcccggcgatccgtggggaggaaggagacgacactgatgccgatagcgacttcaattaccttgcatctggcaatgaggaccagaagcagaagattgccgacagaatgcgcagctggcgcatgaacgttgggggcagcggggatgttggtcgccccaagtatgacagtggcgagatcgggcttaccaagtatgacagtggcgagattcctcggggatacatcccatcagtcactaacagccagatctcaggagaaatccctggtgcttcccctgaccatcatatgatgtccccaactgggaacattggcaagcgtgctccatttccctatgtgaaccattcgccaaatccgtcaagggagttctctggtagcattgggaatgttgcctggaaagagagggttgatggctggaaaatgaagcaggacaaggggacgattcccatgacgaatggcacaagcattgctccctctgagggtcggggtgttggtgatattgatgcatcaactgattacaacatggaagatgccttattgaacgacgaaactcgacagcctctatctaggaaagttccacttccttcctccaggataaatccatacaggatggtcattgtgctgcgattgattgttctaagcatcttcttgcactaccgtatcacaaatcctgtgcgcaatgcatacccattatggcttctatctgttatatgtgagatctggtttgctctttcgtggatattggatcagttccctaagtggtttccaatcaaccgggagacgtaccttgataggctggcattaaggtatgaccgggaaggtgagccatctcagttggctgctgttgacattttcgtcagtacagtcgacccaatgaaggagcctcctcttgtcactgccaataccgtgctatccattcttgctgtggattaccctgtggataaggtctcttgctatgtatctgatgatggagctgcgatgctgacatttgatgcactagctgagacttcagagtttgctagaaaatgggtaccatttgttaagaagtacaacattgaacctagagctcctgaatggtacttctcccagaaaattgattacttgaaggacaaagtgcacccttcatttgttaaagaccgccgggccatgaagagagaatatgaagaattcaaagttagggtaaatggccttgttgctaaggcacagaaagttcctgaggaaggatggatcatgcaagatggcacaccatggccaggaaacaataccngggaccatcctggaatgattcaggttttccttggtcacagtggtggccttgatactgagggcaatgagctaccccgtttggtctatgtttctcgtgaaaagcgtcctggattccagcatcacaagaaagctggtgccatgaatgctcttgttcgtgtctcagctgtgcttaccaatggacaatacatgttgaatcttgattgtgatcactacattaacaacagtaaggctctcagggaagctatgtgcttccttatggaccctaacctaggaaggagtgtctgctacgtccagtttccccagagattcgatggcattgacaggaatgatcgatatgccaacaggaacaccgtgtttttcgatattaacttgagaggtcttgatggcatccaaggaccagtttatgtcggaactggctgtgttttcaaccgaacagctctatatggttatgagcccccaattaagcagaagaagggtggtttcttgtcatcactatgtggcggtaggaagaaggcaagcaaatcaaagaagggctcggacaagaagaagtcgcagaagcatgtggacagttctgtgccagtattcaaccttgaagatatagaggagggagttgaaggcgctggatttgacgacgagaaatcacttcttatgtctcaaatgagcctggagaagagatttggccagtccgcagcgtttgttgcctccactctgatggagtatggtggtgttcctcagtccgcaactccggagtctcttctgaaagaagctatccatgttataagctgtggctatgaggacaagactgaatggggaactgagatcgggtggatctacggttctgtgacagaagacattctcaccggattcaagatgcacgcgcgaggctggcggtcgatctactgcatgcccaagcggccagctttcaaggggtctgcccccatcaatctttcggaccgtctgaaccaggtgctccggtgggctcttgggtccgtggagatcctcttcagccggcactgccccctgtggtacggctacggagggcggctcaagttcctggagagattcgcgtacatcaacaccaccatctacccgctcacgtccatcccgcttctcatctactgcatcctgcccgccatctgtctgctcaccggaaagttcatcattccagagatcagcaacttcgccagcatctggttcatctccctcttcatctcgatcttcgccacgggcatcctggagatgaggtggagcggggtgggcatcgacgagtggtggaggaacgagcagttctgggtgatcgggggcatctccgcgcacctcttcgccgtgttccagggcctgctcaaggtgctggccggcatcgacaccaacttcaccgtcacctccaaggcctcggacgaggacggcgacttcgcggagctgtacatgttcaagtggacgacgctcctgatcccgcccaccaccatcctgatcatcaacctggtcggcgtcgtcgccggcatctcctacgccatcaacagcggataccagtcgtggggcccgctcttcggcaagctcttcttcgccttctgggtcatcgtccacctgtacccgttcctcaagggcctcatgggcaggcagaaccgcaccccgaccatcgtcgtcgtctgggccatcctgctggcgtccatcttctccttgctgtgggttcgcatcgaccccttcaccacccgcgtcactggcccggatacccagacgtgtggcatcaactgctagggaagtggaaggtttgtactttgtagaaacggaggaataccacgtgccatctgttgtctgttaagttatatatatataagcagcaagtggcgttatttacagctacgtacagaccagtggatattgtttaccacaaagttttacttgtgttaatatgcattcttttgttg

SEQ ID NO: 2802 - protein, 3723 aa, Zea mays
  misc_feature: PFam Name: Cellulose_synt; PFam Description: Cellulose synthase
  misc_feature: PFam Name: Glycos_transf_2; PFam Description: Glycosyl transferase
  misc_feature: PFam Name: MAGE; PFam Description: MAGE family
  misc_feature: GI Number: 49615365; NR Description: CesA2 [Acacia mangium]
  misc_feature: GI Number: 34419230; NR Description: TPA: cellulose
  misc_feature: GI Number: 13925884; NR Description: cellulose synthase
  misc_feature: GI Number: 33186651; NR Description: cellulose synthase
  misc_feature: GI Number: 38532102; NR Description: cellulose synthase
TAGGATCAAAACCGTCTCGCCGCTGCAATAATCTTTTGTCAATTCTTAATCCCTCGCGTCGACAGCGACAGCGGAACCAACTCACGTTGCCGCGGCTTCCTCCATCGGTGCGGTGCCCTGTCCTTTTCTCTCGTCCCTCCTCCCCCCGTATAGTTAAGCCCCGCCCCGCTACTACTACTACTAGCAGCAGCAGCGCTCTCGCAGCGGGAGATGCGGTGTTGATCCGTGCCCCGCTCGGATCTCGGGACTGGTGCCGGCTCTGCCCAGGCCCCAGGCTCCAGGCCAGCTCCCTCGACGTTTCTCGGCGAGCTCGCTTGCCATGGAGGGCGACGCGGACGGCGTGAAGTCGGGGAGGCGCGGTGGCGGACAGGTGTGCCAGATCTGCGGCGACGGCGTGGGCACCACGGCGGAGGGGGACGTCTTCGCCGCCTGCGACGTCTGCGGGTTTCCGGTGTGCCGCCCCTGCTACGAGTACGAGCGCAAGGACGGCACGCAGGCGTGCCCCCAGTGCAAGACCAAGTACAAGCGCCACAAGGGGAGCCCGGCGATCCGTGGGGAGGAAGGAGACGACACTGATGCCGATAGCGACTTCAATTACCTTGCATCTGGCAATGAGGACCAGAAGCAGAAGATTGCCGACAGAATGCGCAGCTGGCGCATGAACGTTGGGGGCAGCGGGGATGTTGGTCGCCCCAAGTATGACAGTGGCGAGATCGGGCTTACCAAGTATGACAGTGGCGAGATTCCTCGGGGATACATCCCATCAGTCACTAACAGCCAGATCTCAGGAGAAATCCCTGGTGCTTCCCCTGACCATCATATGATGTCCCCAACTGGGAACATTGGCAAGCGTGCTCCATTTCCCTATGTGAACCATTCGCCAAATCCGTCAAGGGAGTTCTCTGGTAGCATTGGGAATGTTGCCTGGAAAGAGAGGGTTGATGGCTGGAAAATGAAGCAGGACAAGGGGACGATTCCCATGACGAATGGCACAAGCATTGCTCCCTCTGAGGGTCGGGGTGTTGGTGATATTGATGCATCAACTGATTACAACATGGAAGATGCCTTATTGAACGACGAAACTCGACAGCCTCTATCTAGGAAAGTTCCACTTCCTTCCTCCAGGATAAATCCATACAGGATGGTCATTGTGCTGCGATTGATTGTTCTAAGCATCTTCTTGCACTACCGTATCACAAATCCTGTGCGCAATGCATACCCATTATGGCTTCTATCTGTTATATGTGAGATCTGGTTTGCTCTTTCGTGGATATTGGATCAGTTCCCTAAGTGGTTTCCAATCAACCGGGAGACGTACCTTGATAGGCTGGCATTAAGGTATGACCGGGAAGGTGAGCCATCTCAGTTGGCTGCTGTTGACATTTTCGTCAGTACAGTCGACCCAATGAAGGAGCCTCCTCTTGTCACTGCCAATACCGTGCTATCCATTCTTGCTGTGGATTACCCTGTGGATAAGGTCTCTTGCTATGTATCTGATGATGGAGCTGCGATGCTGACATTTGATGCACTAGCTGAGACTTCAGAGTTTGCTAGAAAATGGGTACCATTTGTTAAGAAGTACAACATTGAACCTAGAGCTCCTGAATGGTACTTCTCCCAGAAAATTGATTACTTGAAGGACAAAGTGCACCCTTCATTTGTTAAAGACCGCCGGGCCATGAAGAGAGAATATGAAGAATTCAAAGTTAGGGTAAATGGCCTTGTTGCTAAGGCACAGAAAGTTCCTGAGGAAGGATGGATCATGCAAGATGGCACACCATGGCCAGGAAACAATACCNGGGACCATCCTGGAATGATTCAGGTTTTCCTTGGTCACAGTGGTGGCCTTGATACTGAGGGCAATGAGCTACCCCGTTTGGTCTATGTTTCTCGTGAAAAGCGTCCTGGATTCCAGCATCACAAGAAAGCTGGTGCCATGAATGCTCTTGTTCGTGTCTCAGCTGTGCTTACCAATGGACAATACATGTTGAATCTTGATTGTGATCACTACATTAACAACAGTAAGGCTCTCAGGGAAGCTATGTGCTTCCTTATGGACCCTAACCTAGGAAGGAGTGTCTGCTACGTCCAGTTTCCCCAGAGATTCGATGGCATTGACAGGAATGATCGATATGCCAACAGGAACACCGTGTTTTTCGATATTAACTTGAGAGGTCTTGATGGCATCCAAGGACCAGTTTATGTCGGAACTGGCTGTGTTTTCAACCGAACAGCTCTATATGGTTATGAGCCCCCAATTAAGCAGAAGAAGGGTGGTTTCTTGTCATCACTATGTGGCGGTAGGAAGAAGGCAAGCAAATCAAAGAAGGGCTCGGACAAGAAGAAGTCGCAGAAGCATGTGGACAGTTCTGTGCCAGTATTCAACCTTGAAGATATAGAGGAGGGAGTTGAAGGCGCTGGATTTGACGACGAGAAATCACTTCTTATGTCTCAAATGAGCCTGGAGAAGAGATTTGGCCAGTCCGCAGCGTTTGTTGCCTCCACTCTGATGGAGTATGGTGGTGTTCCTCAGTCCGCAACTCCGGAGTCTCTTCTGAAAGAAGCTATCCATGTTATAAGCTGTGGCTATGAGGACAAGACTGAATGGGGAACTGAGATCGGGTGGATCTACGGTTCTGTGACAGAAGACATTCTCACCGGATTCAAGATGCACGCGCGAGGCTGGCGGTCGATCTACTGCATGCCCAAGCGGCCAGCTTTCAAGGGGTCTGCCCCCATCAATCTTTCGGACCGTCTGAACCAGGTGCTCCGGTGGGCTCTTGGGTCCGTGGAGATCCTCTTCAGCCGGCACTGCCCCCTGTGGTACGGCTACGGAGGGCGGCTCAAGTTCCTGGAGAGATTCGCGTACATCAACACCACCATCTACCCGCTCACGTCCATCCCGCTTCTCATCTACTGCATCCTGCCCGCCATCTGTCTGCTCACCGGAAAGTTCATCATTCCAGAGATCAGCAACTTCGCCAGCATCTGGTTCATCTCCCTCTTCATCTCGATCTTCGCCACGGGCATCCTGGAGATGAGGTGGAGCGGGGTGGGCATCGACGAGTGGTGGAGGAACGAGCAGTTCTGGGTGATCGGGGGCATCTCCGCGCACCTCTTCGCCGTGTTCCAGGGCCTGCTCAAGGTGCTGGCCGGCATCGACACCAACTTCACCGTCACCTCCAAGGCCTCGGACGAGGACGGCGACTTCGCGGAGCTGTACATGTTCAAGTGGACGACGCTCCTGATCCCGCCCACCACCATCCTGATCATCAACCTGGTCGGCGTCGTCGCCGGCATCTCCTACGCCATCAACAGCGGATACCAGTCGTGGGGCCCGCTCTTCGGCAAGCTCTTCTTCGCCTTCTGGGTCATCGTCCACCTGTACCCGTTCCTCAAGGGCCTCATGGGCAGGCAGAACCGCACCCCGACCATCGTCGTCGTCTGGGCCATCCTGCTGGCGTCCATCTTCTCCTTGCTGTGGGTTCGCATCGACCCCTTCACCACCCGCGTCACTGGCCCGGATACCCAGACGTGTGGCATCAACTGCTAGGGAAGTGGAAGGTTTGTACTTTGTAGAAACGGAGGAATACCACGTGCCATCTGTTGTCTGTTAAGTTATATATATATAAGCAGCAAGTGGCGTTATTTACAGCTACGTACAGACCAGTGGATATTGTTTACCACAAAGTTTTACTTGTGTTAATATGCATTCTTTTGTTG

SEQ ID NO: 2803 - DNA, 1846 bp, Arabidopsis thaliana
  misc_feature (1)..(1846): Ceres cDNA ID no. 13667411
  misc_feature (1779)..(1779): n is a, c, t, g, unknown, or other
  misc_feature (1790)..(1790): n is a, c, t, g, unknown, or other
  misc_feature (1821)..(1821): n is a, c, t, g, unknown, or other
tctttctctctttcatcgccctcaccggaacgcgcctactctctttccacatcgtacgtttcctctctctaaattcttcaactttaaaggtgataaaaattgaatctttcccacaacccacaagaaaattcgaatcctttctctctttctatctcttagtcacgctttcgatcagcaatctcctcgaattctggttggttccgtctctgttttctgtacacaaagccctgctgctgttgatacacgtgagccgccattaatgcccctttgttttcttcttccagctgatttaggaagttggtgatcaaattacatctagtgtttgtttccgccagctgaagtgaatcaaaatgtttagttttggccgagcaagaagccaagggaggcaaaacagatctatgtctcttggaggactggattatgcagaccccaagaagaaaaacaattacttgggaaagattcttttgacagcttctcttacagccttgtgcattttcatgctcaagcaatctccaacattcaatactcctagcgtgttttctcgacatgagccaggggttacacatgttttggtcactggtggtgctgggtatattggttcacatgcagctctaaggcttctaaaggaatcatatcgagtgaccattgtggacaatctatcacggggcaatctcgctgcagtcaggattttgcaagaactatttccggaacctggaaggcttcaatttatttatgctgatcttggagatgccaaagctgtcaacaagatattcacagagaatgcctttgacgctgtgatgcatttcgctgctggtgcatatgttggggaaagcacacaattccctcttaagtattatcacaatattacatcgaacactttggtagtattagagacaatggctgctcatggagtaaagactttgatatattcaagcacttgtgcaacgtatggggagcctgatattatgccaattacagaggaaactcctcaggtgccaatcaacccatatggtaaggccaagaagatggcagaagatatcattttggatttctcgaaaaactcagatatggcagttatgatcctaagatatttcaatgtgattgggtccgatccagagggcagattgggtgaagccccaagacctgagctgcgagagcatggacgcatctccggtgcttgttttgatgcagcacgtggcatcatgcctggcctacagatcaaaggaacagactacaaaaccgctgatggaacttgcgtacgggattacattgatgtcactgatttggttgatgctcatgttaaagctcttcaaaaggcaaaaccacgcaaagttggaatctacaatgttggcaccgggaaaggtagctcggtgaaagagtttgttgaggcgtgcaagaaagcaactggtgttgagatcaagatcgactatttgcctagacgtgcaggtgattacgctgaggtttacagtgatccaagcaagattaggaaggaacttaactggacagctaagcacactaatctcaaagagagtcttgagactgcatggagatggcagaagctgcaccgtaatggctatggcttaacaacctcatcggtctcggtttactgactttgttcattcctttggtgatggacggagattttgattccagatggtattgaggagagaagcgtaggagatgatgatggtttatatataaatataacacaagatatattatccatattatgaaaaaatgatatcacatgaccagatttttgattgatattcattttgnaatggctttangttcttttaaggaaccagcccatttcattangtatatggtaccctttttacaaatt

SEQ ID NO: 2804 - protein, 419 aa, Arabidopsis thaliana
  misc_feature: PFam Name: Epimerase; PFam Description: NAD dependent
  misc_feature: GI Number: 51978946; NR Description: PREDICTED P0495H05.61 gene product [Oryza sativa (japonica cultivar-group)] >gi|51963258|ref|XP_506159.1| PREDICTED P0495H05.61 gene product
  misc_feature: GI Number: 51964664; NR Description: PREDICTED P0582D05.120 gene product [Oryza sativa (japonica cultivar-group)] >gi|27529690|dbj|BAC53786.1| UDP-galactose 4-epimerase-like protein
  misc_feature: GI Number: 25553524; NR Description: UDP-galactose
  misc_feature: GI Number: 50934141; NR Description: putative UDP-glucose 4-epimerase [Oryza sativa (japonica cultivar-group)] >gi|27260937|dbj|BAC45055.1| putative UDP-glucose 4-epimerase [Oryza sativa (japonica cultivar-group)]
  misc_feature: GI Number: 24417398; NR Description: unknown [Arabidopsis thaliana]
MFSFGRARSQGRQNRSMSLGGLDYADPKKKNNYLGKILLTASLTALCIFMLKQSPTFNTPSVFSRHEPGVTHVLVTGGAGYIGSHAALRLLKESYRVTIVDNLSRGNLAAVRILQELFPEPGRLQFIYADLGDAKAVNKIFTENAFDAVMHFAAGAYVGESTQFPLKYYHNITSNTLVVLETMAAHGVKTLIYSSTCATYGEPDIMPITEETPQVPINPYGKAKKMAEDIILDFSKNSDMAVMILRYFNVIGSDPEGRLGEAPRPELREHGRISGACFDAARGIMPGLQIKGTDYKTADGTCVRDYIDVTDLVDAHVKALQKAKPRKVGIYNVGTGKGSSVKEFVEACKKATGVEIKIDYLPRRAGDYAEVYSDPSKIRKELNWTAKHTNLKESLETAWRWQKLHRNGYGLTTSSVSVY

SEQ ID NO: 2805 - DNA, 1787 bp, Arabidopsis thaliana
  misc_feature (1)..(1787): Ceres cDNA ID no. 13667464
cggccgcctgtggaggctcttcttcttcttcttctctgtctctgtctctgtctctctgtaatcttctgtgctctccacaaatttgtctctcctctctctcgccgactccacaaattttgagcttctttttttgaagttcttgagaacaagtgaaagagcttaatatccacaagactcttgtttctttcttaaatggctaaagtttattggccttatttcgatcctgaatatgagaacttgagctccagaatcaatcctccaagtgtttctatagataacactagctgcaaagaatgcactcttgtcaaggtggacagtatgaacaaacctggaatactacttgaagttgtgcaagtcctaaccgatctcgatctcactatcactaaagcttatatctcttctgatggtggatggttcatggacgtattccatgtcaccgatcaacaaggaaacaaggttactgatagcaaaaccatcgattacatcgagaaggtgttaggaccaaagggtcatgcttcggcttcacaaaacacttggcctggtaaaagagtcggtgtccattcattaggcgaccacacatcgatagagattattgctcgtgatcgtcctggtctcttgtcggaggtttcagccgtactagcagacctcaacattaatgtggtggcagctgaagcatggactcacaaccgtaggattgcgtgtgtcctctatgtgaatgacaatgcaacttctagagccgttgatgatccagaaagattgtcttccatggaagaacagcttaacaatgtgctgcgtgggtgcgaagaacaagatgagaaatttgctcggacgagtctctccattgggtcgactcacgttgatcgaaggcttcatcagatgtttttcgctgatagagactacgaagcagtgactaagcttgatgattctgcttcttgcggattcgagcccaaaatcacggttgagcattgtgaagagaaaggttactccgtgataaacgtgagctgcgaggatcgaccaaagctcatgtttgacattgtatgcacgcttacggatatgcaatacattgtgtttcacgccacgatttcatcaagcggctctcatgcttctcaggagtatttcatcagacacaaagacggttgcactcttgacacagaaggagagaaagagagagttgtcaaatgtctggaagctgcaatccatagacgagtcagcgagggttggagtttggagctctgcgcaaaggacagagttggattactgtcggaagtgacaaggattctgagagagcacgggctatcagtgtcgagagctggtgtgacaacagtaggagaacaagccgtcaacgttttctatgtgaaagatgcttcagggaatccagtggatgtgaagacgattgaggcgttacgcggagagattggacacagtatgatgattgacttcaagaataaagttccgagcagaaaatggaaagaagaaggtcaagccggaacaggaggaggatgggccaaaaccagtttcttctttgggaatttgctggagaagttactgccttgagagaaaaggtaactatgtgtggataaaacgtactgtaaaatgtgtattatgtatgatctagagggccttagtgtgatgtatgacttggtcagggattttggtggtttgcccgaagtcaaaccgaaccaaaactggttttcggttactttagactttagtcatagtaaaatgaacatgtctataaatgaataatatgcaactcttccaattggtaggcttgcttttggcggccg

SEQ ID NO: 2806 - protein, 453 aa, Arabidopsis thaliana
  misc_feature: PFam Name: ACT; PFam Description: ACT domain
  misc_feature: GI Number: 21593552; NR Description: unknown [Arabidopsis thaliana]
  misc_feature: GI Number: 25370627; NR Description: protein F4N2.2 [imported] - Arabidopsis thaliana
  misc_feature: GI Number: 42572033; NR Description: ACT domain containing
  misc_feature: GI Number: 15239390; NR Description: ACT domain-containing
  misc_feature: GI Number: 34896992; NR Description: putative ACT domain repeat protein [Oryza sativa (japonica cultivar-group)] >gi|28875985|gb|AAO59994.1| putative ACT domain repeat protein
MAKVYWPYFDPEYENLSSRINPPSVSIDNTSCKECTLVKVDSMNKPGILLEVVQVLTDLDLTITKAYISSDGGWFMDVFHVTDQQGNKVTDSKTIDYIEKVLGPKGHASASQNTWPGKRVGVHSLGDHTSIEIIARDRPGLLSEVSAVLADLNINVVAAEAWTHNRRIACVLYVNDNATSRAVDDPERLSSMEEQLNNVLRGCEEQDEKFARTSLSIGSTHVDRRLHQMFFADRDYEAVTKLDDSASCGFEPKITVEHCEEKGYSVINVSCEDRPKLMFDIVCTLTDMQYIVFHATISSSGSHASQEYFIRHKDGCTLDTEGEKERVVKCLEAAIHRRVSEGWSLELCAKDRVGLLSEVTRILREHGLSVSRAGVTTVGEQAVNVFYVKDASGNPVDVKTIEALRGEIGHSMMIDFKNKVPSRKWKEEGQAGTGGGWAKTSFFFGNLLEKLLP

SEQ ID NO: 2807 - DNA, 1351 bp, Arabidopsis thaliana
  misc_feature (1)..(1351): Ceres cDNA ID no. 13667710
  misc_feature (1)..(1351): Also known as  Ceres CDNA ID no. 23485806
caaaaaatattaagaaagtgatattatgacttgcagccaaacactcggaaacaacaacaccaacaaataccagatctgcgaggagatcggccgtggccgtttcggcaccgtctctcgcgtctacgctccggccaccggtgatttcttcgcttgcaaaaccatcgacaaagcctctctctccgacgaccttgaccgtgcctgtctcgacaacgagcctaagctcatggctctcttgtcctatcaccctaacatcgttcaaatccatgatctcatcgacactgattcgactctctccatcttcatggagctcgtccatccctctgtttcgatctacgaccgtctcgtctcttctggaaccttctttgagcctcagacggcgtcgttcgctaaacagattctccaggcgctttcgcattgtcaccgatacggcgtcgttcacagggatattaaaccggagaacattctggtagatctacgaaacgatacggttaagatctgcgatttcggttcagggatttggttaggtgagggagagaccaccgaaggagtcgtcggaacgccgtattacgtggcgccggaggttttaatgggatattcttacggagagaaggtcgatctatggagcgccggcgtcgttttgtacacgatgctcgctggaactccaccgttttacggcgagacagctgaagagatattcgaagcggtactcagaggaaatctccgttttccgacgaagatattccggggggtttcatctatggctaaagatttcctaaggaaattgatatgcaaagatgcttctagaagattctcagccgaacaagcattaaggcacccatggatccaaagagcaggagaaacagaggagagattcatctagaagattctctcggagaaataaataagtgtcaagtgatagcttatcatctctctcggtggttttttatctaacaagtatggaggagtgtcgggcatgtaaatttgggttatgggcattttagattccgccagcctaccaacctagtagaagagaagactctggaaaagacttttaaccaaaaaaaaaggagctgaataataaaagaagcttgtttgttgtggctgcttctgagtttggcgatgagttttttttttttttctgcatttgttgcttatgtgaattttgtttggcttttgaaaagtctttttaggggtagagacggtaatgtagagaggataacaaatctttttccgccttttacgggtttttttttccatgtggggtgagtaaaaggatgtgagaaagcagagttgtactcctttttctgcttttttttttttttaatcaataaaaatagtttatgttatccct

SEQ ID NO: 2808 - protein, 1351 aa, Arabidopsis thaliana
  misc_feature: PFam Name: Cellulose_synt; PFam Description: Cellulose synthase
  misc_feature: PFam Name: Glycos_transf_2; PFam Description: Glycosyl transferase
  misc_feature: PFam Name: MAGE; PFam Description: MAGE family
  misc_feature: GI Number: 49615365; NR Description: CesA2 [Acacia mangium]
  misc_feature: GI Number: 34419230; NR Description: TPA: cellulose
  misc_feature: GI Number: 13925884; NR Description: cellulose synthase
  misc_feature: GI Number: 33186651; NR Description: cellulose synthase
  misc_feature: GI Number: 38532102; NR Description: cellulose synthase
CAAAAAATATTAAGAAAGTGATATTATGACTTGCAGCCAAACACTCGGAAACAACAACACCAACAAATACCAGATCTGCGAGGAGATCGGCCGTGGCCGTTTCGGCACCGTCTCTCGCGTCTACGCTCCGGCCACCGGTGATTTCTTCGCTTGCAAAACCATCGACAAAGCCTCTCTCTCCGACGACCTTGACCGTGCCTGTCTCGACAACGAGCCTAAGCTCATGGCTCTCTTGTCCTATCACCCTAACATCGTTCAAATCCATGATCTCATCGACACTGATTCGACTCTCTCCATCTTCATGGAGCTCGTCCATCCCTCTGTTTCGATCTACGACCGTCTCGTCTCTTCTGGAACCTTCTTTGAGCCTCAGACGGCGTCGTTCGCTAAACAGATTCTCCAGGCGCTTTCGCATTGTCACCGATACGGCGTCGTTCACAGGGATATTAAACCGGAGAACATTCTGGTAGATCTACGAAACGATACGGTTAAGATCTGCGATTTCGGTTCAGGGATTTGGTTAGGTGAGGGAGAGACCACCGAAGGAGTCGTCGGAACGCCGTATTACGTGGCGCCGGAGGTTTTAATGGGATATTCTTACGGAGAGAAGGTCGATCTATGGAGCGCCGGCGTCGTTTTGTACACGATGCTCGCTGGAACTCCACCGTTTTACGGCGAGACAGCTGAAGAGATATTCGAAGCGGTACTCAGAGGAAATCTCCGTTTTCCGACGAAGATATTCCGGGGGGTTTCATCTATGGCTAAAGATTTCCTAAGGAAATTGATATGCAAAGATGCTTCTAGAAGATTCTCAGCCGAACAAGCATTAAGGCACCCATGGATCCAAAGAGCAGGAGAAACAGAGGAGAGATTCATCTAGAAGATTCTCTCGGAGAAATAAATAAGTGTCAAGTGATAGCTTATCATCTCTCTCGGTGGTTTTTTATCTAACAAGTATGGAGGAGTGTCGGGCATGTAAATTTGGGTTATGGGCATTTTAGATTCCGCCAGCCTACCAACCTAGTAGAAGAGAAGACTCTGGAAAAGACTTTTAACCAAAAAAAAAGGAGCTGAATAATAAAAGAAGCTTGTTTGTTGTGGCTGCTTCTGAGTTTGGCGATGAGTTTTTTTTTTTTTTCTGCATTTGTTGCTTATGTGAATTTTGTTTGGCTTTTGAAAAGTCTTTTTAGGGGTAGAGACGGTAATGTAGAGAGGATAACAAATCTTTTTCCGCCTTTTACGGGTTTTTTTTTCCATGTGGGGTGAGTAAAAGGATGTGAGAAAGCAGAGTTGTACTCCTTTTTCTGCTTTTTTTTTTTTTTAATCAATAAAAATAGTTTATGTTATCCCT

SEQ ID NO: 2809 - DNA, 1187 bp, Arabidopsis thaliana
  misc_feature (1)..(1187): Ceres cDNA ID no. 13667908
tcttcttcattagcctttcgtctccttcttctcttctctatctctctttagcttctctacgcaagcttattatctctttctcttaaagctttttctatatacaaacagaagcgtttgatactgtaaaaaagatttagaaatggagactctgagtcgtttattggttttcatgtctctgttttccggtttagtttctggatttgctctgcaaaatcttccaatcacatcttttgaagaaagttacactcaactttttggtgacaagaacttatttgttcatcaagatggcaaatctgtccggttaacgctcgatgaaagaaccggttccggttttgtttcaaatgattattacttgcatggattcttcagtgcttcaattaaattaccttctgattatacagctggagttgttgttgccttttatatgtctaatggagatatgtatgagaagaatcatgatgagatagattttgagtttcttggtaacattagagaaaaagaatggagagttcagacaaacatttacggtaatggaagtactcattcaggaagagaagagagatataatctctggtttgatcctactgaagattttcatcaatacagtatcctctggtctgattctcacatcatattctttgtagacaatgttcctattagagaggtcaaacgtactgcggaaatgggtggtcactttccatcaaagccgatgtctctctacacaacaatatgggacggttctaaatgggcaactaacggtggaaagtacggtgtaaactacaaatatgcgccttacattgcgcggttctcggatctagtcctgcacggctgccccgtggaccctatcgagcagtttccgaggtgcgatgaaggcgcggctgaggatatgcgtgcggcgcaagagattactccttcacaaaggagtaaaatggatgttttcagacggagactcatgacatattcatattgctatgatcgggctaggtacaatgttgctttatcggagtgtgtggtgaatcccgctgaggctcaaaggcttagggtttatgatccggtcagatttggcggcattccgaggcgccaccgcaatggaaagcaccggagcaagagaagccgggttgatggaaccgagtcgatatgataacatatataggcaaaatagtatgggtgagatttggccggaattc

SEQ ID NO: 2810 - protein, 333 aa, Arabidopsis thaliana
  misc_feature: PFam Name: Glyco_hydro_16; PFam Description: Glycosyl
  misc_feature: PFam Name: XET_C; PFam Description: Xyloglucan
  misc_feature: GI Number: 5533313; NR Description: endoxyloglucan
  misc_feature: GI Number: 21553969; NR Description: putative
  misc_feature: GI Number: 6681351; NR Description: ETAG-A3 [Lycopersicon
  misc_feature: GI Number: 13560781; NR Description: endoxyloglucan
  misc_feature: GI Number: 1244754; NR Description: xyloglucan endotransglycosylase-related protein gi|2129774|pir||S71223 xyloglucan endo-1,4-beta-D-glucanase (EC 3.2.1.-) XTR-4 -
METLSRLLVFMSLFSGLVSGFALQNLPITSFEESYTQLFGDKNLFVHQDGKSVRLTLDERTGSGFVSNDYYLHGFFSASIKLPSDYTAGVVVAFYMSNGDMYEKNHDEIDFEFLGNIREKEWRVQTNIYGNGSTHSGREERYNLWFDPTEDFHQYSILWSDSHIIFFVDNVPIREVKRTAEMGGHFPSKPMSLYTTIWDGSKWATNGGKYGVNYKYAPYIARFSDLVLHGCPVDPIEQFPRCDEGAAEDMRAAQEITPSQRSKMDVFRRRLMTYSYCYDRARYNVALSECVVNPAEAQRLRVYDPVRFGGIPRRHRNGKHRSKRSRVDGTESI

SEQ ID NO: 2811 - DNA, 1208 bp, Arabidopsis thaliana
  misc_feature (1)..(1208): Ceres cDNA ID no. 13668003
ggtacgagcttaatccgccgtctctcactttttcgccggcgtggttagatcgtacaaagctcagagagaatgttgggaatcttgaggcaaagagccatcgatggagcttcgactcttaggaggacgcgattcgcattggtttctgctaggagctatgcagctggtgcaaaagagatgacagtcagagatgctctaaattctgcaattgatgaggaaatgtctgctgatcctaaagtatttgtcatgggtgaagaggttggccaatatcaaggtgcctacaagatcactaaaggccttttggagaaatatggtcctgagagagtttacgatacccctattactgaggctggatttactggaattggagttggtgctgcctatgctggcttaaagcccgttgtagaatttatgacgtttaacttctctatgcaggcaattgatcatatcatcaattccgctgcaaagtcaaattacatgtctgctggacagataaatgtacccatcgtctttagaggacccaatggtgctgctgctggtgttggagctcaacattctcagtgctatgcagcgtggtatgcctcagttcctggtttgaaagtccttgctccgtattcagctgaagatgctcgtggtcttcttaaagctgccattagagaccctgaccctgttgtcttccttgaaaacgagttactatatggtgaatcattccctatttcagaagaagcccttgattcaagtttctgtcttcccataggcaaagccaagattgaacgagaaggaaaggacgtaacgatagtaactttctcgaagatggtcggtttcgccctcaaggcagctgagaagctcgcagaagagggaataagtgctgaggtaataaatcttcgatcaatccgtccgcttgaccgagccaccatcaatgcttcagtgaggaaaacgagtagattggtaacagttgaagaaggtttcccacaacatggagtctgtgcagaaatttgtgcgtcggttgtagaagagagcttttcgtacttggatgcaccggtcgagaggattgcaggagctgatgttccaatcccgtatacagctaacctagagagattggctcttcctcagatagaggacatcgttcgtgcatcaaagagagcttgttacagatcgaaataaaatcgtcaacatcaacacatttcttctttgatctttaaagggaaagg

SEQ ID NO: 2812 - protein, 363 aa, Arabidopsis thaliana
  misc_feature: PFam Name: Transket_pyr; PFam Description: Transketolase,
  misc_feature: PFam Name: Transketolase_C; PFam Description: Transketolase,
  misc_feature: GI Number: 520478; NR Description: pyruvate dehydrogenase E1
  misc_feature: GI Number: 3850999; NR Description: pyruvate dehydrogenase E1
  misc_feature: GI Number: 3851001; NR Description: pyruvate dehydrogenase E1
  misc_feature: GI Number: 3851003; NR Description: pyruvate dehydrogenase E1
  misc_feature: GI Number: 25012844; NR Description: RH05604p [Drosophila
MLGILRQRAIDGASTLRRTRFALVSARSYAAGAKEMTVRDALNSAIDEEMSADPKVFVMGEEVGQYQGAYKITKGLLEKYGPERVYDTPITEAGFTGIGVGAAYAGLKPVVEFMTFNFSMQAIDHIINSAAKSNYMSAGQINVPIVFRGPNGAAAGVGAQHSQCYAAWYASVPGLKVLAPYSAEDARGLLKAAIRDPDPVVFLENELLYGESFPISEEALDSSFCLPIGKAKIEREGKDVTIVTFSKMVGFALKAAEKLAEEGISAEVINLRSIRPLDRATINASVRKTSRLVTVEEGFPQHGVCAEICASVVEESFSYLDAPVERIAGADVPIPYTANLERLALPQIEDIVRASKRACYRSK

SEQ ID NO: 2813 - DNA, 1192 bp, Arabidopsis thaliana
  misc_feature (1)..(1192): Ceres cDNA ID no. 14302709
  misc_feature (1)..(1192): Ceres CLONE  ID no. 154882
  misc_feature (1)..(1192): Also known as  Ceres CDNA ID no. 23648630
actcatctctaacgtttctttctatctctaatccaagcaacaatatggattccgtaatcgctttcgacagatctccgatgtttcgagtctacaagagtggccgcattgagcgtctcttaggagaaacaaccgtcccaccatctcttacaccacaaaacggtgtcgtctccaaagatatcatccattcaccggagaaaaacctctccctccgcatctacctaccggagaaagtcactgttaaaaagctcccaatcctcatctacttccacggtggtggtttcatcatagaaacagctttttctccaccctaccacactttcctcacatccaccgtcgcggccgctaactgcttagcaatatcagtaaactatcgccgtgcaccggagtttccggtacctattccgtacgaagattcatgggattcactcaaatgggtgttaactcatatcacaggaaccggaccggaaacttggataaacaaacacggcgatttcggaaaagtgtttctcgccggagatagcgccggtggaaacatatctcatcatctaacgatgcgagcgaaaaaagagaagctttgtgattctttaatatcagggataatcttgattcatccatatttttggagtaagactccaattgatgagtttgaggttagagacgtggggaagacgaaaggtgttgaaggaagttggagagtcgcaagtccgaatagtaaacaaggagttgatgatccatggctcaacgttgtcggatcggatccatccggattaggttgcgggcgggttttggtaatggtagctggagatgatctgtttgtgagacaaggttggtgttacgcggagaagctgaagaagagtggatgggaaggtgaagttgaggtaatggaggctaaaaatgaaggtcatgtttttcatttgaagaatcctaatagtgataatgctcgtcaagtcgtgaagaaacttgaagagtttattaataagtaatattaatgagtacgtttgtcgaaggagataacaataactaaagaataaattggtgtatttgtcactgattacatatagaattatgctatcacatttagggttaaagccaagaggagtcagttaaagtttcagttacttttctttcaagtaactgatagaaagacgattaattgtattagtttgtggtaaataaatggtttggtttgaat

SEQ ID NO: 2814 - protein, 1192 aa, Arabidopsis thaliana
  misc_feature: PFam Name: Abhydrolase_3; PFam Description: alpha/beta
  misc_feature: PFam Name: COesterase; PFam Description: Carboxylesterase
  misc_feature: GI Number: 50198965; NR Description: At2g03550 [Arabidopsis
  misc_feature: GI Number: 28393060; NR Description: putative esterase
  misc_feature: GI Number: 18086341; NR Description: AT3g48690/T8P19_200
  misc_feature: GI Number: 21537287; NR Description: putative esterase
  misc_feature: GI Number: 51535285; NR Description: putative PrMC3 [Oryza
ACTCATCTCTAACGTTTCTTTCTATCTCTAATCCAAGCAACAATATGGATTCCGTAATCGCTTTCGACAGATCTCCGATGTTTCGAGTCTACAAGAGTGGCCGCATTGAGCGTCTCTTAGGAGAAACAACCGTCCCACCATCTCTTACACCACAAAACGGTGTCGTCTCCAAAGATATCATCCATTCACCGGAGAAAAACCTCTCCCTCCGCATCTACCTACCGGAGAAAGTCACTGTTAAAAAGCTCCCAATCCTCATCTACTTCCACGGTGGTGGTTTCATCATAGAAACAGCTTTTTCTCCACCCTACCACACTTTCCTCACATCCACCGTCGCGGCCGCTAACTGCTTAGCAATATCAGTAAACTATCGCCGTGCACCGGAGTTTCCGGTACCTATTCCGTACGAAGATTCATGGGATTCACTCAAATGGGTGTTAACTCATATCACAGGAACCGGACCGGAAACTTGGATAAACAAACACGGCGATTTCGGAAAAGTGTTTCTCGCCGGAGATAGCGCCGGTGGAAACATATCTCATCATCTAACGATGCGAGCGAAAAAAGAGAAGCTTTGTGATTCTTTAATATCAGGGATAATCTTGATTCATCCATATTTTTGGAGTAAGACTCCAATTGATGAGTTTGAGGTTAGAGACGTGGGGAAGACGAAAGGTGTTGAAGGAAGTTGGAGAGTCGCAAGTCCGAATAGTAAACAAGGAGTTGATGATCCATGGCTCAACGTTGTCGGATCGGATCCATCCGGATTAGGTTGCGGGCGGGTTTTGGTAATGGTAGCTGGAGATGATCTGTTTGTGAGACAAGGTTGGTGTTACGCGGAGAAGCTGAAGAAGAGTGGATGGGAAGGTGAAGTTGAGGTAATGGAGGCTAAAAATGAAGGTCATGTTTTTCATTTGAAGAATCCTAATAGTGATAATGCTCGTCAAGTCGTGAAGAAACTTGAAGAGTTTATTAATAAGTAATATTAATGAGTACGTTTGTCGAAGGAGATAACAATAACTAAAGAATAAATTGGTGTATTTGTCACTGATTACATATAGAATTATGCTATCACATTTAGGGTTAAAGCCAAGAGGAGTCAGTTAAAGTTTCAGTTACTTTTCTTTCAAGTAACTGATAGAAAGACGATTAATTGTATTAGTTTGTGGTAAATAAATGGTTTGGTTTGAAT

SEQ ID NO: 2815 - DNA, 2071 bp, Arabidopsis thaliana
  misc_feature (1)..(2071): Ceres cDNA ID no. 14302791
  misc_feature (1)..(2071): Ceres CLONE  ID no. 1198559
  misc_feature (1)..(2071): Also known as  Ceres CDNA ID no. 23656432
gatcatttcctgaaaactagaaaacacagtttaaagggaacataaaaagcaactctttgagagatcagagaaaccctaatttgctaagaaccctaatctcaatttccatcttccaaagttcagattctgtatgtaaatgcatctgaagaattctactgtagcagaacggcggtacatcggaaaagaaaccgccggttatttaacttcttcctccgatttggatccgaaacctaagattaaacatcatcgtcctcttcaggtacctgagattctgactccagacattggtgctggtgctggattcagtgtgtataacaatcaagttcaagctcagagtcgtcatcatctgacggttgaaatcccagattcatcgtctcacaatcttacatctaagagacctgtggtggttcaatcttctaatccgttcaacgttgacgatttccgaagacagcaacgcacaagcttgggttcgatttcatcttattgtccgtcgtatctcttatcgtttttttcttcttctcttccatcgatcccatcggcgactaatcagaagcttcttcgtcatgttcttagagtccgtttgatatgtttccatcttcgtttcttacttcttctctctgttcctcctctctatatctttttcctggtgattagtttcagattcttccttctctttgtcttctcgattatcgctttctctttcgtcctttcgatctctctcaaattcgctcttcctcacttaccatcgattcgtttgattatcgctcggttactttctctcaagcttacccctaccagatcatcctcttcatctcaggagaacactaaacatgttatttggtcaattgggtctaagcctgtgactgagaagaagaccaactctggctcatgggttcagaagtacagctctggtgatgtatacgagggagagtttcatagggggaagtgttcaggaagtggagtttattactattctatgaagggtaaatacgaaggggattggattgatgggaagtatgatggatatggagttgaaacttgggctaaagggagtaggtaccgaggtcaatacaggcaagggatgagacatggaactggtatctacagattttatacaggggatgtatatgctggtgagtggtcgaatggacagagccatggctgtggtgtgtatacctctgaggatggtagtcgttttgttggagagtttaaatggggtgtcaaacatggccttggtcattatcatttcagaaatggtgatacatatgctggggagtattttgcagacaggatgcatggttttggagtgtatcaatttggaaacgggcatcggtatgaaggagcctggcatgaggggagaaggcaaggacttggtatgtacacgttcaggaatggtgagacacaggcaggccattgggaagacggagttcttaactgtcctaccgagcagaccactcgccctgattcatcgttttccatcagtcattccaaggttgtcgacactgtccagcaagcaaggaaagcagccaagaaagcacgcgaagttgtgaaagttgaagagagagtgaacagagcagtgatggtcgcaaaccgagcagcaaatgctgctagagttgctgctacaaaggctgtccaaacccaaacatttcattgtagtagtggtgacgatcccttgtgaattcctgcggcaaagattttgacataatcgcagtcatgaccttacctcaaacttctacgaagacagaagagtgaaagagagatgtttagagaacagagtcagaattcgcaatctccgttgagattttcttgaaggtgaaccacttggaaccaatatcgagatctcataagtaataagtaagagatctggctatggagcaagtattactggtttactttttcttttctcccacttgttttatgagcaggctggtttaaaactgtacataggttgttgaagagtaagcaatgtgtgttaacaaaagatctttgtaacaagcgtaatccatgtaagagaagtaacaaaacattgttttacttttacaacgtgttgaaaataacacctttttttacc

SEQ ID NO: 2816 - protein, 513 aa, Arabidopsis thaliana
  misc_feature: PFam Name: MORN; PFam Description: MORN repeat
  misc_feature: GI Number: 21928129; NR Description: AT4g17080/dl4570w [Arabidopsis thaliana] >gi|27764944|gb|AAO23593.1|
  misc_feature: GI Number: 37536922; NR Description: putative phosphatidylinositol-4-phosphate 5-kinase [Oryza sativa (japonica cultivar-group)] >gi|12597886|gb|AAG60194.1| putative phosphatidylinositol-4-phosphate 5-kinase [Oryza sativa]
  misc_feature: GI Number: 51535948; NR Description: 1-phosphatidylinositol-4-phosphate 5-kinase-like protein [Oryza
  misc_feature: GI Number: 23297433; NR Description: putative phosphatidylinositol-4-phosphate 5-kinase [Arabidopsis thaliana] >gi|13878045|gb|AAK44100.1| putative phosphatidylinositol-4-phosphate 5-kinase [Arabidopsis thaliana]
  misc_feature: GI Number: 21593251; NR Description: phosphatidylinositol-4-phosphate 5-kinase, putative [Arabidopsis
MHLKNSTVAERRYIGKETAGYLTSSSDLDPKPKIKHHRPLQVPEILTPDIGAGAGFSVYNNQVQAQSRHHLTVEIPDSSSHNLTSKRPVVVQSSNPFNVDDFRRQQRTSLGSISSYCPSYLLSFFSSSLPSIPSATNQKLLRHVLRVRLICFHLRFLLLLSVPPLYIFFLVISFRFFLLFVFSIIAFSFVLSISLKFALPHLPSIRLIIARLLSLKLTPTRSSSSSQENTKHVIWSIGSKPVTEKKTNSGSWVQKYSSGDVYEGEFHRGKCSGSGVYYYSMKGKYEGDWIDGKYDGYGVETWAKGSRYRGQYRQGMRHGTGIYRFYTGDVYAGEWSNGQSHGCGVYTSEDGSRFVGEFKWGVKHGLGHYHFRNGDTYAGEYFADRMHGFGVYQFGNGHRYEGAWHEGRRQGLGMYTFRNGETQAGHWEDGVLNCPTEQTTRPDSSFSISHSKVVDTVQQARKAAKKAREVVKVEERVNRAVMVANRAANAARVAATKAVQTQTFHCSSGDDPL

SEQ ID NO: 2817 - DNA, 1378 bp, Zea mays
  misc_feature (1)..(1378): Ceres cDNA ID no. 14303290
  misc_feature (1)..(1378): Ceres CLONE  ID no. 439222
  misc_feature (1)..(1378): Also known as  Ceres CDNA ID no. 24365239
ctctttctcttccaaggagaacaaccaccgtctctctctcccccgtctatctcttcttggagcctggagaagaggaaggatcagggaacgggggaagaggttgctgccacagctcaggtctcaagtttggattcagacaagtagacaaacaccagttggttaagatggcagctggtttccagatcggtgtgatcgggtcacttgcactctctgttgcatcttcagtttccattgtcctctgcaacaaagctctcatcagcacacttggttttccattcgctacaacattaacaagctggcatctgatggtgaccttctgcaccctccatgtggcacagcgcttacgtttcttcgagcccaaggcaattgatggacagacagtcatactctttgggttgctgaatggcacgtcaattggtcttctcaatctgagtttaggattcaactccattggattctaccagatgacaaaattggcgatcatacctttcactgtgctattggagactatcttcttgaagaaaagattcagcgagagtatcaagctttctcttctggtcttacttcttggagtaggaattgcttcagttactgatctcaagctaaatctgcttgggtccatcctttctggcctcgccattgccaccacctgtgttggccaaattctcacaaatacaatacagaagaggttgaaggtctcctcaacgcaacttctgtaccaatctgcgccttaccaggcggcaattctgtttgcatctgggccttttgtagatcaactccttactaaccggagtgtctttgcacacaaatactctgctacagttctgggtttcgttgtcctctcttgcttgattgcggtgtctgtgaacttcagtacatttcttgtgattggaacaacatccccagtgacgtaccaggtgcttggtcaccttaagacatgtctggttctatcatttggctacactctattacatgatcctttcactctaaggaacatattgggcattctaattgccatatttgggatggcactatactcctatttctctgtaagagagggcaagaagaagtcagcaaatgatgccctgccagtttcacagatgccagataaggaggttgaaccgcttttggcaactaaagacagcaatgacaccaagaaagcaaatggtttatctcacgactgctagggcttttcttgtagtttaggtctagtatgaactgcccttagaatttaatggacttggaaagccattcttttcattcttgatttcctttttaggaaaggaagattttaaaatttgtagataatgtgtattttgacgttaaagttattgtttgattgtattctacacacagcagttccatctgaagttttact

SEQ ID NO: 2818 - protein, 1378 aa, Zea mays
  misc_feature: GI Number: 50910741; NR Description: phosphate translocator-like [Oryza sativa (japonica cultivar-group)] >gi|48717036|dbj|BAD23725.1| phosphate translocator-like [Oryza
  misc_feature: GI Number: 13384378; NR Description: putative phosphate
  misc_feature: GI Number: 30984584; NR Description: At2g30460 [Arabidopsis thaliana] >gi|27311731|gb|AAO00831.1| putative integral membrane protein [Arabidopsis thaliana] >gi|51970690|dbj|BAD44037.1| integral membrane protein -like [Arabidopsis thaliana]
  misc_feature: GI Number: 13699188; NR Description: putative
  misc_feature: GI Number: 42570326; NR Description: transporter-related
CTCTTTCTCTTCCAAGGAGAACAACCACCGTCTCTCTCTCCCCCGTCTATCTCTTCTTGGAGCCTGGAGAAGAGGAAGGATCAGGGAACGGGGGAAGAGGTTGCTGCCACAGCTCAGGTCTCAAGTTTGGATTCAGACAAGTAGACAAACACCAGTTGGTTAAGATGGCAGCTGGTTTCCAGATCGGTGTGATCGGGTCACTTGCACTCTCTGTTGCATCTTCAGTTTCCATTGTCCTCTGCAACAAAGCTCTCATCAGCACACTTGGTTTTCCATTCGCTACAACATTAACAAGCTGGCATCTGATGGTGACCTTCTGCACCCTCCATGTGGCACAGCGCTTACGTTTCTTCGAGCCCAAGGCAATTGATGGACAGACAGTCATACTCTTTGGGTTGCTGAATGGCACGTCAATTGGTCTTCTCAATCTGAGTTTAGGATTCAACTCCATTGGATTCTACCAGATGACAAAATTGGCGATCATACCTTTCACTGTGCTATTGGAGACTATCTTCTTGAAGAAAAGATTCAGCGAGAGTATCAAGCTTTCTCTTCTGGTCTTACTTCTTGGAGTAGGAATTGCTTCAGTTACTGATCTCAAGCTAAATCTGCTTGGGTCCATCCTTTCTGGCCTCGCCATTGCCACCACCTGTGTTGGCCAAATTCTCACAAATACAATACAGAAGAGGTTGAAGGTCTCCTCAACGCAACTTCTGTACCAATCTGCGCCTTACCAGGCGGCAATTCTGTTTGCATCTGGGCCTTTTGTAGATCAACTCCTTACTAACCGGAGTGTCTTTGCACACAAATACTCTGCTACAGTTCTGGGTTTCGTTGTCCTCTCTTGCTTGATTGCGGTGTCTGTGAACTTCAGTACATTTCTTGTGATTGGAACAACATCCCCAGTGACGTACCAGGTGCTTGGTCACCTTAAGACATGTCTGGTTCTATCATTTGGCTACACTCTATTACATGATCCTTTCACTCTAAGGAACATATTGGGCATTCTAATTGCCATATTTGGGATGGCACTATACTCCTATTTCTCTGTAAGAGAGGGCAAGAAGAAGTCAGCAAATGATGCCCTGCCAGTTTCACAGATGCCAGATAAGGAGGTTGAACCGCTTTTGGCAACTAAAGACAGCAATGACACCAAGAAAGCAAATGGTTTATCTCACGACTGCTAGGGCTTTTCTTGTAGTTTAGGTCTAGTATGAACTGCCCTTAGAATTTAATGGACTTGGAAAGCCATTCTTTTCATTCTTGATTTCCTTTTTAGGAAAGGAAGATTTTAAAATTTGTAGATAATGTGTATTTTGACGTTAAAGTTATTGTTTGATTGTATTCTACACACAGCAGTTCCATCTGAAGTTTTACT

SEQ ID NO: 2819 - DNA, 1342 bp, Arabidopsis thaliana
  misc_feature (1)..(1342): Ceres cDNA ID no. 14304330
  misc_feature (1)..(1342): Ceres CLONE  ID no. 1351862
  misc_feature (1)..(1342): Also known as  Ceres CDNA ID no. 0
atttagcttggagggataacgcattctttatgcactttttgcagaaaatatgaccacatttcgttgaaacctcctgagtaaatggacacagacagattggacagctaaattttggttcctctacaggaggagccacagccttggactttctcggcttgttaagctcaactgagtcaacactagtttgatcagagcgacgccttgtggatctattagcaccagctgactccacatcaactacttgtgatcctctgcgtgcacttctcgatttgtttttagcctgagcaaaagcagaagcagttgattcaacaacatcatcatcatcttcaatagcaaccacattgatcctaggaggagtagccacaatctgaggcaccgttggagctcgccccccacttgatagtggactcaaccactcaaaaagtgtaacggagtcaaaaaatctctcatatccaaagtagtgtaatccattgtaaccaggtttcatcagaaagcctttggattgtaataatcctttcgtgtcctttcgtttctctcactccactctgcaatctacttcatcgtcgacatcttcttgcgcatttcaaaggttagcttaactctgttgaaagatggcttctcgggtggtgaggactagtatgagacttcgaaggagggatggtgtgactcaaaacgaacaccagggagatcaacaagtggctgaccaagctccaacggtgcctcagattgtggctactcctcctaggatcaatgtggttgctattgaagatgatgatgatgttgttgaatcaactgcttctgcttttgctcaggctaaaaacaaatcgagaagtgcacgcagaggatcacaagtagttgatgtggagtcagctggtgctaatagatccacaaggcgtcgctctgatcaaactagtgttgactcagttgagcttaacaagccgagaaagtccaaggctgtggctcctcctgtagaggaaccaaaatttagctgtccaatctgtctgtgtccatttactcaggaggtttcaacgaaatgtggtcatattttctgcaaaaagtgcataaagaatgcgttatccctccaagctaaatgcccgacatgtaggaaaaaaatcactgttaaggaccttatccgggtcttccttccaaccaccagatgaatgatacagaaacatcactagtagccatggatagtggtctagcgattctacctccaacgatgaagaaatgttgttcattagttgtagtttgttatgtcaatattgttctgttttgtaagagaaatatctaggaattatggaagacctgattttctaatggatatcgttcattggtgatcttc

SEQ ID NO: 2820 - protein, 1342 aa, Arabidopsis thaliana
ATTTAGCTTGGAGGGATAACGCATTCTTTATGCACTTTTTGCAGAAAATATGACCACATTTCGTTGAAACCTCCTGAGTAAATGGACACAGACAGATTGGACAGCTAAATTTTGGTTCCTCTACAGGAGGAGCCACAGCCTTGGACTTTCTCGGCTTGTTAAGCTCAACTGAGTCAACACTAGTTTGATCAGAGCGACGCCTTGTGGATCTATTAGCACCAGCTGACTCCACATCAACTACTTGTGATCCTCTGCGTGCACTTCTCGATTTGTTTTTAGCCTGAGCAAAAGCAGAAGCAGTTGATTCAACAACATCATCATCATCTTCAATAGCAACCACATTGATCCTAGGAGGAGTAGCCACAATCTGAGGCACCGTTGGAGCTCGCCCCCCACTTGATAGTGGACTCAACCACTCAAAAAGTGTAACGGAGTCAAAAAATCTCTCATATCCAAAGTAGTGTAATCCATTGTAACCAGGTTTCATCAGAAAGCCTTTGGATTGTAATAATCCTTTCGTGTCCTTTCGTTTCTCTCACTCCACTCTGCAATCTACTTCATCGTCGACATCTTCTTGCGCATTTCAAAGGTTAGCTTAACTCTGTTGAAAGATGGCTTCTCGGGTGGTGAGGACTAGTATGAGACTTCGAAGGAGGGATGGTGTGACTCAAAACGAACACCAGGGAGATCAACAAGTGGCTGACCAAGCTCCAACGGTGCCTCAGATTGTGGCTACTCCTCCTAGGATCAATGTGGTTGCTATTGAAGATGATGATGATGTTGTTGAATCAACTGCTTCTGCTTTTGCTCAGGCTAAAAACAAATCGAGAAGTGCACGCAGAGGATCACAAGTAGTTGATGTGGAGTCAGCTGGTGCTAATAGATCCACAAGGCGTCGCTCTGATCAAACTAGTGTTGACTCAGTTGAGCTTAACAAGCCGAGAAAGTCCAAGGCTGTGGCTCCTCCTGTAGAGGAACCAAAATTTAGCTGTCCAATCTGTCTGTGTCCATTTACTCAGGAGGTTTCAACGAAATGTGGTCATATTTTCTGCAAAAAGTGCATAAAGAATGCGTTATCCCTCCAAGCTAAATGCCCGACATGTAGGAAAAAAATCACTGTTAAGGACCTTATCCGGGTCTTCCTTCCAACCACCAGATGAATGATACAGAAACATCACTAGTAGCCATGGATAGTGGTCTAGCGATTCTACCTCCAACGATGAAGAAATGTTGTTCATTAGTTGTAGTTTGTTATGTCAATATTGTTCTGTTTTGTAAGAGAAATATCTAGGAATTATGGAAGACCTGATTTTCTAATGGATATCGTTCATTGGTGATCTTC

SEQ ID NO: 2821 - DNA, 2056 bp, Arabidopsis thaliana
  misc_feature (1)..(2056): Ceres cDNA ID no. 14304349
  misc_feature (1)..(2056): Ceres CLONE  ID no. 1334352
  misc_feature (1)..(2056): Also known as  Ceres CDNA ID no. 23657234
actttttcgtctagatacattcttcgtgaagaaatccaagtgcacacattcattagtgttggacggacccattttattttggatttttttgtataattctttggggtttttttgttaataattcacttctgtctataatatgattatgattgttcatcatattttagctgtaatttcctctcttgaacaaaattattattttcgtgatgtttttaagtacgtgacgaaagatcatttggtgatctcactgacatgatttgcccagcctgtcaggtttacctatggtcaaatatcattttctcgattttgccccaaacggtcaaggcatatatccccaatcttcaaagggtatttatgtacttttcgctattaaccgtgtggctatatgaagccgattcctcataacaactacaaaaaaggaaagcttcttccctccggcaaattcttacgtttctccggcggttagaaaaatgacaccacagatcaaaactcatctcttgccgaagcaagaaccttcttcgtctgagaaccatggatcatcaacctccggcatcgttttcaacgtgtcaacgagtataatcggagccggaataatgtcgatgccggcggcgtttaaagttcttggaatagttccagcgtttttgattatcacgatcatagcttggctttccacaatttccgttggatttctgatgaaatcaactctcgccggagaatcaactacttacgccggagttatgaaagagtcgtttggtaaaacaggatccatcgctgtacagattgctacgatggttgctacttttggttgtatgattatattttcgattattataggagatgtgctttctggtaatgaaaatggtggtcctgaacatattggagttttgcaagaatggtttggttcttactggtggaacacgagaatcttcgctttgttatttgtctacggctttgtcttgcttccattggtcctgcgtagacgagtcgaaagactggcaattagttccgctgtatcgtttcttcttgcggttctatttgttgtcataagctcggtgctggcgatttccgcgctggtgaatggacaaacgaagaatccaagactgtttccggagttgagcaatggaggatcgttctggcaactcttcacagcttcccctgttatagttacagccttcacgtttcacttcaatgttcatccaattggattcgagctcaaagatccattacaagtgatcccagcaactaagatctctgtcatcttgtgtgctgctatctacttcgcaactggactctttggttaccttctctttggagatgcaactatgtcggatattctagtgaactttgaccagagctctggttcttccattggttctcttctcaacgacattgtcagactcagctacgtgcttcacctcatgctggtctttcctctcctgaacttctcattgagagcaaatctcgacgaactcttgtaccccaagaagccgtccttggaaaaagacacaaaaagattcatcggactcactctggctctactgatttgctgtttcttgtctgcaatcgctgtaccagacatttggtacttctttcagttcatgggatcaaccatcacagtctccatagcattcatatttccagccgccattgttctaaggaatatccatggtgtatcaacctcaagagagaagatcgtagctgcaataatgcttgttcttgctgttgccactagcattattgctatctcgacaaatttatacagcctcgcagcaaactagtcgttgaaaaaagttttgcaaacagtcccttccatgatcacttcaaagaaatctgtaaaattattagcttgccgtagcattcatatttatatctttgtgaaataggtttgtcagaaaatgcaatgtaatagctatacaaagtgcaatttttgttgctgcttgaaacagagaaagaggaaatgaacaactcttcaaaacttgtattctttaaattactttttgtagaccattatttgaatgaacaaagtacatctgtatcagactattcctttctttgg

SEQ ID NO: 2822 - protein, 2056 aa, Arabidopsis thaliana
  misc_feature: PFam Name: Aa_trans; PFam Description: Transmembrane amino
  misc_feature: GI Number: 42569800; NR Description: amino acid transporter
  misc_feature: GI Number: 51535770; NR Description: putative system A
  misc_feature: GI Number: 50905855; NR Description: putative amino acid transporter A1 [Oryza sativa (japonica cultivar-group)] >gi|46390972|dbj|BAD16485.1| putative amino acid transporter A1 [Oryza sativa (japonica cultivar-group)] [Oryza sativa (japonica
  misc_feature: GI Number: 15241555; NR Description: amino acid transporter
  misc_feature: GI Number: 9758059; NR Description: amino acid
ACTTTTTCGTCTAGATACATTCTTCGTGAAGAAATCCAAGTGCACACATTCATTAGTGTTGGACGGACCCATTTTATTTTGGATTTTTTTGTATAATTCTTTGGGGTTTTTTTGTTAATAATTCACTTCTGTCTATAATATGATTATGATTGTTCATCATATTTTAGCTGTAATTTCCTCTCTTGAACAAAATTATTATTTTCGTGATGTTTTTAAGTACGTGACGAAAGATCATTTGGTGATCTCACTGACATGATTTGCCCAGCCTGTCAGGTTTACCTATGGTCAAATATCATTTTCTCGATTTTGCCCCAAACGGTCAAGGCATATATCCCCAATCTTCAAAGGGTATTTATGTACTTTTCGCTATTAACCGTGTGGCTATATGAAGCCGATTCCTCATAACAACTACAAAAAAGGAAAGCTTCTTCCCTCCGGCAAATTCTTACGTTTCTCCGGCGGTTAGAAAAATGACACCACAGATCAAAACTCATCTCTTGCCGAAGCAAGAACCTTCTTCGTCTGAGAACCATGGATCATCAACCTCCGGCATCGTTTTCAACGTGTCAACGAGTATAATCGGAGCCGGAATAATGTCGATGCCGGCGGCGTTTAAAGTTCTTGGAATAGTTCCAGCGTTTTTGATTATCACGATCATAGCTTGGCTTTCCACAATTTCCGTTGGATTTCTGATGAAATCAACTCTCGCCGGAGAATCAACTACTTACGCCGGAGTTATGAAAGAGTCGTTTGGTAAAACAGGATCCATCGCTGTACAGATTGCTACGATGGTTGCTACTTTTGGTTGTATGATTATATTTTCGATTATTATAGGAGATGTGCTTTCTGGTAATGAAAATGGTGGTCCTGAACATATTGGAGTTTTGCAAGAATGGTTTGGTTCTTACTGGTGGAACACGAGAATCTTCGCTTTGTTATTTGTCTACGGCTTTGTCTTGCTTCCATTGGTCCTGCGTAGACGAGTCGAAAGACTGGCAATTAGTTCCGCTGTATCGTTTCTTCTTGCGGTTCTATTTGTTGTCATAAGCTCGGTGCTGGCGATTTCCGCGCTGGTGAATGGACAAACGAAGAATCCAAGACTGTTTCCGGAGTTGAGCAATGGAGGATCGTTCTGGCAACTCTTCACAGCTTCCCCTGTTATAGTTACAGCCTTCACGTTTCACTTCAATGTTCATCCAATTGGATTCGAGCTCAAAGATCCATTACAAGTGATCCCAGCAACTAAGATCTCTGTCATCTTGTGTGCTGCTATCTACTTCGCAACTGGACTCTTTGGTTACCTTCTCTTTGGAGATGCAACTATGTCGGATATTCTAGTGAACTTTGACCAGAGCTCTGGTTCTTCCATTGGTTCTCTTCTCAACGACATTGTCAGACTCAGCTACGTGCTTCACCTCATGCTGGTCTTTCCTCTCCTGAACTTCTCATTGAGAGCAAATCTCGACGAACTCTTGTACCCCAAGAAGCCGTCCTTGGAAAAAGACACAAAAAGATTCATCGGACTCACTCTGGCTCTACTGATTTGCTGTTTCTTGTCTGCAATCGCTGTACCAGACATTTGGTACTTCTTTCAGTTCATGGGATCAACCATCACAGTCTCCATAGCATTCATATTTCCAGCCGCCATTGTTCTAAGGAATATCCATGGTGTATCAACCTCAAGAGAGAAGATCGTAGCTGCAATAATGCTTGTTCTTGCTGTTGCCACTAGCATTATTGCTATCTCGACAAATTTATACAGCCTCGCAGCAAACTAGTCGTTGAAAAAAGTTTTGCAAACAGTCCCTTCCATGATCACTTCAAAGAAATCTGTAAAATTATTAGCTTGCCGTAGCATTCATATTTATATCTTTGTGAAATAGGTTTGTCAGAAAATGCAATGTAATAGCTATACAAAGTGCAATTTTTGTTGCTGCTTGAAACAGAGAAAGAGGAAATGAACAACTCTTCAAAACTTGTATTCTTTAAATTACTTTTTGTAGACCATTATTTGAATGAACAAAGTACATCTGTATCAGACTATTCCTTTCTTTGG

SEQ ID NO: 2823 - DNA, 1461 bp, Arabidopsis thaliana
  misc_feature (1)..(1461): Ceres cDNA ID no. 14307593
  misc_feature (1)..(1461): Ceres CLONE  ID no. 1338734
  misc_feature (1)..(1461): Also known as  Ceres CDNA ID no. 23486541
gccgaccaaacaatgacgatcgttaaaccgtcgcagttctcattctccggcggcggatcttcgccgttatgttcactcaaaagctcactcctcaccgtcgctattctcactttcatttccctcttctacctctctctcaattccttacgcacttcgccgccgtctcctgtcatcgtggtaacaccgattcatgttcctcataccttcgtgaatgagtataagactgataacgaaacaccgacgatggaagaagaaacctactccgatgtttatcactcaccggaggctttccgattgaattacgccgagatggagaagagattcaaggtttatatttatcccgacggcgatccaaatacgttttatcaaacgccgaggaaagtcaccggtaaatacgctagtgaggggtacttcttccagaacattagagagagtcgatttcgaaccctagatccagatgaagcagatctcttcttcattccaatctcttgtcacaagatgcgaggcaaaggaacatcatatgaaaatatgactgtgattgttcaaaactatgttgatggattgatagctaagtatccttattggaatagaactttaggagcagatcacttctttgttacatgtcatgatgttggtgttagagcatttgagggatctccgcttctgattaagaatactattagggttgtgtgctcacctagctacaatgttggtttcattcctcacaaagatgttgctttgcctcaagttcttcagccatttgctctccctgctggtggaaatgatgttgagaatcggacgactcttggtttttgggctggtcatcgaaattctaagatacgggttatacttgctcatgtgtgggaaaacgacacagagcttgatatttcaaacaacagaattaacagagctacagggcatttggtgtatcagaagagattctaccggactaaattctgcatatgccctggtggttctcaagtaaacagcgctcgcataacggactcgatccattacggatgtattcctgtcatattatcagactactacgacctccctttcaacgacatcctgaattggcgaaaatttgcggttgtactcagagagcaagatgtctataaccttaagcagatcctcaagaacatacctcactcagagtttgtttcgttgcataacaacttggtcaaggtgcagaagcattttcaatggaactcacctccagtcaaattcgacgcatttcacatgatcatgtatgaactatggttacgccaccatgtcgtcaagtactgatccaagactttttttttttgttttttttccttcttcaaccgcgtagatacggtcccaagccaaaaaaaagctagcatgtacacctcttgtaagttttaaatatcatagcttatgacagtaacacggaacatcaacatttcattctttgaggaaaattcattatttttgtgt

SEQ ID NO: 2824 - protein, 1461 aa, Arabidopsis thaliana
  misc_feature: PFam Name: Exostosin; PFam Description: Exostosin family
  misc_feature: GI Number: 51535578; NR Description: pectin-glucuronyltransferase-like [Oryza sativa (japonica
  misc_feature: GI Number: 50905787; NR Description: putative pectin-glucuronyltransferase [Oryza sativa (japonica cultivar-group)] >gi|46390046|dbj|BAD15422.1| putative pectin-glucuronyltransferase [Oryza sativa (japonica
  misc_feature: GI Number: 15237526; NR Description: exostosin family protein / pentatricopeptide (PPR) repeat-containing protein [Arabidopsis
  misc_feature: GI Number: 34911614; NR Description: limonene cyclase-like protein [Oryza sativa (japonica cultivar-group)] >gi|20805119|dbj|BAB92790.1| limonene cyclase-like protein [Oryza
  misc_feature: GI Number: 55297176; NR Description: pectin-glucuronyltransferase-like [Oryza sativa (japonica
GCCGACCAAACAATGACGATCGTTAAACCGTCGCAGTTCTCATTCTCCGGCGGCGGATCTTCGCCGTTATGTTCACTCAAAAGCTCACTCCTCACCGTCGCTATTCTCACTTTCATTTCCCTCTTCTACCTCTCTCTCAATTCCTTACGCACTTCGCCGCCGTCTCCTGTCATCGTGGTAACACCGATTCATGTTCCTCATACCTTCGTGAATGAGTATAAGACTGATAACGAAACACCGACGATGGAAGAAGAAACCTACTCCGATGTTTATCACTCACCGGAGGCTTTCCGATTGAATTACGCCGAGATGGAGAAGAGATTCAAGGTTTATATTTATCCCGACGGCGATCCAAATACGTTTTATCAAACGCCGAGGAAAGTCACCGGTAAATACGCTAGTGAGGGGTACTTCTTCCAGAACATTAGAGAGAGTCGATTTCGAACCCTAGATCCAGATGAAGCAGATCTCTTCTTCATTCCAATCTCTTGTCACAAGATGCGAGGCAAAGGAACATCATATGAAAATATGACTGTGATTGTTCAAAACTATGTTGATGGATTGATAGCTAAGTATCCTTATTGGAATAGAACTTTAGGAGCAGATCACTTCTTTGTTACATGTCATGATGTTGGTGTTAGAGCATTTGAGGGATCTCCGCTTCTGATTAAGAATACTATTAGGGTTGTGTGCTCACCTAGCTACAATGTTGGTTTCATTCCTCACAAAGATGTTGCTTTGCCTCAAGTTCTTCAGCCATTTGCTCTCCCTGCTGGTGGAAATGATGTTGAGAATCGGACGACTCTTGGTTTTTGGGCTGGTCATCGAAATTCTAAGATACGGGTTATACTTGCTCATGTGTGGGAAAACGACACAGAGCTTGATATTTCAAACAACAGAATTAACAGAGCTACAGGGCATTTGGTGTATCAGAAGAGATTCTACCGGACTAAATTCTGCATATGCCCTGGTGGTTCTCAAGTAAACAGCGCTCGCATAACGGACTCGATCCATTACGGATGTATTCCTGTCATATTATCAGACTACTACGACCTCCCTTTCAACGACATCCTGAATTGGCGAAAATTTGCGGTTGTACTCAGAGAGCAAGATGTCTATAACCTTAAGCAGATCCTCAAGAACATACCTCACTCAGAGTTTGTTTCGTTGCATAACAACTTGGTCAAGGTGCAGAAGCATTTTCAATGGAACTCACCTCCAGTCAAATTCGACGCATTTCACATGATCATGTATGAACTATGGTTACGCCACCATGTCGTCAAGTACTGATCCAAGACTTTTTTTTTTTGTTTTTTTTCCTTCTTCAACCGCGTAGATACGGTCCCAAGCCAAAAAAAAGCTAGCATGTACACCTCTTGTAAGTTTTAAATATCATAGCTTATGACAGTAACACGGAACATCAACATTTCATTCTTTGAGGAAAATTCATTATTTTTGTGT

SEQ ID NO: 2825 - DNA, 2791 bp, Arabidopsis thaliana
  misc_feature (1)..(2791): Ceres cDNA ID no. 14308948
  misc_feature (1)..(2791): Ceres CLONE  ID no. 1148967
  misc_feature (1)..(2791): Also known as  Ceres CDNA ID no. 23654348
aaaagaaacaacactcgaaaaagttcttctttttcttccgcacatgtctgactctctcataagcgtaaatcgctctgtcaaatatctctgaccagagagacagagttgcctccacgtttcttcagacaagactcacgctcttccctttcaccacattcccttctccatttctcaatctcacttaccttctcgattcttgctccaatttcgaatcttccgagtgaaaaaagcttcaaagtttggaactttctagtgtttattaatctgggtctgctctgagtttcgtgtgtagctgcatatgagcttaaagctcgagtttttccatctgggtttggaattctagggctagtgattggagattttgggaatttaggttgattttagtaggtttgacttcaggttgcgtaatttaggttgattttgatccgatttgtggaattagggtttgtttgttcacaaagcttcaatttttggagtttaaatggatcgataacgactgtgttagaagaaagtttgctgcttcagattcgtattcgatatagaaatgagtttggttcctcctttaccgattttatcaccaccgtcgtcaaattcttcaacaactgcacctcctccgttacagactcagcccaccactccatctgctccacctccggttacaccacctccttctccgccgcaatctccgccgccggttgtatcatcatcaccaccaccaccggttgtttcgtcacctccaccgtcttcttctccaccaccgtcacctcctgtcatcacttcacctcctcccaccgttgcttcttcccctccacctcctgtggtgattgcttcccctcctccctcaactccggcgacaacaccaccagctcctccgcaaactgtctcacctccaccgcctcctgatgcttctccatcacctcccgcaccaacaacaacaaatcctcctcctaaaccttctccttcaccgccgggagaaacaccttcaccaccgggagaaacaccttcaccgcctaaaccttctccgtcaactccaactccaacaacaaccacatctcctcctcctcctccagctacctctgcttctcctccgtcttcaaatcctactgatccttctacgttagctcctcctccaactccattacctgttgttcccagagagaaaccaattgctaaaccaactggaccagcttcaaacaatggaaacaacactttgccgtctagttcaccaggtaaaagcgaagttggtactggaggtattgtagctatcggagtgattgtgggattggtttttcttagcctttttgtgatgggtgtgtggttcactcggaaacgaaagcgaaaggaccctggaacctttgttggatacacaatgcctccttccgcttattcatctcctcaaggctcagatgtagtgctcttcaactcgcgttcttcagctcctcctaaaatgagaagccattctggtagcgattacatgtatgcgtcatctgattcaggcatggttagcaaccaaagatcaaggttttcatatgatgagttatctcaagttaccagtgggttctccgagaagaatcttctcggtgaaggagggtttggctgtgtatacaaaggcgttctttctgacggaagggaagtggcagttaaacagttaaagattggtggaagccaaggggagagagagttcaaagcagaagttgaaatcatttctcgggttcatcaccgccatttggttacactagttggttattgcatctcagagcaacataggttgcttgtatatgattatgtacctaacaacactctccattatcatctacatgctccaggaagaccagttatgacttgggaaactcgggtaagggtcgctgctggtgcagctcgtggaatcgcctacttacatgaagactgtcatccccgcattattcaccgtgacataaaatcttccaacatacttcttgataacagctttgaagccttggttgcggattttggacttgcaaaaattgcacaagaactggatttaaacacacacgtctcaacgcgcgtaatgggaacctttgggtacatggctcctgaatatgcaacaagtggaaagctgtctgaaaaagcagatgtttattcgtatggggtaatactgttggagcttataactggccgtaaaccggtagatacgtctcaaccacttggtgatgagagccttgttgaatgggcaagacccttgctgggtcaagcaatcgagaacgaagaattcgacgagctagtagatccgaggctagggaaaaacttcatcccaggagagatgttcagaatggtagaagctgcggctgcatgtgtccgccactcagctgcaaaaagaccaaagatgagtcaagtggtgagagctttggacacacttgaagaagcaacggacataaccaacggaatgagaccaggacagagccaagtgtttgactcgagacaacaatctgctcagataaggatgtttcaaagaatggcttttgggagtcaagattatagttctgacttctttgatcgctcacagtcacatagtagctggggcagtcgtgaccagtccagatttgtaccttagtagtttttattgcctttgcttctttcttctttccctttaaacatgtcctcgatcttgtatattcttttgcatgatataatgtatttttgaaatatacatacatacacacataaaatttggtagtcttttgaagaaaaagaataacagatgtatttgatagatagtggtccttgctttatctaatgattgctgaaccgggtt

SEQ ID NO: 2826 - protein, 2791 aa, Arabidopsis thaliana
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 15218591; NR Description: protein kinase family
  misc_feature: GI Number: 42562273; NR Description: protein kinase family
  misc_feature: GI Number: 57899154; NR Description: putative receptor
  misc_feature: GI Number: 57900576; NR Description: putative receptor protein kinase PERK1 [Oryza sativa (japonica cultivar-group)] gi|57899475|dbj|BAD86936.1| putative receptor protein kinase PERK1
  misc_feature: GI Number: 13447449; NR Description: receptor protein kinase
AAAAGAAACAACACTCGAAAAAGTTCTTCTTTTTCTTCCGCACATGTCTGACTCTCTCATAAGCGTAAATCGCTCTGTCAAATATCTCTGACCAGAGAGACAGAGTTGCCTCCACGTTTCTTCAGACAAGACTCACGCTCTTCCCTTTCACCACATTCCCTTCTCCATTTCTCAATCTCACTTACCTTCTCGATTCTTGCTCCAATTTCGAATCTTCCGAGTGAAAAAAGCTTCAAAGTTTGGAACTTTCTAGTGTTTATTAATCTGGGTCTGCTCTGAGTTTCGTGTGTAGCTGCATATGAGCTTAAAGCTCGAGTTTTTCCATCTGGGTTTGGAATTCTAGGGCTAGTGATTGGAGATTTTGGGAATTTAGGTTGATTTTAGTAGGTTTGACTTCAGGTTGCGTAATTTAGGTTGATTTTGATCCGATTTGTGGAATTAGGGTTTGTTTGTTCACAAAGCTTCAATTTTTGGAGTTTAAATGGATCGATAACGACTGTGTTAGAAGAAAGTTTGCTGCTTCAGATTCGTATTCGATATAGAAATGAGTTTGGTTCCTCCTTTACCGATTTTATCACCACCGTCGTCAAATTCTTCAACAACTGCACCTCCTCCGTTACAGACTCAGCCCACCACTCCATCTGCTCCACCTCCGGTTACACCACCTCCTTCTCCGCCGCAATCTCCGCCGCCGGTTGTATCATCATCACCACCACCACCGGTTGTTTCGTCACCTCCACCGTCTTCTTCTCCACCACCGTCACCTCCTGTCATCACTTCACCTCCTCCCACCGTTGCTTCTTCCCCTCCACCTCCTGTGGTGATTGCTTCCCCTCCTCCCTCAACTCCGGCGACAACACCACCAGCTCCTCCGCAAACTGTCTCACCTCCACCGCCTCCTGATGCTTCTCCATCACCTCCCGCACCAACAACAACAAATCCTCCTCCTAAACCTTCTCCTTCACCGCCGGGAGAAACACCTTCACCACCGGGAGAAACACCTTCACCGCCTAAACCTTCTCCGTCAACTCCAACTCCAACAACAACCACATCTCCTCCTCCTCCTCCAGCTACCTCTGCTTCTCCTCCGTCTTCAAATCCTACTGATCCTTCTACGTTAGCTCCTCCTCCAACTCCATTACCTGTTGTTCCCAGAGAGAAACCAATTGCTAAACCAACTGGACCAGCTTCAAACAATGGAAACAACACTTTGCCGTCTAGTTCACCAGGTAAAAGCGAAGTTGGTACTGGAGGTATTGTAGCTATCGGAGTGATTGTGGGATTGGTTTTTCTTAGCCTTTTTGTGATGGGTGTGTGGTTCACTCGGAAACGAAAGCGAAAGGACCCTGGAACCTTTGTTGGATACACAATGCCTCCTTCCGCTTATTCATCTCCTCAAGGCTCAGATGTAGTGCTCTTCAACTCGCGTTCTTCAGCTCCTCCTAAAATGAGAAGCCATTCTGGTAGCGATTACATGTATGCGTCATCTGATTCAGGCATGGTTAGCAACCAAAGATCAAGGTTTTCATATGATGAGTTATCTCAAGTTACCAGTGGGTTCTCCGAGAAGAATCTTCTCGGTGAAGGAGGGTTTGGCTGTGTATACAAAGGCGTTCTTTCTGACGGAAGGGAAGTGGCAGTTAAACAGTTAAAGATTGGTGGAAGCCAAGGGGAGAGAGAGTTCAAAGCAGAAGTTGAAATCATTTCTCGGGTTCATCACCGCCATTTGGTTACACTAGTTGGTTATTGCATCTCAGAGCAACATAGGTTGCTTGTATATGATTATGTACCTAACAACACTCTCCATTATCATCTACATGCTCCAGGAAGACCAGTTATGACTTGGGAAACTCGGGTAAGGGTCGCTGCTGGTGCAGCTCGTGGAATCGCCTACTTACATGAAGACTGTCATCCCCGCATTATTCACCGTGACATAAAATCTTCCAACATACTTCTTGATAACAGCTTTGAAGCCTTGGTTGCGGATTTTGGACTTGCAAAAATTGCACAAGAACTGGATTTAAACACACACGTCTCAACGCGCGTAATGGGAACCTTTGGGTACATGGCTCCTGAATATGCAACAAGTGGAAAGCTGTCTGAAAAAGCAGATGTTTATTCGTATGGGGTAATACTGTTGGAGCTTATAACTGGCCGTAAACCGGTAGATACGTCTCAACCACTTGGTGATGAGAGCCTTGTTGAATGGGCAAGACCCTTGCTGGGTCAAGCAATCGAGAACGAAGAATTCGACGAGCTAGTAGATCCGAGGCTAGGGAAAAACTTCATCCCAGGAGAGATGTTCAGAATGGTAGAAGCTGCGGCTGCATGTGTCCGCCACTCAGCTGCAAAAAGACCAAAGATGAGTCAAGTGGTGAGAGCTTTGGACACACTTGAAGAAGCAACGGACATAACCAACGGAATGAGACCAGGACAGAGCCAAGTGTTTGACTCGAGACAACAATCTGCTCAGATAAGGATGTTTCAAAGAATGGCTTTTGGGAGTCAAGATTATAGTTCTGACTTCTTTGATCGCTCACAGTCACATAGTAGCTGGGGCAGTCGTGACCAGTCCAGATTTGTACCTTAGTAGTTTTTATTGCCTTTGCTTCTTTCTTCTTTCCCTTTAAACATGTCCTCGATCTTGTATATTCTTTTGCATGATATAATGTATTTTTGAAATATACATACATACACACATAAAATTTGGTAGTCTTTTGAAGAAAAAGAATAACAGATGTATTTGATAGATAGTGGTCCTTGCTTTATCTAATGATTGCTGAACCGGGTT

SEQ ID NO: 2827 - DNA, 1629 bp, Arabidopsis thaliana
  misc_feature (1)..(1629): Ceres cDNA ID no. 14309798
  misc_feature (1)..(1629): Ceres CLONE  ID no. 1152436
  misc_feature (1)..(1629): Also known as  Ceres CDNA ID no. 23656162
aaaaccccctggtctggaggaaatagtaccagctaagctcgcagctcaaagctcagtgtttaataattgtatagcttttttggtgaacgaagagtcagatcggcgagcctgagatgggttggggttcggtgttgctattactggcggtggctcttctttgtcagagggcaagttcaatcggagctaactggggcacacaggcgtcgcacccacttccaccggacatagttgtgcggatgctaagagagaatggtattcagaaagtaaagctctttgacgccgaatacgacactctcagagctttgggcaaatccggaatcgaagtcatggttggtattcccaatgagatgcttgcgactctcgcctctagcctgaaagctgctgagaaatgggttgctaaaaatgtctctactcacatctccaccgacaacgtcaacatcagatatgtggctgttgggaatgaacctttcttgtctacttataatgggagctatctgagtactactttccctgcgttgaggaacatccaaattgcaattataaaggctggccttcagaaccaagtgaaggtcacttgtcccttgaacgctgatgtctatgacagctccaccacttttccttctggaggggacttcagggccaatatccgtgacctcatgatcactatcgtcaagttcttgagcgaaaatggcggtcctttcactgttaacatctacccttacatcagtctttacaccaaccccgatttcccagttgattacgccttctttgacggcaatgcacagcccctgaacgatggtgggactttttattacaacatgtttgatgcaaattacgacaccctagtccacgcgttggagaagaatgggtttggtaacatgcctatcattattggggaaattggttggcctactgatggagacagtaatgcgaatttggactacgctaagaagttcaaccaaggctttatggctcacatctcaggggggaaagggactccgaggagacctggccctatcgatgcatacctgttcagcttgatagacgaggacgccaagagtgttcagccaggatactttgagcgacactgggggatattcacatttgacggcttaccaaaatatgccttgaacctagggacaacgaacacaggagctctgatccaggccaaaggggtacgctacctagagaggaagtggtgtgtgatgaagccaaatgtgaggttggatgatccgcaggtagctccagccgtgagctacgcgtgtagccttggggactgtactagtcttggggttgggacgtcctgtgctaatcttgacgggaaacaaaacatatcgtatgcattcaacagttattatcagatacaggatcagcttgatacagcttgtaagttcccaaacatatcagaggtgaccaagacagatccatctactggaacttgcagatttccgattatgatagaaccttactacggtggggcagcccgggaacacgggttctttttcccactactgatggtggcagccatcgcagtctctattttttgatggtttcttcttgtcaatttgtaattctgtgtgatggcttgaactatttttttttcttcttgaattctgatttctcttcctt

SEQ ID NO: 2828 - protein, 1629 aa, Arabidopsis thaliana
  misc_feature: PFam Name: Glyco_hydro_17; PFam Description: Glycosyl
  misc_feature: PFam Name: X8; PFam Description: X8 domain
  misc_feature: GI Number: 7270016; NR Description: 1, 3-beta-glucanase-like protein [Arabidopsis thaliana] >gi|38257777|sp|Q9M088|E135_ARATH Putative glucan endo-1,3-beta-glucosidase 5 precursor ((1->3)-beta-glucan endohydrolase) ((1->3)-beta-glucanase)
  misc_feature: GI Number: 23308419; NR Description: At5g58090/k21l19_70 [Arabidopsis thaliana] >gi|16604491|gb|AAL24251.1|
  misc_feature: GI Number: 9759535; NR Description: glucanase; glucan endo-1,3-beta-glucosidase [Arabidopsis thaliana] >gi|38257732|sp|Q93Z08|E136_ARATH Putative glucan endo-1,3-beta-glucosidase 6 precursor ((1->3)-beta-glucan
  misc_feature: GI Number: 15242078; NR Description: glycosyl hydrolase
  misc_feature: GI Number: 50921029; NR Description: putative 1,3-beta-glucanase [Oryza sativa (japonica cultivar-group)] >gi|30017525|gb|AAP12947.1| putative 1,3-beta-glucanase [Oryza
AAAACCCCCTGGTCTGGAGGAAATAGTACCAGCTAAGCTCGCAGCTCAAAGCTCAGTGTTTAATAATTGTATAGCTTTTTTGGTGAACGAAGAGTCAGATCGGCGAGCCTGAGATGGGTTGGGGTTCGGTGTTGCTATTACTGGCGGTGGCTCTTCTTTGTCAGAGGGCAAGTTCAATCGGAGCTAACTGGGGCACACAGGCGTCGCACCCACTTCCACCGGACATAGTTGTGCGGATGCTAAGAGAGAATGGTATTCAGAAAGTAAAGCTCTTTGACGCCGAATACGACACTCTCAGAGCTTTGGGCAAATCCGGAATCGAAGTCATGGTTGGTATTCCCAATGAGATGCTTGCGACTCTCGCCTCTAGCCTGAAAGCTGCTGAGAAATGGGTTGCTAAAAATGTCTCTACTCACATCTCCACCGACAACGTCAACATCAGATATGTGGCTGTTGGGAATGAACCTTTCTTGTCTACTTATAATGGGAGCTATCTGAGTACTACTTTCCCTGCGTTGAGGAACATCCAAATTGCAATTATAAAGGCTGGCCTTCAGAACCAAGTGAAGGTCACTTGTCCCTTGAACGCTGATGTCTATGACAGCTCCACCACTTTTCCTTCTGGAGGGGACTTCAGGGCCAATATCCGTGACCTCATGATCACTATCGTCAAGTTCTTGAGCGAAAATGGCGGTCCTTTCACTGTTAACATCTACCCTTACATCAGTCTTTACACCAACCCCGATTTCCCAGTTGATTACGCCTTCTTTGACGGCAATGCACAGCCCCTGAACGATGGTGGGACTTTTTATTACAACATGTTTGATGCAAATTACGACACCCTAGTCCACGCGTTGGAGAAGAATGGGTTTGGTAACATGCCTATCATTATTGGGGAAATTGGTTGGCCTACTGATGGAGACAGTAATGCGAATTTGGACTACGCTAAGAAGTTCAACCAAGGCTTTATGGCTCACATCTCAGGGGGGAAAGGGACTCCGAGGAGACCTGGCCCTATCGATGCATACCTGTTCAGCTTGATAGACGAGGACGCCAAGAGTGTTCAGCCAGGATACTTTGAGCGACACTGGGGGATATTCACATTTGACGGCTTACCAAAATATGCCTTGAACCTAGGGACAACGAACACAGGAGCTCTGATCCAGGCCAAAGGGGTACGCTACCTAGAGAGGAAGTGGTGTGTGATGAAGCCAAATGTGAGGTTGGATGATCCGCAGGTAGCTCCAGCCGTGAGCTACGCGTGTAGCCTTGGGGACTGTACTAGTCTTGGGGTTGGGACGTCCTGTGCTAATCTTGACGGGAAACAAAACATATCGTATGCATTCAACAGTTATTATCAGATACAGGATCAGCTTGATACAGCTTGTAAGTTCCCAAACATATCAGAGGTGACCAAGACAGATCCATCTACTGGAACTTGCAGATTTCCGATTATGATAGAACCTTACTACGGTGGGGCAGCCCGGGAACACGGGTTCTTTTTCCCACTACTGATGGTGGCAGCCATCGCAGTCTCTATTTTTTGATGGTTTCTTCTTGTCAATTTGTAATTCTGTGTGATGGCTTGAACTATTTTTTTTTCTTCTTGAATTCTGATTTCTCTTCCTT

SEQ ID NO: 2829 - DNA, 2589 bp, Arabidopsis thaliana
  misc_feature (1)..(2589): Ceres cDNA ID no. 14310283
  misc_feature (1)..(2589): Ceres CLONE  ID no. 1202413
  misc_feature (1)..(2589): Also known as  Ceres CDNA ID no. 23655548
ggtgaatgtaaaaaacaagaaaaaaaataaaatttatttttctctctcgcttggttcaaccgtggttgttcatcggaaaaatatcttcggcttcaatttcgttcgatttaccctaaattctcgactagtgttcgtcaatcccacttccaattccacatttcaaaccttttcgggaagttgaaatcaaaagcatgaatgcttaaacagtttacgcattattgcgaaatgcaagccgagctgatacccgaaggtcctaacggtgagggccgtttatcaaaccagaacagcaaccctaatttactctcttctgcttctatcagtattactcagtttcctgctaagaagccgactaggcaatgggctgcttggacacatcaagaagaggaaagtttcttcactgctcttcgtcaagttggaaagaattttgagaagataacttctcgtgttcagagcaaaaacaaggaccaggtcaggcattactattatcgtttagtgaggcgtatgaacaaacttttgggcccggatctgagccttgatgccaagaacccaaaggacaccaatgctgcaatgctacgatggtggtctttgcttgaaaagtatagctgcaaagcttcaaaacttcatctcaagccccggagattcaaactatttatagaggccttggaacaccaattgctgaaagaccgcagaaagagcataagaaaacggacttgccagggagaaaatctctcttctgcttccctcggaaacacctcaagtcatagtagagaaagaggattggataaccgtccatttaaacttattctctccgacggccaaaatgttaaaaagctagggcctggaagagcatctaccaaacatggtgaaagcttaagtgtcaaccttggtgacgaaaaagaagacacagcctttgggagaggtggaaggcaacggcgaaaacaaggttatagaaaatgggaaaaagctgcaatagatggggtctctctggttgctgatgctgcagagcatttggaacgaacatcaattgacaaagatatggatgatcaaacagctggtgaagttcctctcagtgatgccaatatgcagttttctgccaagcttaaacttcagctgttcccgattgatgaatgtactcgaagatccttggaaatggataagcacaatccgcatcttgaacttactcttagtaatcgcaagaagatatcatctgtacttgaacatctcaatcgcaaatggggaagctcaagttgtgcgactggagagctattgctatttccttacaacgcacgaaaagaaactgtaacgtgccatcagaggtggacccatgactcttttctaagcgcagcagaagtgcattcaatggtcggaagtccttcggttttccgcttaaggtatggttggtttgtccatgatgcgtcaggttctattatttctcaagttccaacttcagatccttgcccttcactcgaggatgacatgaatgtggataggttgaacgaggtcaacatgctcctgggtgaatcaggacccttgtctgtgcattcaactgctgaacaaacgacatctgtagagcccagtcagggtctagtatgtgcatctggtgtccatgatcgtcccgcaagatctagagatgattatgaacctgcttcaacgagtattactccacttgagcatttgagcggcggtaatgcacaatcaccaggagaatgggctgatagtcttactaacataagtataggtgatctactttctgaagtgcccgatgacatagatagtgatggtgttgatccacctgccaccgaaggttcacattacctccttcgagatgtcccatttacctctgactcttttgatgctgcaattgctgctcatatactaagacaccagaacaagccaagtgctcaactaccgctgacttctggctcttcctctctgtgggatgatgaagaaacacgtgatgccttctctttccaaaaaaatcgtttcgcaaattccaccgagctggctagtgttgcttctcctaaaggtgttggcagagtaaatggagagccttcacagttggtggaggcttcatccggcgatgagggatcttataaccctcatgacgatggagatccaatggaagagggtccagcagaccctcatacgatggattctccagggaagaccccttgtggacttgcggatgtatactggcccgactcgttaggaccactggatttagacattagaacgtcaaagtatacagatgatttgatccttagtgagagcctcgggggattgagccgtctgatagcaaccagccttgatgcgtttcagaactgctcgctctttgggttcgacaataagaaggacaagtctaacatggtatgaaatggaaccaaagctaaagcatggggtccaaatgttgatagttgaaaaagaaagtgacttcttgccttttgaaaaaagaaacttttatcaccaactgatagcttcactgtacaaaaatttgatgtaaccttttactcttcctttcacacattcttttgtgttgatacatgtttctctgtgtacacttttactgttaatttacatgtttatttggct

SEQ ID NO: 2830 - protein, 2589 aa, Arabidopsis thaliana
  misc_feature: PFam Name: Myb_DNA-binding; PFam Description: Myb-like
  misc_feature: GI Number: 30686982; NR Description: myb family transcription
  misc_feature: GI Number: 22218300; NR Description: myb/SANT domain protein
  misc_feature: GI Number: 34913318; NR Description: putative myb/SANT domain protein [Oryza sativa (japonica cultivar-group)] >gi|22093830|dbj|BAC07117.1| putative myb/SANT domain protein
  misc_feature: GI Number: 34906224; NR Description: P0666G04.18 [Oryza sativa (japonica cultivar-group)] >gi|13122435|dbj|BAB32916.1|
GGTGAATGTAAAAAACAAGAAAAAAAATAAAATTTATTTTTCTCTCTCGCTTGGTTCAACCGTGGTTGTTCATCGGAAAAATATCTTCGGCTTCAATTTCGTTCGATTTACCCTAAATTCTCGACTAGTGTTCGTCAATCCCACTTCCAATTCCACATTTCAAACCTTTTCGGGAAGTTGAAATCAAAAGCATGAATGCTTAAACAGTTTACGCATTATTGCGAAATGCAAGCCGAGCTGATACCCGAAGGTCCTAACGGTGAGGGCCGTTTATCAAACCAGAACAGCAACCCTAATTTACTCTCTTCTGCTTCTATCAGTATTACTCAGTTTCCTGCTAAGAAGCCGACTAGGCAATGGGCTGCTTGGACACATCAAGAAGAGGAAAGTTTCTTCACTGCTCTTCGTCAAGTTGGAAAGAATTTTGAGAAGATAACTTCTCGTGTTCAGAGCAAAAACAAGGACCAGGTCAGGCATTACTATTATCGTTTAGTGAGGCGTATGAACAAACTTTTGGGCCCGGATCTGAGCCTTGATGCCAAGAACCCAAAGGACACCAATGCTGCAATGCTACGATGGTGGTCTTTGCTTGAAAAGTATAGCTGCAAAGCTTCAAAACTTCATCTCAAGCCCCGGAGATTCAAACTATTTATAGAGGCCTTGGAACACCAATTGCTGAAAGACCGCAGAAAGAGCATAAGAAAACGGACTTGCCAGGGAGAAAATCTCTCTTCTGCTTCCCTCGGAAACACCTCAAGTCATAGTAGAGAAAGAGGATTGGATAACCGTCCATTTAAACTTATTCTCTCCGACGGCCAAAATGTTAAAAAGCTAGGGCCTGGAAGAGCATCTACCAAACATGGTGAAAGCTTAAGTGTCAACCTTGGTGACGAAAAAGAAGACACAGCCTTTGGGAGAGGTGGAAGGCAACGGCGAAAACAAGGTTATAGAAAATGGGAAAAAGCTGCAATAGATGGGGTCTCTCTGGTTGCTGATGCTGCAGAGCATTTGGAACGAACATCAATTGACAAAGATATGGATGATCAAACAGCTGGTGAAGTTCCTCTCAGTGATGCCAATATGCAGTTTTCTGCCAAGCTTAAACTTCAGCTGTTCCCGATTGATGAATGTACTCGAAGATCCTTGGAAATGGATAAGCACAATCCGCATCTTGAACTTACTCTTAGTAATCGCAAGAAGATATCATCTGTACTTGAACATCTCAATCGCAAATGGGGAAGCTCAAGTTGTGCGACTGGAGAGCTATTGCTATTTCCTTACAACGCACGAAAAGAAACTGTAACGTGCCATCAGAGGTGGACCCATGACTCTTTTCTAAGCGCAGCAGAAGTGCATTCAATGGTCGGAAGTCCTTCGGTTTTCCGCTTAAGGTATGGTTGGTTTGTCCATGATGCGTCAGGTTCTATTATTTCTCAAGTTCCAACTTCAGATCCTTGCCCTTCACTCGAGGATGACATGAATGTGGATAGGTTGAACGAGGTCAACATGCTCCTGGGTGAATCAGGACCCTTGTCTGTGCATTCAACTGCTGAACAAACGACATCTGTAGAGCCCAGTCAGGGTCTAGTATGTGCATCTGGTGTCCATGATCGTCCCGCAAGATCTAGAGATGATTATGAACCTGCTTCAACGAGTATTACTCCACTTGAGCATTTGAGCGGCGGTAATGCACAATCACCAGGAGAATGGGCTGATAGTCTTACTAACATAAGTATAGGTGATCTACTTTCTGAAGTGCCCGATGACATAGATAGTGATGGTGTTGATCCACCTGCCACCGAAGGTTCACATTACCTCCTTCGAGATGTCCCATTTACCTCTGACTCTTTTGATGCTGCAATTGCTGCTCATATACTAAGACACCAGAACAAGCCAAGTGCTCAACTACCGCTGACTTCTGGCTCTTCCTCTCTGTGGGATGATGAAGAAACACGTGATGCCTTCTCTTTCCAAAAAAATCGTTTCGCAAATTCCACCGAGCTGGCTAGTGTTGCTTCTCCTAAAGGTGTTGGCAGAGTAAATGGAGAGCCTTCACAGTTGGTGGAGGCTTCATCCGGCGATGAGGGATCTTATAACCCTCATGACGATGGAGATCCAATGGAAGAGGGTCCAGCAGACCCTCATACGATGGATTCTCCAGGGAAGACCCCTTGTGGACTTGCGGATGTATACTGGCCCGACTCGTTAGGACCACTGGATTTAGACATTAGAACGTCAAAGTATACAGATGATTTGATCCTTAGTGAGAGCCTCGGGGGATTGAGCCGTCTGATAGCAACCAGCCTTGATGCGTTTCAGAACTGCTCGCTCTTTGGGTTCGACAATAAGAAGGACAAGTCTAACATGGTATGAAATGGAACCAAAGCTAAAGCATGGGGTCCAAATGTTGATAGTTGAAAAAGAAAGTGACTTCTTGCCTTTTGAAAAAAGAAACTTTTATCACCAACTGATAGCTTCACTGTACAAAAATTTGATGTAACCTTTTACTCTTCCTTTCACACATTCTTTTGTGTTGATACATGTTTCTCTGTGTACACTTTTACTGTTAATTTACATGTTTATTTGGCT

SEQ ID NO: 2831 - DNA, 1732 bp, Arabidopsis thaliana
  misc_feature (1)..(1732): Ceres cDNA ID no. 14312116
  misc_feature (1)..(1732): Ceres CLONE  ID no. 1353496
  misc_feature (1)..(1732): Also known as  Ceres CDNA ID no. 23657944
gaatatcttcctttgtcaatctcttgagagtttttgcttcctcgtcttcttcgattcatcaaacagcgtgtgttttttgtttagagttggaagagacgaatcgaattttgaagctttcttttatgtctgacaagatatctccgttttgttgtcaatctggttgcttggaaaacacagtcctacatccagaattaaggactactactagttcctccatcactttagggtctcgcatcttcaaaccggagatccctcctctttctctccacttttttagctaagaagaatggcgctgcagaacattggtgcttccaaccgtaacgatgccttctacaggtacaagatgcctaagatggttaccaaaaccgaaggcaaaggtaatggcattaagaccaacattatcaacaatgttgagattgccaaagccttggctagaccgccttcttatacgaccaagtactttggttgtgagcttggagcgcagtctaagtttgatgagaagactgggacgtcgcttgtgaatggagctcacaacacgtctaagcttgctgggcttttggagaattttattaagaagtttgttcagtgttatggatgtggtaacccggagactgagattattattacgaagacgcagatggtgaatctcaagtgtgctgcttgtgggtttatctctgaggtcgacatgagggataagttgactaatttcattctcaagaacccacctgagcagaagaaggtgtcaaaggataagaaagcaatgaggaaagctgagaaggagaggcttaaagaaggcgagctagctgatgaggagcagagaaagctgaaagctaagaagaaagcattgtctaacggcaaggattctaagacgtctaagaaccattcttctgatgaggatataagcccgaagcatgatgagaatgctctagaggtggatgaggatgaagatgatgatgatggtgtcgagtggcaaactgatacttcccgagaagctgctgagaaaagaatgatggaacagttgagtgctaaaactgccgaaatggtgatgctctctgcaatggaagtagaagagaaaaaggcgcccaaaagcaaatctaacgggaacgttgtgaaaactgagaatcctcctccgcaagagaagaatctcgtgcaggatatgaaagagtatctgaagaaagggtcaccaataagcgcgctcaaaagtttcatctcgtctctctctgaacctcctcaagacatcatggacgcactcttcaatgctctctttgatggtgtgggaaagggattcgccaaagaagtgactaagaagaagaattacttagcggctgctgcaacaatgcaagaggatggatcacagatgcatctgctcaattcgattgggacattctgtggaaagaatggaaacgaagaagctttgaaagaggtggctctggttcttaaagcattgtacgaccaagacatcattgaggaagaggtagtgttggattggtacgaaaagggtctcaccggagctgacaaaagctcgccggtttggaagaatgttaagccttttgtggagtggcttcagagcgctgagtctgagtccgaagaggaggattgagtcacttttttcttccctcctaacttttctttgcggcatttcttataatacttcgtcagttttcagaattcttaaatctttttgctgtgttcttataaagaaacatcatctattaaagttgtcttcgtttgg

SEQ ID NO: 2832 - protein, 1732 aa, Arabidopsis thaliana
  misc_feature: PFam Name: eIF-5_eIF-2B; PFam Description: Domain found in
  misc_feature: PFam Name: W2; PFam Description: eIF4-gamma/eIF5/eIF2-epsilon
  misc_feature: PFam Name: eIF-3c_N; PFam Description: Eukaryotic
  misc_feature: GI Number: 15810339; NR Description: putative eukaryotic
  misc_feature: GI Number: 21387159; NR Description: putative eukaryotic translation initiation factor 5 [Arabidopsis thaliana] >gi|17473619|gb|AAL38273.1| putative eukaryotic translation initiation factor 5 [Arabidopsis thaliana]
  misc_feature: GI Number: 20465815; NR Description: putative eukaryotic translation initiation factor 5 protein [Arabidopsis thaliana] >gi|17381210|gb|AAL36417.1| putative Eukaryotic translation initiation factor 5 [Arabidopsis thaliana] factor 5, putative
  misc_feature: GI Number: 53792080; NR Description: putative eukaryotic translation initiation factor 5 [Oryza sativa (japonica
  misc_feature: GI Number: 4160402; NR Description: eukaryotic translation
GAATATCTTCCTTTGTCAATCTCTTGAGAGTTTTTGCTTCCTCGTCTTCTTCGATTCATCAAACAGCGTGTGTTTTTTGTTTAGAGTTGGAAGAGACGAATCGAATTTTGAAGCTTTCTTTTATGTCTGACAAGATATCTCCGTTTTGTTGTCAATCTGGTTGCTTGGAAAACACAGTCCTACATCCAGAATTAAGGACTACTACTAGTTCCTCCATCACTTTAGGGTCTCGCATCTTCAAACCGGAGATCCCTCCTCTTTCTCTCCACTTTTTTAGCTAAGAAGAATGGCGCTGCAGAACATTGGTGCTTCCAACCGTAACGATGCCTTCTACAGGTACAAGATGCCTAAGATGGTTACCAAAACCGAAGGCAAAGGTAATGGCATTAAGACCAACATTATCAACAATGTTGAGATTGCCAAAGCCTTGGCTAGACCGCCTTCTTATACGACCAAGTACTTTGGTTGTGAGCTTGGAGCGCAGTCTAAGTTTGATGAGAAGACTGGGACGTCGCTTGTGAATGGAGCTCACAACACGTCTAAGCTTGCTGGGCTTTTGGAGAATTTTATTAAGAAGTTTGTTCAGTGTTATGGATGTGGTAACCCGGAGACTGAGATTATTATTACGAAGACGCAGATGGTGAATCTCAAGTGTGCTGCTTGTGGGTTTATCTCTGAGGTCGACATGAGGGATAAGTTGACTAATTTCATTCTCAAGAACCCACCTGAGCAGAAGAAGGTGTCAAAGGATAAGAAAGCAATGAGGAAAGCTGAGAAGGAGAGGCTTAAAGAAGGCGAGCTAGCTGATGAGGAGCAGAGAAAGCTGAAAGCTAAGAAGAAAGCATTGTCTAACGGCAAGGATTCTAAGACGTCTAAGAACCATTCTTCTGATGAGGATATAAGCCCGAAGCATGATGAGAATGCTCTAGAGGTGGATGAGGATGAAGATGATGATGATGGTGTCGAGTGGCAAACTGATACTTCCCGAGAAGCTGCTGAGAAAAGAATGATGGAACAGTTGAGTGCTAAAACTGCCGAAATGGTGATGCTCTCTGCAATGGAAGTAGAAGAGAAAAAGGCGCCCAAAAGCAAATCTAACGGGAACGTTGTGAAAACTGAGAATCCTCCTCCGCAAGAGAAGAATCTCGTGCAGGATATGAAAGAGTATCTGAAGAAAGGGTCACCAATAAGCGCGCTCAAAAGTTTCATCTCGTCTCTCTCTGAACCTCCTCAAGACATCATGGACGCACTCTTCAATGCTCTCTTTGATGGTGTGGGAAAGGGATTCGCCAAAGAAGTGACTAAGAAGAAGAATTACTTAGCGGCTGCTGCAACAATGCAAGAGGATGGATCACAGATGCATCTGCTCAATTCGATTGGGACATTCTGTGGAAAGAATGGAAACGAAGAAGCTTTGAAAGAGGTGGCTCTGGTTCTTAAAGCATTGTACGACCAAGACATCATTGAGGAAGAGGTAGTGTTGGATTGGTACGAAAAGGGTCTCACCGGAGCTGACAAAAGCTCGCCGGTTTGGAAGAATGTTAAGCCTTTTGTGGAGTGGCTTCAGAGCGCTGAGTCTGAGTCCGAAGAGGAGGATTGAGTCACTTTTTTCTTCCCTCCTAACTTTTCTTTGCGGCATTTCTTATAATACTTCGTCAGTTTTCAGAATTCTTAAATCTTTTTGCTGTGTTCTTATAAAGAAACATCATCTATTAAAGTTGTCTTCGTTTGG

SEQ ID NO: 2833 - DNA, 1788 bp, Arabidopsis thaliana
  misc_feature (1)..(1788): Ceres cDNA ID no. 14315390
  misc_feature (1)..(1788): Ceres CLONE  ID no. 1148659
  misc_feature (1)..(1788): Also known as  Ceres CDNA ID no. 23656245
gaaacgatcattttctaggaaaacgaacgaacagaggacaaatatattagataaacagagggaaacaagaacaaaaacgtttgcttcattctctaatggcagccaccacgagacggttgctttactctgtgtccaaaagattctctaccgccggagtgcggcggagctatggcggtctgccacaatcgaattccaaatctcctccgtcttcttctcaacgattgatggaattggaatctgaattcagtgcccacaattaccatcctgttccggttgtgttttctcgcgcgaatggctcaactatatgggaccctgaaggaaagagatacattgattttcttgcagcttactctgcagttaatcagggacattgtcatcctaagatcatgaaggcattgcaggaacaagtggagaagctcactttaagttcacgagcgttttacaacgataaattcccggtatttgctgagcgtctcacaaacatgttcggttatgatatggtgcttcctatgaacacgggtgctgaaggtgtcgaaaccgctttgaaactagcaagaaaatggggtcatgaaaagaaaaatattcccaaagacgaggctatcattgtctcttgttgtggctgctttcatggacgtacattagcaattgtttccatgagttgtgacaatgatgctactcgtggattcgggccattgttgccagggaatcttaaagttgattttggtgatgcggattcacttgagaaaatcattaaagaaaagggagatagaatagcgggatttctattcgagcctattcaaggcgaagctggagttattattcctcccgacggttacttgaaagctgttagagaactctgcacaaaatacaatgttttgatgatagcggatgaagtacaaagcggtctggctagatccgggaagatgctagcttgtgattgggaagaaattcgtcctgacatggtgatacttgggaaagcattaggtggaggagtaattccagtaagtgcagtgcttgctgataaagacgtgatgcttcatataaaacctggtcaacacggaagcacatttggtggtaaccctttagctagtgctgtagctatggcttctttagacgttatcgtggaagaaaaactcgttgaaagatcagcaagtcttggagaggaactgaggattcaattgaatgaaatcaagaaacagtttccgaagtacataaaggaagtacgaggaagaggcttgtttaatgcgattgagttcaatagcgaaagcttgtccccggtttcagcttacgatatttgcttgagcttgaaggagagaggagtcttggctaaacctactcacaacactattgtccggttaactccaccactctctataagctctgatgaactccgagaaggatctgaggctcttcacgatgtcctcgagctcgatcttccaaatctgctgaaaatcaattccggtaaaactccggtttctcatataaccgagtgtgatcgctgtggaagaaacctctatgcttgaaccggtttgaaacttgattaggttctggtataattagattctttgtatcttgtgatttccataggacacagcaccggtttggtataagaaatatattaaagtataaggccgaaccggattgtaccgagcttggtagaaataactctggtttatttctggtttggcattaaataaaaccaacataaaataatatgatgcctgttttcataggtgttatacatgatatctcaacaaacaaataaatgttacataacaatatgtatgg

SEQ ID NO: 2834 - protein, 1788 aa, Arabidopsis thaliana
  misc_feature: PFam Name: Aminotran_3; PFam Description: Aminotransferase
  misc_feature: GI Number: 9757738; NR Description: ornithine aminotransferase [Arabidopsis thaliana] >gi|15237392|ref|NP_199430.1| ornithine aminotransferase, putative / ornithine--oxo-acid aminotransferase, putative [Arabidopsis
  misc_feature: GI Number: 27527063; NR Description: ornithine
  misc_feature: GI Number: 9957234; NR Description: ornithine
  misc_feature: GI Number: 53749407; NR Description: ornithine--oxo-acid
  misc_feature: GI Number: 60465399; NR Description: ornithine-oxo-acid
GAAACGATCATTTTCTAGGAAAACGAACGAACAGAGGACAAATATATTAGATAAACAGAGGGAAACAAGAACAAAAACGTTTGCTTCATTCTCTAATGGCAGCCACCACGAGACGGTTGCTTTACTCTGTGTCCAAAAGATTCTCTACCGCCGGAGTGCGGCGGAGCTATGGCGGTCTGCCACAATCGAATTCCAAATCTCCTCCGTCTTCTTCTCAACGATTGATGGAATTGGAATCTGAATTCAGTGCCCACAATTACCATCCTGTTCCGGTTGTGTTTTCTCGCGCGAATGGCTCAACTATATGGGACCCTGAAGGAAAGAGATACATTGATTTTCTTGCAGCTTACTCTGCAGTTAATCAGGGACATTGTCATCCTAAGATCATGAAGGCATTGCAGGAACAAGTGGAGAAGCTCACTTTAAGTTCACGAGCGTTTTACAACGATAAATTCCCGGTATTTGCTGAGCGTCTCACAAACATGTTCGGTTATGATATGGTGCTTCCTATGAACACGGGTGCTGAAGGTGTCGAAACCGCTTTGAAACTAGCAAGAAAATGGGGTCATGAAAAGAAAAATATTCCCAAAGACGAGGCTATCATTGTCTCTTGTTGTGGCTGCTTTCATGGACGTACATTAGCAATTGTTTCCATGAGTTGTGACAATGATGCTACTCGTGGATTCGGGCCATTGTTGCCAGGGAATCTTAAAGTTGATTTTGGTGATGCGGATTCACTTGAGAAAATCATTAAAGAAAAGGGAGATAGAATAGCGGGATTTCTATTCGAGCCTATTCAAGGCGAAGCTGGAGTTATTATTCCTCCCGACGGTTACTTGAAAGCTGTTAGAGAACTCTGCACAAAATACAATGTTTTGATGATAGCGGATGAAGTACAAAGCGGTCTGGCTAGATCCGGGAAGATGCTAGCTTGTGATTGGGAAGAAATTCGTCCTGACATGGTGATACTTGGGAAAGCATTAGGTGGAGGAGTAATTCCAGTAAGTGCAGTGCTTGCTGATAAAGACGTGATGCTTCATATAAAACCTGGTCAACACGGAAGCACATTTGGTGGTAACCCTTTAGCTAGTGCTGTAGCTATGGCTTCTTTAGACGTTATCGTGGAAGAAAAACTCGTTGAAAGATCAGCAAGTCTTGGAGAGGAACTGAGGATTCAATTGAATGAAATCAAGAAACAGTTTCCGAAGTACATAAAGGAAGTACGAGGAAGAGGCTTGTTTAATGCGATTGAGTTCAATAGCGAAAGCTTGTCCCCGGTTTCAGCTTACGATATTTGCTTGAGCTTGAAGGAGAGAGGAGTCTTGGCTAAACCTACTCACAACACTATTGTCCGGTTAACTCCACCACTCTCTATAAGCTCTGATGAACTCCGAGAAGGATCTGAGGCTCTTCACGATGTCCTCGAGCTCGATCTTCCAAATCTGCTGAAAATCAATTCCGGTAAAACTCCGGTTTCTCATATAACCGAGTGTGATCGCTGTGGAAGAAACCTCTATGCTTGAACCGGTTTGAAACTTGATTAGGTTCTGGTATAATTAGATTCTTTGTATCTTGTGATTTCCATAGGACACAGCACCGGTTTGGTATAAGAAATATATTAAAGTATAAGGCCGAACCGGATTGTACCGAGCTTGGTAGAAATAACTCTGGTTTATTTCTGGTTTGGCATTAAATAAAACCAACATAAAATAATATGATGCCTGTTTTCATAGGTGTTATACATGATATCTCAACAAACAAATAAATGTTACATAACAATATGTATGG

SEQ ID NO: 2835 - DNA, 2117 bp, Arabidopsis thaliana
  misc_feature (1)..(2117): Ceres cDNA ID no. 15168619
  misc_feature (1)..(2117): Ceres CLONE  ID no. 1186388
  misc_feature (1)..(2117): Also known as  Ceres CDNA ID no. 23652321
gaaaaatactgaaacttggtggagcttttatcattcactcatcaatggtggctggaaggttcgtgtaacaatgggttttcacaaatcaccttctactaaaaaaactaaagacatgccttctcctttacctcttcctcctcctcctcctcctccacttaaaccgccttcttccggttccactactactaaaccaccgattaatcctagtaaaccgggtttcactcgctctttcggtgtttatttcccacgcgcttccgctcaggttcacgccactgctgctgctgcttctcataacggcgtcgtttctgagcttcgtcgtcaagtcgaggagcttcgtgagagagaagctctgttgaaaacagagaatctcgaggtcaagcttcttagagaatctgtttctgttattccgttgcttgaatcgcagatcgctgataagaacggcgaaatcgaggagcttaggaaagagacggcgagattagcggaggacaacgagagattacggcgggaaagcgaggagatgagaagagagagtgagagaagagagaaggaaatggaggcggagattgttgagcttcggaaacttgtttcgtcggagagtgacgaccacgcgctctctgtttctcagaggtttcagggtttaatggatgtgtcggcgaaatctaacctaatcagaagtttaaaacgtgtcgggtcgttgaggaatatacccgacccgattacgaatcaagagaataacaacaagagcatttcatcaaccggagacgcggacggcgacatttatcggaaagacgaaatcgagagttattcacggagtagtaactcggaggaactcactgagtcatcatctctctccaccgtcagatccagagttccgagagtccctaaaccaccgccgaaacggtctatttcattaggtgattccacggagaacagagcagatccgccaccgcagaaatcgattccgcctcctcctcctccacctccgccaccgcttcttcaacaaccaccacctcctccgtctgtttccaaagctcctcctccgcctcctccaccaccgccgccgaagagtttaagcattgcgtcggcgaaagtgagaagagtaccggaagtggttgagttttatcactcgttgatgcgaagagactccactaactcgaggagagattccaccggcggtggaaacgccgccgcggaagcaatacttgctaactccaacgccagagacatgatcggagaaatcgaaaaccgatcggtttatctcctcgcgataaaaaccgacgtagaaacgcaaggagatttcataaggttcttgatcaaagaagtcggaaacgctgcgttttcagacattgaagacgttgttcctttcgtcaaatggctcgacgacgaactctcttacctggttgatgagagagcagtgttgaaacatttcgagtggccggagcaaaaagctgatgctttacgtgaagcagcgttttgttatttcgatctaaagaaactcatatcagaagcttctcgtttccgggaagatcctcgtcaatcttctagctctgctcttaagaaaatgcaagctttgtttgaaaagttagagcatggtgtttatagtctttcgaggatgagagaatcggcggcaacaaaattcaagagtttccacattccggttgattggatgctcgaaaccggtattactagccagattaaactggcatccgtgaaactagcgatgaagtatatgaagagagtatccgcagagctagaggctattgaaggtggtggccctgaagaggaagagctaattgtccaaggtgttcgattcgcattccgtgttcatcagtttgccggaggatttgatgcagaaacaatgaaggcatttgaagagctaagagataaagcaagatcatgtcatgttcagtgtcaaagccaaacacatcaacataaactttgttttcgatctaccccttgttaaagaagcaatcttagcttcatatataatccacctcttgttgtcattttctcgatttaatttgtttttttgttctttcgtcttaaaagacctataactcttgtgaatatacgttctcgatcgtcttgctgaaaaaggattaaaacagttgatattc

SEQ ID NO: 2836 - protein, 2117 aa, Arabidopsis thaliana
  misc_feature: PFam Name: Extensin_2; PFam Description: Extensin-like region
  misc_feature: PFam Name: FH2; PFam Description: Formin Homology 2 Domain
  misc_feature: PFam Name: GATase_2; PFam Description: Glutamine
  misc_feature: PFam Name: LMBR1; PFam Description: LMBR1-like membrane protein
  misc_feature: PFam Name: Drf_FH1; PFam Description: Formin Homology Region 1
  misc_feature: GI Number: 22135814; NR Description: AT4g18560/F28J12_220 [Arabidopsis thaliana] >gi|28416477|gb|AAO42769.1| At4g18560/F28J12_220 [Arabidopsis thaliana] >gi|30684447|ref|NP_193591.2| proline-rich family protein
  misc_feature: GI Number: 34911862; NR Description: pherophorin - like protein [Oryza sativa (japonica cultivar-group)] >gi|19571144|dbj|BAB86567.1| pherophorin - like protein [Oryza
  misc_feature: GI Number: 50940793; NR Description: proline-rich protein family-like [Oryza sativa (japonica cultivar-group)] >gi|29467527|dbj|BAC66716.1| proline-rich protein family-like
  misc_feature: GI Number: 55297080; NR Description: pherophorin-like protein
  misc_feature: GI Number: 8778962; NR Description: F11A17.16 [Arabidopsis thaliana] >gi|25405258|pir||G96522 F11A17.16 [imported] - Arabidopsis thaliana >gi|18402131|ref|NP_564524.1| hydroxyproline-rich glycoprotein family protein [Arabidopsis
GAAAAATACTGAAACTTGGTGGAGCTTTTATCATTCACTCATCAATGGTGGCTGGAAGGTTCGTGTAACAATGGGTTTTCACAAATCACCTTCTACTAAAAAAACTAAAGACATGCCTTCTCCTTTACCTCTTCCTCCTCCTCCTCCTCCTCCACTTAAACCGCCTTCTTCCGGTTCCACTACTACTAAACCACCGATTAATCCTAGTAAACCGGGTTTCACTCGCTCTTTCGGTGTTTATTTCCCACGCGCTTCCGCTCAGGTTCACGCCACTGCTGCTGCTGCTTCTCATAACGGCGTCGTTTCTGAGCTTCGTCGTCAAGTCGAGGAGCTTCGTGAGAGAGAAGCTCTGTTGAAAACAGAGAATCTCGAGGTCAAGCTTCTTAGAGAATCTGTTTCTGTTATTCCGTTGCTTGAATCGCAGATCGCTGATAAGAACGGCGAAATCGAGGAGCTTAGGAAAGAGACGGCGAGATTAGCGGAGGACAACGAGAGATTACGGCGGGAAAGCGAGGAGATGAGAAGAGAGAGTGAGAGAAGAGAGAAGGAAATGGAGGCGGAGATTGTTGAGCTTCGGAAACTTGTTTCGTCGGAGAGTGACGACCACGCGCTCTCTGTTTCTCAGAGGTTTCAGGGTTTAATGGATGTGTCGGCGAAATCTAACCTAATCAGAAGTTTAAAACGTGTCGGGTCGTTGAGGAATATACCCGACCCGATTACGAATCAAGAGAATAACAACAAGAGCATTTCATCAACCGGAGACGCGGACGGCGACATTTATCGGAAAGACGAAATCGAGAGTTATTCACGGAGTAGTAACTCGGAGGAACTCACTGAGTCATCATCTCTCTCCACCGTCAGATCCAGAGTTCCGAGAGTCCCTAAACCACCGCCGAAACGGTCTATTTCATTAGGTGATTCCACGGAGAACAGAGCAGATCCGCCACCGCAGAAATCGATTCCGCCTCCTCCTCCTCCACCTCCGCCACCGCTTCTTCAACAACCACCACCTCCTCCGTCTGTTTCCAAAGCTCCTCCTCCGCCTCCTCCACCACCGCCGCCGAAGAGTTTAAGCATTGCGTCGGCGAAAGTGAGAAGAGTACCGGAAGTGGTTGAGTTTTATCACTCGTTGATGCGAAGAGACTCCACTAACTCGAGGAGAGATTCCACCGGCGGTGGAAACGCCGCCGCGGAAGCAATACTTGCTAACTCCAACGCCAGAGACATGATCGGAGAAATCGAAAACCGATCGGTTTATCTCCTCGCGATAAAAACCGACGTAGAAACGCAAGGAGATTTCATAAGGTTCTTGATCAAAGAAGTCGGAAACGCTGCGTTTTCAGACATTGAAGACGTTGTTCCTTTCGTCAAATGGCTCGACGACGAACTCTCTTACCTGGTTGATGAGAGAGCAGTGTTGAAACATTTCGAGTGGCCGGAGCAAAAAGCTGATGCTTTACGTGAAGCAGCGTTTTGTTATTTCGATCTAAAGAAACTCATATCAGAAGCTTCTCGTTTCCGGGAAGATCCTCGTCAATCTTCTAGCTCTGCTCTTAAGAAAATGCAAGCTTTGTTTGAAAAGTTAGAGCATGGTGTTTATAGTCTTTCGAGGATGAGAGAATCGGCGGCAACAAAATTCAAGAGTTTCCACATTCCGGTTGATTGGATGCTCGAAACCGGTATTACTAGCCAGATTAAACTGGCATCCGTGAAACTAGCGATGAAGTATATGAAGAGAGTATCCGCAGAGCTAGAGGCTATTGAAGGTGGTGGCCCTGAAGAGGAAGAGCTAATTGTCCAAGGTGTTCGATTCGCATTCCGTGTTCATCAGTTTGCCGGAGGATTTGATGCAGAAACAATGAAGGCATTTGAAGAGCTAAGAGATAAAGCAAGATCATGTCATGTTCAGTGTCAAAGCCAAACACATCAACATAAACTTTGTTTTCGATCTACCCCTTGTTAAAGAAGCAATCTTAGCTTCATATATAATCCACCTCTTGTTGTCATTTTCTCGATTTAATTTGTTTTTTTGTTCTTTCGTCTTAAAAGACCTATAACTCTTGTGAATATACGTTCTCGATCGTCTTGCTGAAAAAGGATTAAAACAGTTGATATTC

SEQ ID NO: 2837 - DNA, 1722 bp, Arabidopsis thaliana
  misc_feature (1)..(1722): Ceres cDNA ID no. 15168642
  misc_feature (1)..(1722): Ceres CLONE  ID no. 1202370
  misc_feature (1)..(1722): Also known as  Ceres CDNA ID no. 23655184
aatttcagttgcaaagtcttcgtcttcttcttccaccagagacaattccatcatcatcatcaatagacaagggaagaattcaatttcccctttctttattggcgcgaagatctttcacagaatcaatcaccaacgaaaaatcgagaatggatgtttgcttgagctattcatataatatggatgatgagattgctaagttcatcagaagagtgaatccaccaagggttgtgatcgataacgaagtctgcaaagatgttactgtcattaaggtggatagtgcgaataaacatgggatacttctggaggttgttcaagttttgactgagcttaatctgactattaagaaagcttatatctcctctgatggtggctggtttatggatgttttcaatgttactgatcaagatgggaacaaagttaccgatgaaattgttcttgaatatatccgtaaatctcttggtcctgatgagtcttcttgcttcagtccatcaatgagatcaaccattggggttaaacaatctgtcgactacactgtggttgagctaacaggaactgatagacccagtttgttgtctgagttatgtgctgttcttatggacctccaatgcaatgtggtaaacgctgaaatttggacacatagagcaaaagcagcagcggttttgcaagtgaccgatgaagaaacgtgctctgcaatcactgatccagagaggttgtccaaaatcaggaaacttcttggttatgtgcttacaggtggaagcagtggcagaagattccgtgaaccgaaaaccactgtttcttctgctcttaatgagactcacacggaccgtaagcttcatcaattgatgtttgcagatagagattatgatgaatgggagaacaatgtcgatgacgaggataaatgtgggagagaaattccagatgtggatgtctccaatttgcatgatttggattactccattgtgatgatcaagtgtaaagacagaccgaagcttcttttcgataccgtcttcactctgacagatatgaattatgtcgtttcacatgctagcattgacgctgaaggcccccaagcttatcaggaatactacataagacatacggatggatctcctgtcaaatccgaggcagaaagacagcgagtgatcaaatgtctaaaagcagctattcaaagaagagtctctgaggggttgaagcttgagctttgcacttcagatagagtcgggttactctcggatgtgactcgaatcttccgcgaaaacagtctcacagtaacaagagctgaagtgaaaacaaaaggagacaaagctcttaacacattctacgtgagggacgcttctggctaccaagttgataccaagaccatagaatccattagacaagtcatcggtcagacgatacttcaagtgaaaggcggaaacacagacgcgaaacggagtcctcaagattcaccaacagggtttcttttcggggttttcaagtcgagatcgttcgtcaatttcgggttgatcagatcttaaatcctgaaagagttgttacctctatttgtaaataaccatagtacattgtgtgaatatgtagataaagcttttaggaaagtaaagtttagattctttttacagggttttatagtatagattcttgtgtagtaagtaaatgttggttttttatatttggggttgtatataaaatggattcttcttgatttattgtttgttacccatc

SEQ ID NO: 2838 - protein, 1722 aa, Arabidopsis thaliana
  misc_feature: PFam Name: ACT; PFam Description: ACT domain
  misc_feature: GI Number: 22138098; NR Description: ACR4 [Arabidopsis thaliana] >gi|15221589|ref|NP_177067.1| ACT domain containing
  misc_feature: GI Number: 22138100; NR Description: ACR5 [Arabidopsis thaliana] >gi|25370626|pir||F84451 probable uridylyl transferase
  misc_feature: GI Number: 42572033; NR Description: ACT domain containing
  misc_feature: GI Number: 25370627; NR Description: protein F4N2.2 [imported] - Arabidopsis thaliana >gi|6730631|gb|AAF27052.1| F4N2.2
  misc_feature: GI Number: 50916533; NR Description: putative ACT domain containing protein, ACR4, with alternative splicing forms [Oryza sativa (japonica cultivar-group)] >gi|41469089|gb|AAS07063.1|
AATTTCAGTTGCAAAGTCTTCGTCTTCTTCTTCCACCAGAGACAATTCCATCATCATCATCAATAGACAAGGGAAGAATTCAATTTCCCCTTTCTTTATTGGCGCGAAGATCTTTCACAGAATCAATCACCAACGAAAAATCGAGAATGGATGTTTGCTTGAGCTATTCATATAATATGGATGATGAGATTGCTAAGTTCATCAGAAGAGTGAATCCACCAAGGGTTGTGATCGATAACGAAGTCTGCAAAGATGTTACTGTCATTAAGGTGGATAGTGCGAATAAACATGGGATACTTCTGGAGGTTGTTCAAGTTTTGACTGAGCTTAATCTGACTATTAAGAAAGCTTATATCTCCTCTGATGGTGGCTGGTTTATGGATGTTTTCAATGTTACTGATCAAGATGGGAACAAAGTTACCGATGAAATTGTTCTTGAATATATCCGTAAATCTCTTGGTCCTGATGAGTCTTCTTGCTTCAGTCCATCAATGAGATCAACCATTGGGGTTAAACAATCTGTCGACTACACTGTGGTTGAGCTAACAGGAACTGATAGACCCAGTTTGTTGTCTGAGTTATGTGCTGTTCTTATGGACCTCCAATGCAATGTGGTAAACGCTGAAATTTGGACACATAGAGCAAAAGCAGCAGCGGTTTTGCAAGTGACCGATGAAGAAACGTGCTCTGCAATCACTGATCCAGAGAGGTTGTCCAAAATCAGGAAACTTCTTGGTTATGTGCTTACAGGTGGAAGCAGTGGCAGAAGATTCCGTGAACCGAAAACCACTGTTTCTTCTGCTCTTAATGAGACTCACACGGACCGTAAGCTTCATCAATTGATGTTTGCAGATAGAGATTATGATGAATGGGAGAACAATGTCGATGACGAGGATAAATGTGGGAGAGAAATTCCAGATGTGGATGTCTCCAATTTGCATGATTTGGATTACTCCATTGTGATGATCAAGTGTAAAGACAGACCGAAGCTTCTTTTCGATACCGTCTTCACTCTGACAGATATGAATTATGTCGTTTCACATGCTAGCATTGACGCTGAAGGCCCCCAAGCTTATCAGGAATACTACATAAGACATACGGATGGATCTCCTGTCAAATCCGAGGCAGAAAGACAGCGAGTGATCAAATGTCTAAAAGCAGCTATTCAAAGAAGAGTCTCTGAGGGGTTGAAGCTTGAGCTTTGCACTTCAGATAGAGTCGGGTTACTCTCGGATGTGACTCGAATCTTCCGCGAAAACAGTCTCACAGTAACAAGAGCTGAAGTGAAAACAAAAGGAGACAAAGCTCTTAACACATTCTACGTGAGGGACGCTTCTGGCTACCAAGTTGATACCAAGACCATAGAATCCATTAGACAAGTCATCGGTCAGACGATACTTCAAGTGAAAGGCGGAAACACAGACGCGAAACGGAGTCCTCAAGATTCACCAACAGGGTTTCTTTTCGGGGTTTTCAAGTCGAGATCGTTCGTCAATTTCGGGTTGATCAGATCTTAAATCCTGAAAGAGTTGTTACCTCTATTTGTAAATAACCATAGTACATTGTGTGAATATGTAGATAAAGCTTTTAGGAAAGTAAAGTTTAGATTCTTTTTACAGGGTTTTATAGTATAGATTCTTGTGTAGTAAGTAAATGTTGGTTTTTTATATTTGGGGTTGTATATAAAATGGATTCTTCTTGATTTATTGTTTGTTACCCATC

SEQ ID NO: 2839 - DNA, 1232 bp, Arabidopsis thaliana
  misc_feature (1)..(1232): Ceres cDNA ID no. 15168779
  misc_feature (1)..(1232): Ceres CLONE  ID no. 1206137
  misc_feature (1)..(1232): Also known as  Ceres CDNA ID no. 23655648
ggcgtacgtcaatttgtagaagcaatctcactttttccctttctctgtacatcatcatccttcaagctcggagctctctcttcccgccggcgatctcctccgcttctctccgattttaagtcgatcgaatggggaaaatcaagaaagtgaatcaaaggggtcatattgctacaccgtatccatcaccatgttgtaagaaagaatgggctggctcaacctgtccagtatgcttggagtctccacacaatgcggttcttctcctgtgttcgtcttatcacaaaggatgccgtccttacatgtgtgctacaaacagccgttttgccaactgccttgatcaatacaggaaatcctacggtaacgaaaactcaggacaacccgagcttttgtgtccactgtgtagaggtcaagtgaaaggctggactgttgtgaaagatgctcggatgcattttaactccaagagaaggacttgtatgcaggataactgttcctttttaggaaatttccgaaagctcaagaaacacatgaaggaaaaacacccacatgcttgcccaagagccattgatccagctttagaaactaaatggaagaggcttgagagggaaagagacagaagagacgtgataagcacgataatgtcatcgacaccaggtgctgttgtgttgggagattatgtgatagagccgcataaccgaggtgtttatgatgaagaagacgaagaagaagattacagctcagatgactctctaagcaacgggatactggatctagaatcatcatggcaaggacaaagccatcatattcggtttcttgatatggaatcaagtgacttcgcatcctcttccagctcccctgcttctccaagccgttcgcttcaccgtttgctctttccaaggaaccagagaggcggcaatagaggagcagtataaaaaggctaacatgactagccaattagccatacacagggaattggaaaaaaaaaactcgcagtcgtccctttcttttatttattttcatgtaaattattgtattctgtgtaattgtattattgtttctgcattgttgtactttaatgaggaatgatctcttatgcctcatttcataatttctcttttatttccactttttttcctctgtatagatatgatcttcatcttcctcaagttctggaagaacaataaaaaggttatgtgaaaagaaaagaaaagaaaaaaagcttttctcacttcttaacg

SEQ ID NO: 2840 - protein, 1232 aa, Arabidopsis thaliana
  misc_feature: GI Number: 34912600; NR Description: P0046B10.17 [Oryza sativa (japonica cultivar-group)] >gi|11034559|dbj|BAB17083.1| P0410E01.4 [Oryza sativa (japonica cultivar-group)] >gi|21104687|dbj|BAB93277.1| P0046B10.17 [Oryza sativa (japonica
  misc_feature: GI Number: 5103842; NR Description: F9L1.39 [Arabidopsis thaliana]
GGCGTACGTCAATTTGTAGAAGCAATCTCACTTTTTCCCTTTCTCTGTACATCATCATCCTTCAAGCTCGGAGCTCTCTCTTCCCGCCGGCGATCTCCTCCGCTTCTCTCCGATTTTAAGTCGATCGAATGGGGAAAATCAAGAAAGTGAATCAAAGGGGTCATATTGCTACACCGTATCCATCACCATGTTGTAAGAAAGAATGGGCTGGCTCAACCTGTCCAGTATGCTTGGAGTCTCCACACAATGCGGTTCTTCTCCTGTGTTCGTCTTATCACAAAGGATGCCGTCCTTACATGTGTGCTACAAACAGCCGTTTTGCCAACTGCCTTGATCAATACAGGAAATCCTACGGTAACGAAAACTCAGGACAACCCGAGCTTTTGTGTCCACTGTGTAGAGGTCAAGTGAAAGGCTGGACTGTTGTGAAAGATGCTCGGATGCATTTTAACTCCAAGAGAAGGACTTGTATGCAGGATAACTGTTCCTTTTTAGGAAATTTCCGAAAGCTCAAGAAACACATGAAGGAAAAACACCCACATGCTTGCCCAAGAGCCATTGATCCAGCTTTAGAAACTAAATGGAAGAGGCTTGAGAGGGAAAGAGACAGAAGAGACGTGATAAGCACGATAATGTCATCGACACCAGGTGCTGTTGTGTTGGGAGATTATGTGATAGAGCCGCATAACCGAGGTGTTTATGATGAAGAAGACGAAGAAGAAGATTACAGCTCAGATGACTCTCTAAGCAACGGGATACTGGATCTAGAATCATCATGGCAAGGACAAAGCCATCATATTCGGTTTCTTGATATGGAATCAAGTGACTTCGCATCCTCTTCCAGCTCCCCTGCTTCTCCAAGCCGTTCGCTTCACCGTTTGCTCTTTCCAAGGAACCAGAGAGGCGGCAATAGAGGAGCAGTATAAAAAGGCTAACATGACTAGCCAATTAGCCATACACAGGGAATTGGAAAAAAAAAACTCGCAGTCGTCCCTTTCTTTTATTTATTTTCATGTAAATTATTGTATTCTGTGTAATTGTATTATTGTTTCTGCATTGTTGTACTTTAATGAGGAATGATCTCTTATGCCTCATTTCATAATTTCTCTTTTATTTCCACTTTTTTTCCTCTGTATAGATATGATCTTCATCTTCCTCAAGTTCTGGAAGAACAATAAAAAGGTTATGTGAAAAGAAAAGAAAAGAAAAAAAGCTTTTCTCACTTCTTAACG

SEQ ID NO: 2841 - DNA, 1818 bp, Arabidopsis thaliana
  misc_feature (1)..(1818): Ceres cDNA ID no. 15168825
  misc_feature (1)..(1818): Ceres CLONE  ID no. 1207929
  misc_feature (1)..(1818): Also known as  Ceres CDNA ID no. 23655076
gtctcactccgatccgatcatggctttcgctgtctcggttcagtcacatttcgcaatcagagcgttaaaacgagaccacttcaagaacccttctcctcgtactttctgctcgtgttttaaatcgaggcctgactcgtcttaccttagtttaaaggaacgtacttgcttcgtttccaaaccgggtttagtcactactagatacagacatatattccaggtcggagctgagacgggaggagagttcgccgacagtggagaagtagctgattcgcttgcttctgatgcaccagagtcattttcttggtcttctgtgatactcccgtttatcttcccggctttgggaggattattgtttgggtatgacattggggctacctccggtgctacgctctcacttcagtcacctgcgcttagcggaactacatggtttaacttctcacctgttcagctaggacttgtggttagcggatccttgtatggagcccttcttggctcaatttctgtctatggcgttgctgatttccttggaagaaggcgggaacttattatagctgctgttctctatctcctcgggtctctgatcactggctgtgcccctgatcttaatattctcttagttggaaggcttctctatggctttggtattggtttggcaatgcatggggctcccctctatattgctgagacatgcccatctcaaatccgtggaactttgatatctctgaaagaactcttcatcgtattgggaattttgttgggtttttctgttggaagcttccagattgatgtagttggagggtggcgttacatgtatggatttggtacgcctgttgctttgctgatgggactaggcatgtggagtctccctgcatctcctcgctggttgctgcttagagctgtccaaggtaaaggacaattacaagaatacaaagagaaggccatgcttgccctcagcaaattacgtggcagacctccaggtgataaaatctcaagaagttggtagatgatgcctatttatctgtgaaaacggcctatgaagatgagaaatctgggggaaacttcctggaagtattccaagggcctaatttgaaagctttgacaattggtggaggtttagtcctcttccaacagataactggacagcctagtgttctttattatgcgggttcgattcttcagactgctggattctctgctgctgctgatgcaactcgagtctctgttattattggtgttttcaagttactgatgacatgggtagctgttgcgaaagttgatgatctcggcagacgacctttactgattggaggtgtcagcggcattgcgttgtccttgtttctactgtcagcatactacaagtttctcggaggctttccccttgtcgctgttggtgcactgcttctctatgttggttgttaccagatctcatttggacccatcagctggctaatggtgtcagagattttcccgctccgcacaagagggagagggatcagtcttgcagttcttacaaactttggctccaatgctattgtgacatttgcattttcacctttaaaggaatttcttggagccgagaatcttttccttctctttgggggcatagcactggtatcactgctgtttgtaatactagtagttccagagaccaagggtctcagcttggaagaaattgaatcaaaaatcttgaagtgaaacgttgaagaacatatttgttatagttgattctggtgaaatacatgtatgaggatgtgactattctctttgtaacataatatgtttcgtaatcaatgggaaaaccaaacctttttcatgatt

SEQ ID NO: 2842 - protein, 1818 aa, Arabidopsis thaliana
  misc_feature: PFam Name: Sugar_tr; PFam Description: Sugar (and other)
  misc_feature: PFam Name: MFS_1; PFam Description: Major Facilitator Superfamily
  misc_feature: GI Number: 50897170; NR Description: At5g17010 [Arabidopsis thaliana] >gi|42570524|ref|NP_850835.2| sugar transporter family
  misc_feature: GI Number: 37537174; NR Description: putative sugar transporter protein [Oryza sativa (japonica cultivar-group)] >gi|12039393|gb|AAG46179.1| putative sugar transporter protein [Oryza sativa] >gi|31433692|gb|AAP55176.1| putative sugar
  misc_feature: GI Number: 34897404; NR Description: putative sugar transporter protein [Oryza sativa (japonica cultivar-group)] >gi|27545039|gb|AAO18445.1| putative sugar transporter protein
  misc_feature: GI Number: 9755702; NR Description: sugar transporter-like protein [Arabidopsis thaliana] >gi|11358865|pir||T51556 sugar transporter-like protein - Arabidopsis thaliana >gi|30686158|ref|NP_850836.1| sugar transporter family protein
  misc_feature: GI Number: 29653696; NR Description: d-xylose-proton symporter, putative [Coxiella burnetii RSA 493] >gi|29540959|gb|AAO89902.1| d-xylose-proton symporter, putative
GTCTCACTCCGATCCGATCATGGCTTTCGCTGTCTCGGTTCAGTCACATTTCGCAATCAGAGCGTTAAAACGAGACCACTTCAAGAACCCTTCTCCTCGTACTTTCTGCTCGTGTTTTAAATCGAGGCCTGACTCGTCTTACCTTAGTTTAAAGGAACGTACTTGCTTCGTTTCCAAACCGGGTTTAGTCACTACTAGATACAGACATATATTCCAGGTCGGAGCTGAGACGGGAGGAGAGTTCGCCGACAGTGGAGAAGTAGCTGATTCGCTTGCTTCTGATGCACCAGAGTCATTTTCTTGGTCTTCTGTGATACTCCCGTTTATCTTCCCGGCTTTGGGAGGATTATTGTTTGGGTATGACATTGGGGCTACCTCCGGTGCTACGCTCTCACTTCAGTCACCTGCGCTTAGCGGAACTACATGGTTTAACTTCTCACCTGTTCAGCTAGGACTTGTGGTTAGCGGATCCTTGTATGGAGCCCTTCTTGGCTCAATTTCTGTCTATGGCGTTGCTGATTTCCTTGGAAGAAGGCGGGAACTTATTATAGCTGCTGTTCTCTATCTCCTCGGGTCTCTGATCACTGGCTGTGCCCCTGATCTTAATATTCTCTTAGTTGGAAGGCTTCTCTATGGCTTTGGTATTGGTTTGGCAATGCATGGGGCTCCCCTCTATATTGCTGAGACATGCCCATCTCAAATCCGTGGAACTTTGATATCTCTGAAAGAACTCTTCATCGTATTGGGAATTTTGTTGGGTTTTTCTGTTGGAAGCTTCCAGATTGATGTAGTTGGAGGGTGGCGTTACATGTATGGATTTGGTACGCCTGTTGCTTTGCTGATGGGACTAGGCATGTGGAGTCTCCCTGCATCTCCTCGCTGGTTGCTGCTTAGAGCTGTCCAAGGTAAAGGACAATTACAAGAATACAAAGAGAAGGCCATGCTTGCCCTCAGCAAATTACGTGGCAGACCTCCAGGTGATAAAATCTCAAGAAGTTGGTAGATGATGCCTATTTATCTGTGAAAACGGCCTATGAAGATGAGAAATCTGGGGGAAACTTCCTGGAAGTATTCCAAGGGCCTAATTTGAAAGCTTTGACAATTGGTGGAGGTTTAGTCCTCTTCCAACAGATAACTGGACAGCCTAGTGTTCTTTATTATGCGGGTTCGATTCTTCAGACTGCTGGATTCTCTGCTGCTGCTGATGCAACTCGAGTCTCTGTTATTATTGGTGTTTTCAAGTTACTGATGACATGGGTAGCTGTTGCGAAAGTTGATGATCTCGGCAGACGACCTTTACTGATTGGAGGTGTCAGCGGCATTGCGTTGTCCTTGTTTCTACTGTCAGCATACTACAAGTTTCTCGGAGGCTTTCCCCTTGTCGCTGTTGGTGCACTGCTTCTCTATGTTGGTTGTTACCAGATCTCATTTGGACCCATCAGCTGGCTAATGGTGTCAGAGATTTTCCCGCTCCGCACAAGAGGGAGAGGGATCAGTCTTGCAGTTCTTACAAACTTTGGCTCCAATGCTATTGTGACATTTGCATTTTCACCTTTAAAGGAATTTCTTGGAGCCGAGAATCTTTTCCTTCTCTTTGGGGGCATAGCACTGGTATCACTGCTGTTTGTAATACTAGTAGTTCCAGAGACCAAGGGTCTCAGCTTGGAAGAAATTGAATCAAAAATCTTGAAGTGAAACGTTGAAGAACATATTTGTTATAGTTGATTCTGGTGAAATACATGTATGAGGATGTGACTATTCTCTTTGTAACATAATATGTTTCGTAATCAATGGGAAAACCAAACCTTTTTCATGATT

SEQ ID NO: 2843 - DNA, 2368 bp, Arabidopsis thaliana
  misc_feature (1)..(2368): Ceres cDNA ID no. 15176027
  misc_feature (1)..(2368): Ceres CLONE  ID no. 1189286
  misc_feature (1)..(2368): Also known as  Ceres CDNA ID no. 23652505
gacctttttcacttccttctcactgatcgtcgaacaataagaccgtcgcatctcccagttatggctatggccggagaatcttccggcaaaaaaattggagactgtgacggtaaagtcgcggggaacagacagcgaaaggtgggtcttatttacgacgagacgatgtgcaaacacgacacacctgacggcgaggatcaccctgagtgtcccgaccgcatcagagttatctgggagaagcttcagctcgccggagtttctcaaagatgtgtggttcttggtagtagcaaagcagaagataagcatctccaattggttcacacaaaggaccatgttaatttagttaagagtattagcacaaaacagaaagattatcggagaaacaggattgcttcacagttgaattcgatttatctgaatggaggttcatctgaagccgcatatcttgcagctggttctgttgtaaagttggcagaaaaagttgcagaaggagagttagattgtggttttgctattgtcaggcccccagggcaccatgctgaggcagatgaagccatgggtttttgtttattcaacaatgttgccgttgctgctagttttttactaaacgaaagaccggatctaggggtcaagaaaattctgatcgttgattgggatgtccatcacggaaatggtacccagaagatgttttggaaagatcctcgtgtactatttttctctgttcataggcatgagtatgggggtttctatccagcgggtgatgatggcgattataacatggttggggaaggtccaggtgaagggtttaacataaatgttccatgggatcaaggacgatgtggagatgcagattatcttgctgcatgggaccatatcttgattcctgtggcgagggaatttaacccggatgttatttttctttcagctggatttgatgcagctattaatgatccgctagggggttgttgtgtgaccccatatggatattcagttatgttgaagaagctgatggagtttgcacaaggaaagatagtgctggcgttagagggagggtacaatcttgactcaattgcaaagtcttcacttgcatgtgtccaagttttgcttgaagacaaacaaattcaaggacctccggaagcatacccattcgagtcgacatggcgtgtcatacaagcggtgcgcaagaggctatgcacatattggccttcacttgcagatgaattatcgtggaagctaattaatcagaaaactcctactccaatcatccttatctcaagctccgactctgaaactgaagacaacgcccaaggactcctggatcaaatgtcgaaactcagcattgaaaaccctcaaggtacactacttgaaaaccaccaagtagaacctgcatctacatcttggagagctgatctcgcaaaggttgacgtttggtatgcctcttttggatccaacatgtggaaaccaaggtttctttgctatattcaagggggacaggtcgatggattgaaaaaggtatgtgttggctcaatggataaaagtccaccaaaggaaacagtgtgggaaacatttccacatagattgttctttggccgtgaatcttcagttggttggggtgtaggaggagttgctttcaccaacccccttgctaatctcattgatcaaactcacatgtgtttgtaccgtatcacgcttgagcagttcaatgacgttctgtctcaagaaaatggtttgaatgtggattcagattctccggtctttgatctagctgctttgcagttagtagataacaaaggatccattttagaagctcctttgaatagttggtatggaaatgttgtctgcttgggaaaagaacgcgacattcctatacttacaatgacttgcacgctttccgctgttgagaaattcaaatccggtgagatccctataagacctcctgcaaaagcttatgccaacactttaataaggggacttgtggaaggaggaagattatctaaagaagaagctgaggcttacatagacaaggctgtgtctaaacctctctagtgtataattatttactcagaaaccgcccgtttgaacacgatttggagcttcgggtttctgagttattcaattaggataaaaaccacaagtttaggaatattgtgagacctttgaatttgtcttttgaaagagaggactgtgtcctctgttagctgtgttgtgcttgctccctaagcaaactctcaatgtattttagttatcttcgggttttaggctttaccaagaagctgtattcggtaaatgtattaaagaatcctccaaactgctttatattgaccggagagaaacattcttattcttcggaatggtactttgaagtttgaag

SEQ ID NO: 2844 - protein, 2368 aa, Arabidopsis thaliana
  misc_feature: PFam Name: Hist_deacetyl; PFam Description: Histone
  misc_feature: GI Number: 32968028; NR Description: HDA1 [Zea mays]
  misc_feature: GI Number: 21105769; NR Description: HDA18 [Arabidopsis thaliana] >gi|22327996|ref|NP_200915.2| histone deacetylase family
  misc_feature: GI Number: 23197730; NR Description: histone deacetylase-like protein [Arabidopsis thaliana] >gi|20259320|gb|AAM13986.1| putative histone deacetylase [Arabidopsis thaliana] >gi|21539579|gb|AAM53342.1| histone deacetylase-like protein
  misc_feature: GI Number: 50939065; NR Description: putative histone deacetylase [Oryza sativa (japonica cultivar-group)] >gi|34394912|dbj|BAC84464.1| putative histone deacetylase [Oryza
  misc_feature: GI Number: 34933421; NR Description: histone deacetylase 6
GACCTTTTTCACTTCCTTCTCACTGATCGTCGAACAATAAGACCGTCGCATCTCCCAGTTATGGCTATGGCCGGAGAATCTTCCGGCAAAAAAATTGGAGACTGTGACGGTAAAGTCGCGGGGAACAGACAGCGAAAGGTGGGTCTTATTTACGACGAGACGATGTGCAAACACGACACACCTGACGGCGAGGATCACCCTGAGTGTCCCGACCGCATCAGAGTTATCTGGGAGAAGCTTCAGCTCGCCGGAGTTTCTCAAAGATGTGTGGTTCTTGGTAGTAGCAAAGCAGAAGATAAGCATCTCCAATTGGTTCACACAAAGGACCATGTTAATTTAGTTAAGAGTATTAGCACAAAACAGAAAGATTATCGGAGAAACAGGATTGCTTCACAGTTGAATTCGATTTATCTGAATGGAGGTTCATCTGAAGCCGCATATCTTGCAGCTGGTTCTGTTGTAAAGTTGGCAGAAAAAGTTGCAGAAGGAGAGTTAGATTGTGGTTTTGCTATTGTCAGGCCCCCAGGGCACCATGCTGAGGCAGATGAAGCCATGGGTTTTTGTTTATTCAACAATGTTGCCGTTGCTGCTAGTTTTTTACTAAACGAAAGACCGGATCTAGGGGTCAAGAAAATTCTGATCGTTGATTGGGATGTCCATCACGGAAATGGTACCCAGAAGATGTTTTGGAAAGATCCTCGTGTACTATTTTTCTCTGTTCATAGGCATGAGTATGGGGGTTTCTATCCAGCGGGTGATGATGGCGATTATAACATGGTTGGGGAAGGTCCAGGTGAAGGGTTTAACATAAATGTTCCATGGGATCAAGGACGATGTGGAGATGCAGATTATCTTGCTGCATGGGACCATATCTTGATTCCTGTGGCGAGGGAATTTAACCCGGATGTTATTTTTCTTTCAGCTGGATTTGATGCAGCTATTAATGATCCGCTAGGGGGTTGTTGTGTGACCCCATATGGATATTCAGTTATGTTGAAGAAGCTGATGGAGTTTGCACAAGGAAAGATAGTGCTGGCGTTAGAGGGAGGGTACAATCTTGACTCAATTGCAAAGTCTTCACTTGCATGTGTCCAAGTTTTGCTTGAAGACAAACAAATTCAAGGACCTCCGGAAGCATACCCATTCGAGTCGACATGGCGTGTCATACAAGCGGTGCGCAAGAGGCTATGCACATATTGGCCTTCACTTGCAGATGAATTATCGTGGAAGCTAATTAATCAGAAAACTCCTACTCCAATCATCCTTATCTCAAGCTCCGACTCTGAAACTGAAGACAACGCCCAAGGACTCCTGGATCAAATGTCGAAACTCAGCATTGAAAACCCTCAAGGTACACTACTTGAAAACCACCAAGTAGAACCTGCATCTACATCTTGGAGAGCTGATCTCGCAAAGGTTGACGTTTGGTATGCCTCTTTTGGATCCAACATGTGGAAACCAAGGTTTCTTTGCTATATTCAAGGGGGACAGGTCGATGGATTGAAAAAGGTATGTGTTGGCTCAATGGATAAAAGTCCACCAAAGGAAACAGTGTGGGAAACATTTCCACATAGATTGTTCTTTGGCCGTGAATCTTCAGTTGGTTGGGGTGTAGGAGGAGTTGCTTTCACCAACCCCCTTGCTAATCTCATTGATCAAACTCACATGTGTTTGTACCGTATCACGCTTGAGCAGTTCAATGACGTTCTGTCTCAAGAAAATGGTTTGAATGTGGATTCAGATTCTCCGGTCTTTGATCTAGCTGCTTTGCAGTTAGTAGATAACAAAGGATCCATTTTAGAAGCTCCTTTGAATAGTTGGTATGGAAATGTTGTCTGCTTGGGAAAAGAACGCGACATTCCTATACTTACAATGACTTGCACGCTTTCCGCTGTTGAGAAATTCAAATCCGGTGAGATCCCTATAAGACCTCCTGCAAAAGCTTATGCCAACACTTTAATAAGGGGACTTGTGGAAGGAGGAAGATTATCTAAAGAAGAAGCTGAGGCTTACATAGACAAGGCTGTGTCTAAACCTCTCTAGTGTATAATTATTTACTCAGAAACCGCCCGTTTGAACACGATTTGGAGCTTCGGGTTTCTGAGTTATTCAATTAGGATAAAAACCACAAGTTTAGGAATATTGTGAGACCTTTGAATTTGTCTTTTGAAAGAGAGGACTGTGTCCTCTGTTAGCTGTGTTGTGCTTGCTCCCTAAGCAAACTCTCAATGTATTTTAGTTATCTTCGGGTTTTAGGCTTTACCAAGAAGCTGTATTCGGTAAATGTATTAAAGAATCCTCCAAACTGCTTTATATTGACCGGAGAGAAACATTCTTATTCTTCGGAATGGTACTTTGAAGTTTGAAG

SEQ ID NO: 2845 - DNA, 1432 bp, Zea mays
  misc_feature (1)..(1432): Ceres cDNA ID no. 15180059
  misc_feature (1)..(1432): Ceres CLONE  ID no. 332432
  misc_feature (1)..(1432): Also known as  Ceres CDNA ID no. 24360921
aagtggcaaggaaatagaaaacgcagcgtccgtgcgctgtaggtgtgtgtgcgccaagttcctgtgtccattgtcttgtgtacagctactgttcatctctgtctatctctgttcttggcgttccatcgagtgtgtagcgctagtagattccaacatttggtatcagaggcagtttatgcccaagatcctgcgctactacctcgagtccgaagctatggcgatggttccgcacggcgccggggggagttcggtctccatgtcgtacccggtgctgtcgccggcgagctacacggcgtgggcgatcaaggtggagtcgatcctcgacgcgcaaggtctctgggaggccgtgtctccaccagatggtggcgaggtgaacgcggtgaagaacaagacggcgcgggcacaacttctccaagctctgcccgatgacatcttgatgcaggtctccaccaagaaaacggcggcggaggtgtgggcgagtctcaagactcgtttcgtcggggcggatcgggtcaagacggcgcgcctagccacgctcaagggggagttcgacaagctgtacatggaggacggggaggcattggacgactacgccggcaaaatcagcggtatggcggcgcgttacgccgggcttggcgcgacactcgacgacgctgccatggtaaaaaagctcctcgacaccgtcccggatcggctcttccccgtcgtcgcgggcatcgagcagttctgcgacgttgagacgatgccatttgaggaggcgctcggacgtctcaaggcgttcgatgagcgttctcggcggcgtactcatgccggcggcgaacgacgcgacgaccaactcctcctcacggaggccgagtggaaagctcgaaaaaagaagaagtcgacgatcggcaagtgcttcaactgcggtaaccgcggccacttcgcgcgggattgccgtaagaagaaggaggaggaggcgctgctagccagggccgatgaagaagcgacgctcctgtgagtgcgggacgcggcgctaggattagggagagtttgttagaataatcccagcgcatgtgtgtacgagtcatggcagttgtgcatgtgtgtgcatgcagtgcaactgctagctccgtgggtgtgtgcgcatggtgctggtcactagctagttgagtggtgtagtgcgtgcgttagttgcgtgcgtgcttgcatgctggaaggagtggccgagaagctagcgcctagtgacttgttcgtgtgtgtgaggaggttgcttgcatgcaaagcaacatgagttatgtggctcatggcgtgaaggctgggtagtggactagtggagttcgtagctctctgtatattcagtctataaaggcacatgtactgctcagttaaaaagtgtggcaaggaaatagaaaacgcagcgtccatgcgctgtaggtgtgtgtgcgcgaac

SEQ ID NO: 2846 - protein, 1432 aa, Zea mays
  misc_feature: PFam Name: Retrotrans_gag; PFam Description: Retrotransposon
  misc_feature: GI Number: 34907386; NR Description: P0471B04.27 [Oryza sativa (japonica cultivar-group)] >gi|21952802|dbj|BAC06218.1| P0018C10.19 [Oryza sativa (japonica cultivar-group)] >gi|22202685|dbj|BAC07343.1| P0471B04.27 [Oryza sativa (japonica
  misc_feature: GI Number: 34910624; NR Description: putative copia-type polyprotein [Oryza sativa (japonica cultivar-group)] >gi|15623989|dbj|BAB68043.1| putative copia-type polyprotein [Oryza sativa (japonica cultivar-group)]
  misc_feature: GI Number: 51964644; NR Description: PREDICTED OJ1499_A07.20
  misc_feature: GI Number: 50921055; NR Description: putative gag-pol polyprotein [Oryza sativa (japonica cultivar-group)] >gi|30017513|gb|AAP12935.1| putative gag-pol polyprotein [Oryza
  misc_feature: GI Number: 50917767; NR Description: gag-pol polyprotein [Oryza sativa (japonica cultivar-group)] >gi|29150404|gb|AAO72413.1| gag-pol polyprotein [Oryza sativa
AAGTGGCAAGGAAATAGAAAACGCAGCGTCCGTGCGCTGTAGGTGTGTGTGCGCCAAGTTCCTGTGTCCATTGTCTTGTGTACAGCTACTGTTCATCTCTGTCTATCTCTGTTCTTGGCGTTCCATCGAGTGTGTAGCGCTAGTAGATTCCAACATTTGGTATCAGAGGCAGTTTATGCCCAAGATCCTGCGCTACTACCTCGAGTCCGAAGCTATGGCGATGGTTCCGCACGGCGCCGGGGGGAGTTCGGTCTCCATGTCGTACCCGGTGCTGTCGCCGGCGAGCTACACGGCGTGGGCGATCAAGGTGGAGTCGATCCTCGACGCGCAAGGTCTCTGGGAGGCCGTGTCTCCACCAGATGGTGGCGAGGTGAACGCGGTGAAGAACAAGACGGCGCGGGCACAACTTCTCCAAGCTCTGCCCGATGACATCTTGATGCAGGTCTCCACCAAGAAAACGGCGGCGGAGGTGTGGGCGAGTCTCAAGACTCGTTTCGTCGGGGCGGATCGGGTCAAGACGGCGCGCCTAGCCACGCTCAAGGGGGAGTTCGACAAGCTGTACATGGAGGACGGGGAGGCATTGGACGACTACGCCGGCAAAATCAGCGGTATGGCGGCGCGTTACGCCGGGCTTGGCGCGACACTCGACGACGCTGCCATGGTAAAAAAGCTCCTCGACACCGTCCCGGATCGGCTCTTCCCCGTCGTCGCGGGCATCGAGCAGTTCTGCGACGTTGAGACGATGCCATTTGAGGAGGCGCTCGGACGTCTCAAGGCGTTCGATGAGCGTTCTCGGCGGCGTACTCATGCCGGCGGCGAACGACGCGACGACCAACTCCTCCTCACGGAGGCCGAGTGGAAAGCTCGAAAAAAGAAGAAGTCGACGATCGGCAAGTGCTTCAACTGCGGTAACCGCGGCCACTTCGCGCGGGATTGCCGTAAGAAGAAGGAGGAGGAGGCGCTGCTAGCCAGGGCCGATGAAGAAGCGACGCTCCTGTGAGTGCGGGACGCGGCGCTAGGATTAGGGAGAGTTTGTTAGAATAATCCCAGCGCATGTGTGTACGAGTCATGGCAGTTGTGCATGTGTGTGCATGCAGTGCAACTGCTAGCTCCGTGGGTGTGTGCGCATGGTGCTGGTCACTAGCTAGTTGAGTGGTGTAGTGCGTGCGTTAGTTGCGTGCGTGCTTGCATGCTGGAAGGAGTGGCCGAGAAGCTAGCGCCTAGTGACTTGTTCGTGTGTGTGAGGAGGTTGCTTGCATGCAAAGCAACATGAGTTATGTGGCTCATGGCGTGAAGGCTGGGTAGTGGACTAGTGGAGTTCGTAGCTCTCTGTATATTCAGTCTATAAAGGCACATGTACTGCTCAGTTAAAAAGTGTGGCAAGGAAATAGAAAACGCAGCGTCCATGCGCTGTAGGTGTGTGTGCGCGAAC

SEQ ID NO: 2847 - DNA, 1263 bp, Zea mays
  misc_feature (1)..(1263): Ceres cDNA ID no. 15180126
  misc_feature (1)..(1263): Ceres CLONE  ID no. 372006
  misc_feature (1)..(1263): Also known as  Ceres CDNA ID no. 23793644
cagctgctcctggccgtcgacaccagcaactacgcctcgtggatcccttgcgccggctgcgcgggctgccccacgtcgtccgcggcgcccttcgacccggccgcgtccgcctcgtaccgcacggtgccctgcgggtcgccgctgtgcgcgcaggcacccaacgcggcgtccccgcccggcggcaaggcctgcggcttcagcctcacctacgccgactcctcgctgcaggccgcgctgtcgcaggactccctcgccgtcgcaggcaacgccgtgaaggcctacaccttcgggtgcctgcagagggccactggcacggctgcgccgccgcaggggctgctgggtctcggccgcggcccgctgtcgttcctttcgcagaccaaggacatgtacgaggccaccttctcgtactgtctccccagcttcaagtcgctcaacttctctggaacgctccggctcgggcgcaacggccagccgcagcgcatcaagacgacgccgctgctggccaacccgcaccggtcgtcgctctactacgtgaacatgaccggcgtccgcgtgggcaggaaggtggtgcccatcccggcgttcgacccggcgacgggcgcgggcaccgtgctggactctggcaccatgttcacccggctggtggcgccggcgtacgtggccgtgcgggacgaggtccggcgccgcgtcggcgcgcccgtatcctcgctgggagggttcgacacgtgcttcaacaccaccgccgtcgcgtggccgcccatgacgctgctgttcgacggcatgcaggtgacgttgccggaggagaacgtggtcatccacagcacgtacgcgaccatcagctgcctggccatggccgcggcgcccgacggcgtcaacaccgtgctcaacgtcatcccagcatgcagcagcagaaccaccgtgtgctcttcgacgtgcccaacggacgcgtcggcttcgcgcgcgagcgctgcactgccgcttgatcagcttgctcgcgcgcctgcgcgcgggctcggattcgggttatatttagttaaacctacgttctacggttgtggacgtcatgcactgctgtcggagtgggtgattaataatttaactttccttttctttttaatctcgttgctcttcagatttaccatatgtgtttcacattcaccgcgttatgtggtttaggggctgaatgattggggtctaaataatgtactgcatattccagttttggattaagcacggtcgtcgtttaggcttgatatgcctaac

SEQ ID NO: 2848 - protein, 1263 aa, Zea mays
  misc_feature: PFam Name: Asp; PFam Description: Eukaryotic aspartyl protease
  misc_feature: PFam Name: TP2; PFam Description: Nuclear transition protein 2
  misc_feature: GI Number: 50939761; NR Description: nucleoid DNA-binding-like protein [Oryza sativa (japonica cultivar-group)] >gi|22775625|dbj|BAC15479.1| nucleoid DNA-binding-like protein [Oryza sativa (japonica cultivar-group)]
  misc_feature: GI Number: 50904527; NR Description: putative nucleoid DNA-binding-like protein [Oryza sativa (japonica cultivar-group)] >gi|20161865|dbj|BAB90778.1| putative nucleoid DNA-binding-like
  misc_feature: GI Number: 21700851; NR Description: AT3g54400/T12E18_90 [Arabidopsis thaliana] >gi|7288018|emb|CAB81805.1| nucleoid DNA-binding-like protein [Arabidopsis thaliana] >gi|17979257|gb|AAL49945.1| AT3g54400/T12E18_90 [Arabidopsis
  misc_feature: GI Number: 21617933; NR Description: nucleoid
  misc_feature: GI Number: 21553652; NR Description: nucleoid DNA-binding-like protein [Arabidopsis thaliana] >gi|9759559|dbj|BAB11161.1| nucleoid DNA-binding-like protein [Arabidopsis thaliana] >gi|15240680|ref|NP_196320.1| aspartyl
CAGCTGCTCCTGGCCGTCGACACCAGCAACTACGCCTCGTGGATCCCTTGCGCCGGCTGCGCGGGCTGCCCCACGTCGTCCGCGGCGCCCTTCGACCCGGCCGCGTCCGCCTCGTACCGCACGGTGCCCTGCGGGTCGCCGCTGTGCGCGCAGGCACCCAACGCGGCGTCCCCGCCCGGCGGCAAGGCCTGCGGCTTCAGCCTCACCTACGCCGACTCCTCGCTGCAGGCCGCGCTGTCGCAGGACTCCCTCGCCGTCGCAGGCAACGCCGTGAAGGCCTACACCTTCGGGTGCCTGCAGAGGGCCACTGGCACGGCTGCGCCGCCGCAGGGGCTGCTGGGTCTCGGCCGCGGCCCGCTGTCGTTCCTTTCGCAGACCAAGGACATGTACGAGGCCACCTTCTCGTACTGTCTCCCCAGCTTCAAGTCGCTCAACTTCTCTGGAACGCTCCGGCTCGGGCGCAACGGCCAGCCGCAGCGCATCAAGACGACGCCGCTGCTGGCCAACCCGCACCGGTCGTCGCTCTACTACGTGAACATGACCGGCGTCCGCGTGGGCAGGAAGGTGGTGCCCATCCCGGCGTTCGACCCGGCGACGGGCGCGGGCACCGTGCTGGACTCTGGCACCATGTTCACCCGGCTGGTGGCGCCGGCGTACGTGGCCGTGCGGGACGAGGTCCGGCGCCGCGTCGGCGCGCCCGTATCCTCGCTGGGAGGGTTCGACACGTGCTTCAACACCACCGCCGTCGCGTGGCCGCCCATGACGCTGCTGTTCGACGGCATGCAGGTGACGTTGCCGGAGGAGAACGTGGTCATCCACAGCACGTACGCGACCATCAGCTGCCTGGCCATGGCCGCGGCGCCCGACGGCGTCAACACCGTGCTCAACGTCATCCCAGCATGCAGCAGCAGAACCACCGTGTGCTCTTCGACGTGCCCAACGGACGCGTCGGCTTCGCGCGCGAGCGCTGCACTGCCGCTTGATCAGCTTGCTCGCGCGCCTGCGCGCGGGCTCGGATTCGGGTTATATTTAGTTAAACCTACGTTCTACGGTTGTGGACGTCATGCACTGCTGTCGGAGTGGGTGATTAATAATTTAACTTTCCTTTTCTTTTTAATCTCGTTGCTCTTCAGATTTACCATATGTGTTTCACATTCACCGCGTTATGTGGTTTAGGGGCTGAATGATTGGGGTCTAAATAATGTACTGCATATTCCAGTTTTGGATTAAGCACGGTCGTCGTTTAGGCTTGATATGCCTAAC

SEQ ID NO: 2849 - DNA, 1649 bp, Zea mays
  misc_feature (1)..(1649): Ceres cDNA ID no. 15180302
  misc_feature (1)..(1649): Ceres CLONE  ID no. 347625
  misc_feature (1)..(1649): Also known as  Ceres CDNA ID no. 23789808
tagttcatttatgatttcctgcgagcacaaagctagcgaagataccaaacaatggggagcacgagcgccacaggcaccacgtcgtcttcctcatcggctgcccacgggggcggtgccgcacacgtactgctcctgccgtacccgggcgcgcagggccatacaaacccgctgctccagttcggccgctgcctcgcctaccacggcctccgccccacgctcgtcacctcgcggtacgtgctctccaccaccccgcctcccggggagcccttcagggtggccgccatttccgatggcttcgacgacggcggggcggccgcgtgccccgacctcgacgtgtactggcgccagctcgaggccgtcggctcggagacgctggcggagctgatccgctccgaggccgccgatgggcggcctgtgcgcgtgctggtttacgacccgcacctgccgtgggcgcgacgggtggcacaggcggccgggctggcggcagcggcgttcctatcgcagccatgcgccgtcgacgtcgtctacggggaggtgtgtgcaggacggctgccactgccggtggtggacgggatagagctgtttgcacgcgggctgctgggtgtcgagctcggtcccgacgacgttccgccgttcgcagcaaagccagactggtgccctgtgttccttcgggcatcattgcggcaatttgaggggctggaggacgccgacgacgtgctcgtcaactcattccacgagatcgaacccaaggaggcagattatatggccctaacatggcatgcaaagacaataggcccaactttgccatcattttatcttgatgatgaccgtttgcccttgaacaagacttacggtttcaacctcttcaacagcagcgagtcatgtctggcttggcttgacaaacagcttccgtgttctgttgttcttgtatcctatggtactgtctctgattatgatgaagcacagttagaggagcttggcaatggattgtacaattctggcaaaccattcatttgggttgtgaggtcaaacgaagaacacaagttgtccaatgaacttcgtgacaagtgcaaggaacgtggccttattgtttcttggtgcccccagctggaagttctagcacataaagctacaggttgtttcttcacacattgcggatggaactcgacattggaagcaattgttaatggtgtgccaatggtggcaataccacactgggcagaccagccgaccatatcaaaatatatggagagcatgttgggcttgggtgtccgagtgcgcaaggatgagaaaggcttggtaacgagggacgaggtggaaaggtgcatcaaggatgtcatggatggtgatagtaaggataagtataggaagagtgccactatgtggatgcaaaaggccaaggcagctatgcagaatggagggagctcggccaagaatattacagaattcgccgcgaagtattctttaagttaatttttcaaatatttcgtaaaaaaagttaattttcaaagatataatgatagtgttataattacttcctataccttcatggattgtatgccttcctgcatgttatatttttgtctcgggattgtgcgtattacgttttgacttgatgatgtacatgctacagcagcaacctccacgtc

SEQ ID NO: 2850 - protein, 473 aa, Zea mays
  misc_feature: PFam Name: UDPGT; PFam Description: UDP-glucoronosyl and
  misc_feature: GI Number: 50726639; NR Description: putative UDP-glucose:salicylic acid glucosyltransferase [Oryza sativa (japonica cultivar-group)] >gi|50725328|dbj|BAD34401.1| putative UDP-glucose:salicylic acid glucosyltransferase [Oryza sativa
  misc_feature: GI Number: 50726641; NR Description: putative UDP-glucose:salicylic acid glucosyltransferase [Oryza sativa (japonica cultivar-group)] >gi|50725330|dbj|BAD34403.1| putative UDP-glucose:salicylic acid glucosyltransferase [Oryza sativa
  misc_feature: GI Number: 60649935; NR Description: UDP-xylose phenolic
  misc_feature: GI Number: 42571217; NR Description: UDP-glucoronosyl/UDP-glucosyl transferase family protein
  misc_feature: GI Number: 37993669; NR Description: UDP-glycosyltransferase
MGSTSATGTTSSSSSAAHGGGAAHVLLLPYPGAQGHTNPLLQFGRCLAYHGLRPTLVTSRYVLSTTPPPGEPFRVAAISDGFDDGGAAACPDLDVYWRQLEAVGSETLAELIRSEAADGRPVRVLVYDPHLPWARRVAQAAGLAAAAFLSQPCAVDVVYGEVCAGRLPLPVVDGIELFARGLLGVELGPDDVPPFAAKPDWCPVFLRASLRQFEGLEDADDVLVNSFHEIEPKEADYMALTWHAKTIGPTLPSFYLDDDRLPLNKTYGFNLFNSSESCLAWLDKQLPCSVVLVSYGTVSDYDEAQLEELGNGLYNSGKPFIWVVRSNEEHKLSNELRDKCKERGLIVSWCPQLEVLAHKATGCFFTHCGWNSTLEAIVNGVPMVAIPHWADQPTISKYMESMLGLGVRVRKDEKGLVTRDEVERCIKDVMDGDSKDKYRKSATMWMQKAKAAMQNGGSSAKNITEFAAKYSLS

SEQ ID NO: 2851 - DNA, 1847 bp, Zea mays
  misc_feature (1)..(1847): Ceres cDNA ID no. 15180404
  misc_feature (1)..(1847): Ceres CLONE  ID no. 391660
  misc_feature (1)..(1847): Also known as  Ceres CDNA ID no. 24447692
ctgctagtgctcagtcctcgccctctcgctttccgagggagcctttgcctttcccctccgcccgccagccattaatggcggcggcatctccatccactcccccctcgcccccctcccactgctgctacttctagaagcgctggtggcagggcaggcggtatcccggccgctggcgctggcgcgagagttggttggtggtggtgttcagcccccctccctcttcaggtttagggtggagcgatccgtgcaggccaacgcggggtgcgtgacccagaaagggaaaccgccgccttttttctcttctgccgccccgcttttccaatccctcctcaacctcatccgccccgcccgcaccatcaccaaaaaggtccccgccttcttcttcctcttctcctctgcccctgcttgtcgtttgctcgtgctcccccaccccctttctgattcagccagggttccttccgcggcgcggcgcgtcgccatgggcaactgctggggcgccaagatcagctccgacagcccctcccgcggcgcctcctccccgtcagggacggcgtccaagttggcgagcaggaacggggcggcggcagccctgagcgggtgcagcagccacgcgtcgtccgcgtccatgctgccgacgccccgcagcgaggacgagatcctggagtcggccaacgtcagggccttcagcttcaacgagctgaggaccgccaccaggaacttcaggccggacagcgtgctgggcgagggcgggttcggatccgtcttcaagggctgggtcgacgagaagacgctcgccccggctaggcccggcacggggatggtcattgccgtcaagaagctcaaccaggatggataccagggccacaaggagtggctgactgaagtgaactaccttggaacgctgtcgcacccctaccttgtgaagctcgttggctactgcctcgaggacgaacagcgcctcctcgtctacgagttcatgccacgcgggagtctggagaaccatctgttcaggaggagctcctatttccagccgctgtcctggaacctacggatgaagattgcgctcggagcagctaaaggcctcgcgtatctccacagcgacgaggctaaagtcatctaccgtgacttcaagacatctaatgtccttctagatgcgaacttcaatgcaaagctctctgatttcgggctggcgaaggatggtccgaccggcgacaagagccatgtctccactagggtgatggggactcacgggtatgcagctccagaataccttgcgacaggtcatctgaccaccaagagcgacgtgtacagctttggggtggtgctcctagagatgctgtcagggcggcgggcgctggacaagaaccgcccgaacggggagcacaacctggtggagtgggctaggccatacctgagaagcaagcggcgcatatttcgcatcctggacccacggctgggcgggcagtactcccttgccagggcgcagaaggctgcggcgctcgccctgcaatgcctctcggtggagtccaggcacaggcccagcatggacgaggtggtcacagcgttagagcagctccaggacaccaaagaaggaggtaaccatcacctacagaagaggccaggcagccggagcttggataacaatggcggcaaagcggcagggaaggggaagcctgctcctcatgtaaaaccagtttgagtgattggattttatatgccagagtatctctcttttttttttcccatccatttgtaggtgtaggtaatatagtaggtttcttagagggatttgtaaagaggcaggcagagttctggatgttttctgtctattatgtagttttttttac

SEQ ID NO: 2852 - protein, 1847 aa, Zea mays
  misc_feature: PFam Name: Pkinase; PFam Description: Protein kinase domain
  misc_feature: PFam Name: Pkinase_Tyr; PFam Description: Protein tyrosine kinase
  misc_feature: GI Number: 8778537; NR Description: F22G5.5 [Arabidopsis thaliana]
  misc_feature: GI Number: 166809; NR Description: protein kinase
  misc_feature: GI Number: 42569425; NR Description: protein kinase (APK1b)
  misc_feature: GI Number: 34906046; NR Description: putative serine/threonine-specific protein kinase [Oryza sativa (japonica cultivar-group)] >gi|15290002|dbj|BAB63697.1| putative serine/threonine-specific protein kinase [Oryza sativa (japonica
  misc_feature: GI Number: 21555255; NR Description: serine/threonine-specific protein kinase NAK [Arabidopsis thaliana] >gi|7406425|emb|CAB85534.1| serine/threonine-specific protein kinase NAK [Arabidopsis thaliana]
CTGCTAGTGCTCAGTCCTCGCCCTCTCGCTTTCCGAGGGAGCCTTTGCCTTTCCCCTCCGCCCGCCAGCCATTAATGGCGGCGGCATCTCCATCCACTCCCCCCTCGCCCCCCTCCCACTGCTGCTACTTCTAGAAGCGCTGGTGGCAGGGCAGGCGGTATCCCGGCCGCTGGCGCTGGCGCGAGAGTTGGTTGGTGGTGGTGTTCAGCCCCCCTCCCTCTTCAGGTTTAGGGTGGAGCGATCCGTGCAGGCCAACGCGGGGTGCGTGACCCAGAAAGGGAAACCGCCGCCTTTTTTCTCTTCTGCCGCCCCGCTTTTCCAATCCCTCCTCAACCTCATCCGCCCCGCCCGCACCATCACCAAAAAGGTCCCCGCCTTCTTCTTCCTCTTCTCCTCTGCCCCTGCTTGTCGTTTGCTCGTGCTCCCCCACCCCCTTTCTGATTCAGCCAGGGTTCCTTCCGCGGCGCGGCGCGTCGCCATGGGCAACTGCTGGGGCGCCAAGATCAGCTCCGACAGCCCCTCCCGCGGCGCCTCCTCCCCGTCAGGGACGGCGTCCAAGTTGGCGAGCAGGAACGGGGCGGCGGCAGCCCTGAGCGGGTGCAGCAGCCACGCGTCGTCCGCGTCCATGCTGCCGACGCCCCGCAGCGAGGACGAGATCCTGGAGTCGGCCAACGTCAGGGCCTTCAGCTTCAACGAGCTGAGGACCGCCACCAGGAACTTCAGGCCGGACAGCGTGCTGGGCGAGGGCGGGTTCGGATCCGTCTTCAAGGGCTGGGTCGACGAGAAGACGCTCGCCCCGGCTAGGCCCGGCACGGGGATGGTCATTGCCGTCAAGAAGCTCAACCAGGATGGATACCAGGGCCACAAGGAGTGGCTGACTGAAGTGAACTACCTTGGAACGCTGTCGCACCCCTACCTTGTGAAGCTCGTTGGCTACTGCCTCGAGGACGAACAGCGCCTCCTCGTCTACGAGTTCATGCCACGCGGGAGTCTGGAGAACCATCTGTTCAGGAGGAGCTCCTATTTCCAGCCGCTGTCCTGGAACCTACGGATGAAGATTGCGCTCGGAGCAGCTAAAGGCCTCGCGTATCTCCACAGCGACGAGGCTAAAGTCATCTACCGTGACTTCAAGACATCTAATGTCCTTCTAGATGCGAACTTCAATGCAAAGCTCTCTGATTTCGGGCTGGCGAAGGATGGTCCGACCGGCGACAAGAGCCATGTCTCCACTAGGGTGATGGGGACTCACGGGTATGCAGCTCCAGAATACCTTGCGACAGGTCATCTGACCACCAAGAGCGACGTGTACAGCTTTGGGGTGGTGCTCCTAGAGATGCTGTCAGGGCGGCGGGCGCTGGACAAGAACCGCCCGAACGGGGAGCACAACCTGGTGGAGTGGGCTAGGCCATACCTGAGAAGCAAGCGGCGCATATTTCGCATCCTGGACCCACGGCTGGGCGGGCAGTACTCCCTTGCCAGGGCGCAGAAGGCTGCGGCGCTCGCCCTGCAATGCCTCTCGGTGGAGTCCAGGCACAGGCCCAGCATGGACGAGGTGGTCACAGCGTTAGAGCAGCTCCAGGACACCAAAGAAGGAGGTAACCATCACCTACAGAAGAGGCCAGGCAGCCGGAGCTTGGATAACAATGGCGGCAAAGCGGCAGGGAAGGGGAAGCCTGCTCCTCATGTAAAACCAGTTTGAGTGATTGGATTTTATATGCCAGAGTATCTCTCTTTTTTTTTTCCCATCCATTTGTAGGTGTAGGTAATATAGTAGGTTTCTTAGAGGGATTTGTAAAGAGGCAGGCAGAGTTCTGGATGTTTTCTGTCTATTATGTAGTTTTTTTTAC

SEQ ID NO: 2853 - DNA, 1055 bp, Zea mays
  misc_feature (1)..(1055): Ceres cDNA ID no. 15180515
  misc_feature (1)..(1055): Ceres CLONE  ID no. 379745
  misc_feature (1)..(1055): Also known as  Ceres CDNA ID no. 24726684
acacgtattctggggctacctcagctgccgtcctcgagctttcggatcagcggcctccgcaccggcgcttcagctcctcgacgaactcgtcgaagttgcgccgcgacgaaccaccggacgccacggcagcctcgagtgtgcccctgagcttcttcacctgctccctgagcttgaggccgtcttccccgcccatgaccgcttcaatccgcgccctcacctcgtcggcgcgcaccgcgccgcggtctccgacggacacgccggcacgccactcccgcgcgacgaggcggcggttggtgagctggtccgtgagcagcgggaagcacagcatgggcacgcccgcccacacgctctcgaggacggagttccagccgcagtgcgtgaggaaggcgccgacggcggcgtgggagagcacctccacctggcagcaccactggaccaccaggccgcgccccgccgcggcctcggcgaacccctcgggcagcgggtccgggtcgtcggagctcacgatgtccgggagcatcacccacaggaaccgggcgccgctggccagcacgccgcccgcgatctcgcgcagctcctgcttggtcacgtgcgcgtagctgccgaaggagatgtagagcacggacccgaccggctgcgcgtccagccaccgggagcagtcggactccgcccacatggacgtggccacggcgctgcgcgcgaagcccgccgggaggatgggccccacggcgtagaagggcctgtaggcgcgcagcgccgcgatggtcgacggctccagctcctccacggtgttgcagagcacgtagtcggcgccgcgggcctcgtcgaacgccttgaagatgatgcggtggacgatggagctggtgtccatctcctgcaggtacgacatgagctcgctgggctcgatggccgccacgcccgggatgtaggtgatcgtgtccttgcgaggctctgcacatcgatgatgcatggaattgggacggacatcagcgaaacaaacatggccctgtctgtttggcgcgaactcaatggaaaagtgtgtggtgagttttgtc

SEQ ID NO: 2854 - protein, 1055 aa, Zea mays
  misc_feature: GI Number: 66776813; NR Description: Phosphoribosylaminoimidazole-succinocarboxamide synthase [Anaeromyxobacter dehalogenans 2CP-C] >gi|66857369|ref|ZP_00401420.1|
  misc_feature: GI Number: 66776896; NR Description: LigA [Anaeromyxobacter dehalogenans 2CP-C] >gi|66857361|ref|ZP_00401413.1| LigA
  misc_feature: GI Number: 66778368; NR Description: Cytochrome c biogenesis protein, transmembrane region [Anaeromyxobacter dehalogenans 2CP-C] >gi|66855954|ref|ZP_00400025.1| Cytochrome c biogenesis protein,
  misc_feature: GI Number: 66778899; NR Description: UvrD/REP helicase [Anaeromyxobacter dehalogenans 2CP-C] >gi|66855227|ref|ZP_00399303.1| UvrD/REP helicase [Anaeromyxobacter
  misc_feature: GI Number: 66779508; NR Description: Aspartate/glutamate/uridylate kinase [Anaeromyxobacter dehalogenans 2CP-C] >gi|66854587|ref|ZP_00398667.1| Aspartate/glutamate/uridylate kinase [Anaeromyxobacter
ACACGTATTCTGGGGCTACCTCAGCTGCCGTCCTCGAGCTTTCGGATCAGCGGCCTCCGCACCGGCGCTTCAGCTCCTCGACGAACTCGTCGAAGTTGCGCCGCGACGAACCACCGGACGCCACGGCAGCCTCGAGTGTGCCCCTGAGCTTCTTCACCTGCTCCCTGAGCTTGAGGCCGTCTTCCCCGCCCATGACCGCTTCAATCCGCGCCCTCACCTCGTCGGCGCGCACCGCGCCGCGGTCTCCGACGGACACGCCGGCACGCCACTCCCGCGCGACGAGGCGGCGGTTGGTGAGCTGGTCCGTGAGCAGCGGGAAGCACAGCATGGGCACGCCCGCCCACACGCTCTCGAGGACGGAGTTCCAGCCGCAGTGCGTGAGGAAGGCGCCGACGGCGGCGTGGGAGAGCACCTCCACCTGGCAGCACCACTGGACCACCAGGCCGCGCCCCGCCGCGGCCTCGGCGAACCCCTCGGGCAGCGGGTCCGGGTCGTCGGAGCTCACGATGTCCGGGAGCATCACCCACAGGAACCGGGCGCCGCTGGCCAGCACGCCGCCCGCGATCTCGCGCAGCTCCTGCTTGGTCACGTGCGCGTAGCTGCCGAAGGAGATGTAGAGCACGGACCCGACCGGCTGCGCGTCCAGCCACCGGGAGCAGTCGGACTCCGCCCACATGGACGTGGCCACGGCGCTGCGCGCGAAGCCCGCCGGGAGGATGGGCCCCACGGCGTAGAAGGGCCTGTAGGCGCGCAGCGCCGCGATGGTCGACGGCTCCAGCTCCTCCACGGTGTTGCAGAGCACGTAGTCGGCGCCGCGGGCCTCGTCGAACGCCTTGAAGATGATGCGGTGGACGATGGAGCTGGTGTCCATCTCCTGCAGGTACGACATGAGCTCGCTGGGCTCGATGGCCGCCACGCCCGGGATGTAGGTGATCGTGTCCTTGCGAGGCTCTGCACATCGATGATGCATGGAATTGGGACGGACATCAGCGAAACAAACATGGCCCTGTCTGTTTGGCGCGAACTCAATGGAAAAGTGTGTGGTGAGTTTTGTC

SEQ ID NO: 2855 - DNA, 1784 bp, Zea mays
  misc_feature (1)..(1784): Ceres cDNA ID no. 15180518
  misc_feature (1)..(1784): Ceres CLONE  ID no. 383925
  misc_feature (1)..(1784): Also known as  Ceres CDNA ID no. 23808913
actttcccagggagcgtttaattgcctccgcctgcctcgctctcgcttccttcggatgccgctctgcctctgccgcgcccgccagctgcacgcagttcagcaacgcgcgcgccacggcccgcgacgcgatgagcgagaggaggaggcgggcgagcgctgcttccctcgggggtggaggtggcggcggcgttggtggtgttgcgcctgcgcgggccgaggaggacaaggtcgcggcgccgggtaaagcgcctccgccgacggtgtggttcgcgttcaagcggtcgctgcactgccgctccgagccgtcggaggtccacgtgccgcgtgccaaggccggtcccgtcgcgggcgggggcgccggcgcggctgtcggcggcggccacctgtcgtcgatcgtcaccaagcgcgccgcgcggtcggggtgctcgcgctccatcgccaacctccgggacgtcatccacgggagcaagcgccacccggggcagccgcccagctgcagcccgcggtccatcggcagcagcgagttcctcaaccccattgcacacgaggtcgtgctcagcaccaactcccgctgcgagctcaagatcaccggcttcggcggctgcggggggctggcggccgtcggggtggggaccggcgccgcgaacgacgccgacggcgggggcgacggcggcgtcgtgtcgtcgttcgtcggcacgctccgccctggcacgccgggcccagcgtgggccggacacggactgccgtacagcggctccgtgcggggcagcgtgcgctgcacgccgccgaggtcgccgaacgtgatgctcgagaggaatggctcagtggtgaacggccaccgcgcgtcatgcgacgaaaccgctaaaaacggcgccagcaagggctccggtgggctcagctgccacaagtgcggcgagcagttcagcaagtgggaggcgctggaggcgcaccacctctccaaacacgcagtgacggagctggtggaaggggactcgtcgcggaagatcgtggagatcatctgccggacgagcctgctcaagtcggagagcagctgcgtccggatcgagcgcgtgttcaaggtgcacaacacgcagcggacgctgtcccgcttcgaggagtaccgcgaggccgtgaagctcaaggcgagcaagctagccaagaagcacccgcgctgcctcgccgacggcaacgagctgctgcgcttccacggcgccacgctctcgtgcgcgctcggcggcggctccggctcttccagcctctgcgcctccgacaagtgcgccgtgtgccgcatcatccggcacggcttctccgccaggaaggagggcaagggcggcgtgggcgtgttcaccacgtccaccagcggccgcgcgttcgagtccatcgttgaggcgccccccgccatcggcgtcggcgacgacgacggagcgggccagctgggcctgggcaccgcgcgcagggcgctgctggtgtgcagggtcatcgccggccgcgtgcacaagccgctggacaacctcaaggagttcgtggggcagacgggcttcgattcgctcgccggcaaggtcggaccctactccaacatcgaggagctgtacctgctgaacccgagggcgctgctcccgtgcttcgtcgtcatctgtagaccgtagcctactactagctaaacacaccgtctcattcttctctcttcccacttttctctttcgattgctactctagtgtacgtagttaacacggacacggcatagctatcgcctatcggttggaaggtcggatggatttgtcct

SEQ ID NO: 2856 - protein, 1784 aa, Zea mays
  misc_feature: PFam Name: zf-C2H2; PFam Description: Zinc finger, C2H2 type
  misc_feature: PFam Name: APC_basic; PFam Description: APC basic domain
  misc_feature: PFam Name: Pkinase; PFam Description: Protein kinase domain
  misc_feature: PFam Name: Pyr_redox_2; PFam Description: Pyridine
  misc_feature: PFam Name: Cupin_1; PFam Description: Cupin
  misc_feature: GI Number: 52076893; NR Description: zinc finger (C2H2 type) protein-like [Oryza sativa (japonica cultivar-group)] >gi|52076647|dbj|BAD45547.1| zinc finger (C2H2 type) protein-like
  misc_feature: GI Number: 15220394; NR Description: zinc finger (C2H2 type)
  misc_feature: GI Number: 15222333; NR Description: zinc finger (C2H2 type) family protein [Arabidopsis thaliana] >gi|9369383|gb|AAF87132.1|
  misc_feature: GI Number: 9802582; NR Description: T2E6.3 [Arabidopsis thaliana]
  misc_feature: GI Number: 6554199; NR Description: T23J18.16 [Arabidopsis
ACTTTCCCAGGGAGCGTTTAATTGCCTCCGCCTGCCTCGCTCTCGCTTCCTTCGGATGCCGCTCTGCCTCTGCCGCGCCCGCCAGCTGCACGCAGTTCAGCAACGCGCGCGCCACGGCCCGCGACGCGATGAGCGAGAGGAGGAGGCGGGCGAGCGCTGCTTCCCTCGGGGGTGGAGGTGGCGGCGGCGTTGGTGGTGTTGCGCCTGCGCGGGCCGAGGAGGACAAGGTCGCGGCGCCGGGTAAAGCGCCTCCGCCGACGGTGTGGTTCGCGTTCAAGCGGTCGCTGCACTGCCGCTCCGAGCCGTCGGAGGTCCACGTGCCGCGTGCCAAGGCCGGTCCCGTCGCGGGCGGGGGCGCCGGCGCGGCTGTCGGCGGCGGCCACCTGTCGTCGATCGTCACCAAGCGCGCCGCGCGGTCGGGGTGCTCGCGCTCCATCGCCAACCTCCGGGACGTCATCCACGGGAGCAAGCGCCACCCGGGGCAGCCGCCCAGCTGCAGCCCGCGGTCCATCGGCAGCAGCGAGTTCCTCAACCCCATTGCACACGAGGTCGTGCTCAGCACCAACTCCCGCTGCGAGCTCAAGATCACCGGCTTCGGCGGCTGCGGGGGGCTGGCGGCCGTCGGGGTGGGGACCGGCGCCGCGAACGACGCCGACGGCGGGGGCGACGGCGGCGTCGTGTCGTCGTTCGTCGGCACGCTCCGCCCTGGCACGCCGGGCCCAGCGTGGGCCGGACACGGACTGCCGTACAGCGGCTCCGTGCGGGGCAGCGTGCGCTGCACGCCGCCGAGGTCGCCGAACGTGATGCTCGAGAGGAATGGCTCAGTGGTGAACGGCCACCGCGCGTCATGCGACGAAACCGCTAAAAACGGCGCCAGCAAGGGCTCCGGTGGGCTCAGCTGCCACAAGTGCGGCGAGCAGTTCAGCAAGTGGGAGGCGCTGGAGGCGCACCACCTCTCCAAACACGCAGTGACGGAGCTGGTGGAAGGGGACTCGTCGCGGAAGATCGTGGAGATCATCTGCCGGACGAGCCTGCTCAAGTCGGAGAGCAGCTGCGTCCGGATCGAGCGCGTGTTCAAGGTGCACAACACGCAGCGGACGCTGTCCCGCTTCGAGGAGTACCGCGAGGCCGTGAAGCTCAAGGCGAGCAAGCTAGCCAAGAAGCACCCGCGCTGCCTCGCCGACGGCAACGAGCTGCTGCGCTTCCACGGCGCCACGCTCTCGTGCGCGCTCGGCGGCGGCTCCGGCTCTTCCAGCCTCTGCGCCTCCGACAAGTGCGCCGTGTGCCGCATCATCCGGCACGGCTTCTCCGCCAGGAAGGAGGGCAAGGGCGGCGTGGGCGTGTTCACCACGTCCACCAGCGGCCGCGCGTTCGAGTCCATCGTTGAGGCGCCCCCCGCCATCGGCGTCGGCGACGACGACGGAGCGGGCCAGCTGGGCCTGGGCACCGCGCGCAGGGCGCTGCTGGTGTGCAGGGTCATCGCCGGCCGCGTGCACAAGCCGCTGGACAACCTCAAGGAGTTCGTGGGGCAGACGGGCTTCGATTCGCTCGCCGGCAAGGTCGGACCCTACTCCAACATCGAGGAGCTGTACCTGCTGAACCCGAGGGCGCTGCTCCCGTGCTTCGTCGTCATCTGTAGACCGTAGCCTACTACTAGCTAAACACACCGTCTCATTCTTCTCTCTTCCCACTTTTCTCTTTCGATTGCTACTCTAGTGTACGTAGTTAACACGGACACGGCATAGCTATCGCCTATCGGTTGGAAGGTCGGATGGATTTGTCCT

SEQ ID NO: 2857 - DNA, 1692 bp, Zea mays
  misc_feature (1)..(1692): Ceres cDNA ID no. 15180663
  misc_feature (1)..(1692): Ceres CLONE  ID no. 322358
  misc_feature (1)..(1692): Also known as  Ceres CDNA ID no. 23771679
gaaaaaccatcctcctcgctcgcactgacaggcaggcagagagagagagacagagagccgaattgattgccgagggcagagcagcaacagcaacagtccacgaccgatcgcccggcccgcgcgcaggcaggcagcagccatgaaccacctgacgccggcgctccacggggcgatgcggccgccctcggcgcaggggcaggggctggcccggtacggctccgcgccgggctcgctcctagccgccatcgccgactccgtcacccgcggcgaccccgcgccgccgccgccgccgcccgtgagccggttctactccgccgagtcctcggggctcacctcctgcgagtccagctgccgcaccgactgcggacgcccgcccctcgagcgggcgtacggcggctccggcgagatccgcgtgccgccgccgctgcagcagcagcagcaccacctgctggctccccccgcggcctccccgctgttccgccacagcagctcccccgccgggctgctctcccgtctcatgaccgacccgcacggaatggcggcgaccggaggagcgatggggagctacacgcaggcgggcagcgacgccgcgctgggccacggccacgcgcagctcagctcgcagtggagcttctccaggcaggacctgccgcagatctcggagatggggatgataccggccgacatcggggagagcatcgtgggcgccggcgggtgcaacagctccagcgacgccgcgcagtcctcctcctacctctccaggaccttctccgtcggctcctgggacgacaccaactccatcatgttctcgtctgccccctgcaagaagcccaaggtggaccccgccgccggcgccgacgacatggtcaccaacttcagcaccattgacccgcagttcggcctgtccaactcatccctggagctgcccggcatggacgactacctgcagctgcagcaggactccgtcgcctgcagagtgcgtgcgaggcgtggctgcgcgactcacccgcggagcattgccgagagggaaagaaggacgaggatcagcaagaggctgaagaagctgcaagaccttgtgcccaacatggacaagcaaacgaatacgtcggacatgttggaccttgctgtggattacatcaaagagctcaaggaccaagtcgagaagctaaaacacgaccaagcaaactgctgttgcctaggcaacaagagctgctgctgatgctggagaagcagacggaggagggtttttatgccgtaacaatgtgactgttaaaccagagctgttgcttcaggagaccaggccgcgggcagaagtgcgtgacatgtggagcggcttccatgactcagcttcctcttttcttggttgttccacggactagcgacccggccggtgccaacggcttgaagactaggagataacaagtaggacgatgttgtaatttagttaccgcgacgcggtggctctggcttgcgtgtaaagaagtcctccctttcaacgcgactgggattgctgttgctggtaaaattgttgtaggaatatcatctgcgctccatttttcatcgagctcatcttttttttttttttttttttgtgtgtgtcactggattttggcaagaccgtaactcagaaaccgagcactgatcgagcgttcatgccaccccatacgaagtccaagagaattttagtatgcc

SEQ ID NO: 2858 - protein, 1692 aa, Zea mays
  misc_feature: PFam Name: HLH; PFam Description: Helix-loop-helix
  misc_feature: PFam Name: Pyr_redox_2; PFam Description: Pyridine
  misc_feature: PFam Name: FH2; PFam Description: Formin Homology 2 Domain
  misc_feature: PFam Name: Extensin_2; PFam Description: Extensin-like region
  misc_feature: PFam Name: Atrophin-1; PFam Description: Atrophin-1 family
  misc_feature: GI Number: 56784863; NR Description: putative helix-loop-helix protein 1A [Oryza sativa (japonica
  misc_feature: GI Number: 34907702; NR Description: P0035F12.11 [Oryza sativa (japonica cultivar-group)] >gi|20161021|dbj|BAB89954.1| P0035F12.11 [Oryza sativa (japonica cultivar-group)] >gi|20161601|dbj|BAB90521.1| B1065G12.3 [Oryza sativa (japonica
  misc_feature: GI Number: 21554238; NR Description: Contains similarity to bHLH transcription factor GBOF-1 from Tulipa gesneriana gb|AF185269
  misc_feature: GI Number: 50947455; NR Description: putative transcription factor RAU1 [Oryza sativa (japonica cultivar-group)] >gi|42408931|dbj|BAD10188.1| putative transcription factor RAU1
  misc_feature: GI Number: 19401700; NR Description: transcription factor
GAAAAACCATCCTCCTCGCTCGCACTGACAGGCAGGCAGAGAGAGAGAGACAGAGAGCCGAATTGATTGCCGAGGGCAGAGCAGCAACAGCAACAGTCCACGACCGATCGCCCGGCCCGCGCGCAGGCAGGCAGCAGCCATGAACCACCTGACGCCGGCGCTCCACGGGGCGATGCGGCCGCCCTCGGCGCAGGGGCAGGGGCTGGCCCGGTACGGCTCCGCGCCGGGCTCGCTCCTAGCCGCCATCGCCGACTCCGTCACCCGCGGCGACCCCGCGCCGCCGCCGCCGCCGCCCGTGAGCCGGTTCTACTCCGCCGAGTCCTCGGGGCTCACCTCCTGCGAGTCCAGCTGCCGCACCGACTGCGGACGCCCGCCCCTCGAGCGGGCGTACGGCGGCTCCGGCGAGATCCGCGTGCCGCCGCCGCTGCAGCAGCAGCAGCACCACCTGCTGGCTCCCCCCGCGGCCTCCCCGCTGTTCCGCCACAGCAGCTCCCCCGCCGGGCTGCTCTCCCGTCTCATGACCGACCCGCACGGAATGGCGGCGACCGGAGGAGCGATGGGGAGCTACACGCAGGCGGGCAGCGACGCCGCGCTGGGCCACGGCCACGCGCAGCTCAGCTCGCAGTGGAGCTTCTCCAGGCAGGACCTGCCGCAGATCTCGGAGATGGGGATGATACCGGCCGACATCGGGGAGAGCATCGTGGGCGCCGGCGGGTGCAACAGCTCCAGCGACGCCGCGCAGTCCTCCTCCTACCTCTCCAGGACCTTCTCCGTCGGCTCCTGGGACGACACCAACTCCATCATGTTCTCGTCTGCCCCCTGCAAGAAGCCCAAGGTGGACCCCGCCGCCGGCGCCGACGACATGGTCACCAACTTCAGCACCATTGACCCGCAGTTCGGCCTGTCCAACTCATCCCTGGAGCTGCCCGGCATGGACGACTACCTGCAGCTGCAGCAGGACTCCGTCGCCTGCAGAGTGCGTGCGAGGCGTGGCTGCGCGACTCACCCGCGGAGCATTGCCGAGAGGGAAAGAAGGACGAGGATCAGCAAGAGGCTGAAGAAGCTGCAAGACCTTGTGCCCAACATGGACAAGCAAACGAATACGTCGGACATGTTGGACCTTGCTGTGGATTACATCAAAGAGCTCAAGGACCAAGTCGAGAAGCTAAAACACGACCAAGCAAACTGCTGTTGCCTAGGCAACAAGAGCTGCTGCTGATGCTGGAGAAGCAGACGGAGGAGGGTTTTTATGCCGTAACAATGTGACTGTTAAACCAGAGCTGTTGCTTCAGGAGACCAGGCCGCGGGCAGAAGTGCGTGACATGTGGAGCGGCTTCCATGACTCAGCTTCCTCTTTTCTTGGTTGTTCCACGGACTAGCGACCCGGCCGGTGCCAACGGCTTGAAGACTAGGAGATAACAAGTAGGACGATGTTGTAATTTAGTTACCGCGACGCGGTGGCTCTGGCTTGCGTGTAAAGAAGTCCTCCCTTTCAACGCGACTGGGATTGCTGTTGCTGGTAAAATTGTTGTAGGAATATCATCTGCGCTCCATTTTTCATCGAGCTCATCTTTTTTTTTTTTTTTTTTTTGTGTGTGTCACTGGATTTTGGCAAGACCGTAACTCAGAAACCGAGCACTGATCGAGCGTTCATGCCACCCCATACGAAGTCCAAGAGAATTTTAGTATGCC

SEQ ID NO: 2859 - DNA, 1988 bp, Zea mays
  misc_feature (1)..(1988): Ceres cDNA ID no. 15224424
  misc_feature (1)..(1988): Ceres CLONE  ID no. 1159621
  misc_feature (1)..(1988): Also known as  Ceres CDNA ID no. 23830973
taattacggttgggagtgaatatatatagtggagtgttgtgggccaaggcccattacaatggaggtatacacagagacgtaaacaacactctaacactaacatcaacgactatccttaaggcttttgtcgatcaagatacctacaccattcctacccaaacttgctcccgtgttccaacgcttgaaaccagtatcctccacctccttcgccttatagccctttcatttagtcttctggacgcatagaatatttacacgcctcttaatcgctacatccactagctcccctaacttacctgttagggaccctatgttccaactgcctacacgaaatctagttggttcgactagcttccttacccttcacacccgtcgagagagatgtgaagacccttgttcatttttcactacatcctggcgttgatgtagcacatcactaaggaaatgacgacctggtccttgctcacttaagcaagcatctattttgtattcatctgagaaaagtagaacaaaaatttcctcttgggtaaccaatggccactgagcatgtaaatcctgtgtaatcagcccatgaaatgatgatggtgaggtctacttgtgtgctcacgtaggccatagtcttgaggcacattgtgtgaaaccttgtgctcactgtgctcaaatctatctgatccaacgaggcagcaaggtcttcagacactgaagctgcaggtgcagccaagccattttccagggtttcctgtttcatttgttatgcttgggtgttgaggagggttttttttatccctggccacatttcccccctgattgcttgatgtgtattccctccttgcccagaaggaatcaagttgtacactaatccctagtttctacctaaggttagttagaaatattaaggaaagatggaagttctcaaggcattgtgttcagattgataagcatgaatgattactcctttggcatttcaaaagggatagtaacataaaactggggtagatggattatattgttttgtaaaacatgagtactacctatatgcagagtttaaatttaaatccatattatgtaaacaggtagctcaaacatggtcgtttcactgcagcctgtccactgcagtttcaaaatggttcacaatgtgggcgatgttgtgtggttacattttatctttctatgtttgacttactacgacacatctttttcacatgtaggtggtagattgccgtatctgtggtgatcctaactcagtgcttcgttttgcttttatcgagtttgctgatgacgttgctgcacaatcagcactagcacttggtggaaccgtgcttggcttttatcctgtcaaggttctgccatcaaagacagcaattttacctgtgaaccctaaatttcttcctcacactgatgatgagaaagaaatggtatccaggactgtgtattgtactaacattgacaagaagatcgcagaagatgaagtgaagcaattctttgagggaacatgtggtgaagtttctcgtctgaggctacttggtgattatgtgcactccacatgcatcgcttttgttgagtttgtccaagcagatagtgctattctcgctctgaactgcagtggcattgttcttggaacgcttcctgttagggtgagcccatcaaagacaccagtccgctcgcgatcgccccgtgtgacgtcatactgaattcggctcatctgaagccgtcgtccagggcagcaaatttctgggcaacaaagccctagtcgtgtggccttagagactgccgcatcgcggataagtaattgtcgttgagcagagttctcgttggttaaagtccagtctagtaggaggcgcagagacccgtctgtatggtcgctgggagatctatcttgacctcctttttctgttctttttggtcttagttatcgtggttggattctatagcagccttgacaggcattcgaacaacaatgtttatggttatcctatccgctttggact

SEQ ID NO: 2860 - protein, 1988 aa, Zea mays
  misc_feature: PFam Name: RRM_1; PFam Description: RNA recognition motif.
  misc_feature: GI Number: 53793076; NR Description: putative RNA-binding protein [Oryza sativa (japonica cultivar-group)] >gi|53793069|dbj|BAD54280.1| putative RNA-binding protein [Oryza
  misc_feature: GI Number: 50252270; NR Description: putative RNA-binding
  misc_feature: GI Number: 6714278; NR Description: F6N18.17 [Arabidopsis thaliana] gi|25403416|pir||F86452 protein F6N18.17 [imported] - Arabidopsis thaliana gi|15223304|ref|NP_174556.1| RNA-binding
  misc_feature: GI Number: 14030687; NR Description: At1g32790 [Arabidopsis thaliana] >gi|25090128|gb|AAN72236.1| At1g32790/F6N18_9
  misc_feature: GI Number: 48427656; NR Description: At1g53650 [Arabidopsis thaliana] >gi|25405657|pir||F96576 probable RNA-binding protein, 40942-42923 [imported] - Arabidopsis thaliana
TAATTACGGTTGGGAGTGAATATATATAGTGGAGTGTTGTGGGCCAAGGCCCATTACAATGGAGGTATACACAGAGACGTAAACAACACTCTAACACTAACATCAACGACTATCCTTAAGGCTTTTGTCGATCAAGATACCTACACCATTCCTACCCAAACTTGCTCCCGTGTTCCAACGCTTGAAACCAGTATCCTCCACCTCCTTCGCCTTATAGCCCTTTCATTTAGTCTTCTGGACGCATAGAATATTTACACGCCTCTTAATCGCTACATCCACTAGCTCCCCTAACTTACCTGTTAGGGACCCTATGTTCCAACTGCCTACACGAAATCTAGTTGGTTCGACTAGCTTCCTTACCCTTCACACCCGTCGAGAGAGATGTGAAGACCCTTGTTCATTTTTCACTACATCCTGGCGTTGATGTAGCACATCACTAAGGAAATGACGACCTGGTCCTTGCTCACTTAAGCAAGCATCTATTTTGTATTCATCTGAGAAAAGTAGAACAAAAATTTCCTCTTGGGTAACCAATGGCCACTGAGCATGTAAATCCTGTGTAATCAGCCCATGAAATGATGATGGTGAGGTCTACTTGTGTGCTCACGTAGGCCATAGTCTTGAGGCACATTGTGTGAAACCTTGTGCTCACTGTGCTCAAATCTATCTGATCCAACGAGGCAGCAAGGTCTTCAGACACTGAAGCTGCAGGTGCAGCCAAGCCATTTTCCAGGGTTTCCTGTTTCATTTGTTATGCTTGGGTGTTGAGGAGGGTTTTTTTTATCCCTGGCCACATTTCCCCCCTGATTGCTTGATGTGTATTCCCTCCTTGCCCAGAAGGAATCAAGTTGTACACTAATCCCTAGTTTCTACCTAAGGTTAGTTAGAAATATTAAGGAAAGATGGAAGTTCTCAAGGCATTGTGTTCAGATTGATAAGCATGAATGATTACTCCTTTGGCATTTCAAAAGGGATAGTAACATAAAACTGGGGTAGATGGATTATATTGTTTTGTAAAACATGAGTACTACCTATATGCAGAGTTTAAATTTAAATCCATATTATGTAAACAGGTAGCTCAAACATGGTCGTTTCACTGCAGCCTGTCCACTGCAGTTTCAAAATGGTTCACAATGTGGGCGATGTTGTGTGGTTACATTTTATCTTTCTATGTTTGACTTACTACGACACATCTTTTTCACATGTAGGTGGTAGATTGCCGTATCTGTGGTGATCCTAACTCAGTGCTTCGTTTTGCTTTTATCGAGTTTGCTGATGACGTTGCTGCACAATCAGCACTAGCACTTGGTGGAACCGTGCTTGGCTTTTATCCTGTCAAGGTTCTGCCATCAAAGACAGCAATTTTACCTGTGAACCCTAAATTTCTTCCTCACACTGATGATGAGAAAGAAATGGTATCCAGGACTGTGTATTGTACTAACATTGACAAGAAGATCGCAGAAGATGAAGTGAAGCAATTCTTTGAGGGAACATGTGGTGAAGTTTCTCGTCTGAGGCTACTTGGTGATTATGTGCACTCCACATGCATCGCTTTTGTTGAGTTTGTCCAAGCAGATAGTGCTATTCTCGCTCTGAACTGCAGTGGCATTGTTCTTGGAACGCTTCCTGTTAGGGTGAGCCCATCAAAGACACCAGTCCGCTCGCGATCGCCCCGTGTGACGTCATACTGAATTCGGCTCATCTGAAGCCGTCGTCCAGGGCAGCAAATTTCTGGGCAACAAAGCCCTAGTCGTGTGGCCTTAGAGACTGCCGCATCGCGGATAAGTAATTGTCGTTGAGCAGAGTTCTCGTTGGTTAAAGTCCAGTCTAGTAGGAGGCGCAGAGACCCGTCTGTATGGTCGCTGGGAGATCTATCTTGACCTCCTTTTTCTGTTCTTTTTGGTCTTAGTTATCGTGGTTGGATTCTATAGCAGCCTTGACAGGCATTCGAACAACAATGTTTATGGTTATCCTATCCGCTTTGGACT

SEQ ID NO: 2861 - DNA, 1409 bp, Triticum aestivum
  misc_feature (1)..(1409): Ceres cDNA ID no. 16448144
  misc_feature (1)..(1409): Ceres CLONE  ID no. 773112
  misc_feature (1)..(1409): Also known as  Ceres CDNA ID no. 23726333
gccgtggtttgttgccagaaaaacaatctatcttcgttccttgcttcgtctacctccgtccctcaaaactagttcgagctagctagggttagacccaacaattggtatcagagcctcgtttgttcatgtgctcgtggccatgacgatcgtccagcacggcgcagggggtagcacggtgtcgatgccaatgccgatgctcacaccggaaaactacacggtgtgggcgatcaaggccgaagccatcctcgacgcccagaacctctgggaagcggtgtcgccggcaggcgacgcggcggtcgacgcggggaaaaacaagacggcgagggtggtgctgttcggtgtgctctccgaagacttgttgatgcaggtatcgacgaagaagacggccgctgaggtgtgggccagcttgaagacgaggttcgtcggtgctgatcgggtccaggcggcgcggctctccactctccgtggcgagtttgacaacctgcgcatggaggagggggaggcgctttacgcgtacgccggcaaaatcggcggcatggcagcaaggtatgctggcctcggctcgacgctcgacgacaccgccatggtgaaaaaactgctcgacacggtgcccgatcggttgtatgccgcggtggccgggattgagcagttctgcgacgtggagacgatggtgttcgaggaggcgttgagcaggctcaaggagttcgacgaacgcttacgtcggcgcacgcaggacaacggcggacgaggcggcgatcagctgatgttcgcggcggcccagtgggaggcacggcagtgtcagcgcggcggcaacctcgaccatgacgacggtgcgagcagcgtggcttcgggcacgagatgacggcgcgggaagtgctacaactgtggcgttcgtggccacttctcccgtgactgccggcagccgaaggagaaggcgctcctcgccaacatcgacgacgagccgaccttactgtaggtcgtgtcttagggggagattcttaggaataagacacggcggtggtggtgaccagtgtgtgcgtgcgtgttggtcgtgccagacgccgtggcgagtgtgcgtgtgtgcgtgcgttgtgtgcgtgtcgagtctgtgctcataattgagtcgtagtcggttagcagcagtagctggacgcgttagaacgcgtcgtagaggcggtgtaggtgagcaggttgttgggcgctcgtacgtgcttgcgtaggaaaacaatggcttgggcgctacgtctcgtaggctacaaagccggccaggatttggtttgttagtgcgtcagattgatatacgtaggtggttaggagtccagatatgttttgatttgtccagctatatatatgacagagaaaagaggcgttcggcgccgtggtttgttgctacaaaaaaaaaaaaaaaa

SEQ ID NO: 2862 - protein, 240 aa, Triticum aestivum
  misc_feature: PFam Name: Retrotrans_gag; PFam Description: Retrotransposon
  misc_feature: GI Number: 51964644; NR Description: PREDICTED OJ1499_A07.20
  misc_feature: GI Number: 34907386; NR Description: P0471B04.27 [Oryza sativa (japonica cultivar-group)] >gi|21952802|dbj|BAC06218.1| P0018C10.19 [Oryza sativa (japonica cultivar-group)] >gi|22202685|dbj|BAC07343.1| P0471B04.27 [Oryza sativa (japonica
  misc_feature: GI Number: 50917767; NR Description: gag-pol polyprotein [Oryza sativa (japonica cultivar-group)] >gi|29150404|gb|AAO72413.1| gag-pol polyprotein [Oryza sativa
  misc_feature: GI Number: 50921055; NR Description: putative gag-pol polyprotein [Oryza sativa (japonica cultivar-group)] >gi|30017513|gb|AAP12935.1| putative gag-pol polyprotein [Oryza
  misc_feature: GI Number: 34910624; NR Description: putative copia-type polyprotein [Oryza sativa (japonica cultivar-group)] >gi|15623989|dbj|BAB68043.1| putative copia-type polyprotein [Oryza sativa (japonica cultivar-group)]
MTIVQHGAGGSTVSMPMPMLTPENYTVWAIKAEAILDAQNLWEAVSPAGDAAVDAGKNKTARVVLFGVLSEDLLMQVSTKKTAAEVWASLKTRFVGADRVQAARLSTLRGEFDNLRMEEGEALYAYAGKIGGMAARYAGLGSTLDDTAMVKKLLDTVPDRLYAAVAGIEQFCDVETMVFEEALSRLKEFDERLRRRTQDNGGRGGDQLMFAAAQWEARQCQRGGNLDHDDGASSVASGTR

SEQ ID NO: 2863 - DNA, 1427 bp, Zea mays
  misc_feature (1)..(1427): Ceres cDNA ID no. 16449547
  misc_feature (1)..(1427): Ceres CLONE  ID no. 995986
  misc_feature (1)..(1427): Also known as  Ceres CDNA ID no. 23825124
ataaaaatgcctctgccttgcgtctctctcttcttcctccccaccccacgaggcgctagctgcggcacggaaccagcgccattagaggccacaagcccgcaccacgcctccctcgttctcgcgcgcgcgcacgcatgcacgaggagctgctgcagagaagaggaggcctgtcgatttgattgaactttccaaattcagattcagaagctggccaagatgactgccggtttccagctcggcgtgatcgggtctctcacgctctccgtcgcgtcgtcggttgccattgtcatctgcaacaaagccctcatcagcaccctaggctttccattcgctacgactctgacaagctggcacctgatggtgaccttctgcaccctccacgtggcgcagcgcctgcgctttttcgagcccaaggcgatcgacgggcagacggtagttctgtttggcttgctcaacgggacctcgattggccttctgaaccttagtttagggttcaactccatcggattctaccagatgacgaagttggccataatacccttcacggtgctgttggagactatattcctgaagaaaagattcagtgagacgatcaagttttctctgctggtcttgctgctcggagttggcatcgcctcagttacggacctcaagttaaactgcctcgggtccgttctttccggcctcgccatcgccaccacttgtgtcggccaaattctcacgaatacgatacagaggaagctgaaggtctcgtcaacgcagctcctgtaccagtcagcgccttaccaagcagccattctgttcgccactggccccttcgtggaccatctcctcaccggccgcagcgtcttcgcccatagatacactttcccggttgtgggcttcatcgtcctgtcgtgcttgatcgcggtgtcggtgaacttcagcacgttcctggtgatcgggacgacgtcgccggtgacgtaccaggtgctgggccacctcaagacgtgcctggtgctgtcgttcgggtacacgctgctgcacgatcctttcaccgtgcggaacatcctgggcatcctcgtcgccatcttcgggatggcgctctactccatcttctcggtgcgtgagggcaagaagaagtccgcaggcgacgccctcccggtgtcacagatgcctgacaaggagacggagccgctgttggcgaccaaggacaacagcgacaccaaaaaggcgaacggggttgctcacgactgctaagatgttcccgtttgccgttgcttatagcctaattagtccagctctagtgttactacgacgcactgttctgaatctcagaaagtcagggaagaagtcattcctttttgtttcttataatattgtatatgtaatattcctctattgcgaattataagccgtttcaatttttttgaaaaaaaaaaaaaaaa

SEQ ID NO: 2864 - protein, 340 aa, Zea mays
  misc_feature: GI Number: 50910741; NR Description: phosphate translocator-like [Oryza sativa (japonica cultivar-group)] >gi|48717036|dbj|BAD23725.1| phosphate translocator-like [Oryza
  misc_feature: GI Number: 13384378; NR Description: putative phosphate
  misc_feature: GI Number: 30984584; NR Description: At2g30460 [Arabidopsis thaliana] >gi|27311731|gb|AAO00831.1| putative integral membrane protein [Arabidopsis thaliana] >gi|51970690|dbj|BAD44037.1| integral membrane protein -like [Arabidopsis thaliana]
  misc_feature: GI Number: 13699188; NR Description: putative
  misc_feature: GI Number: 42570326; NR Description: transporter-related
MTAGFQLGVIGSLTLSVASSVAIVICNKALISTLGFPFATTLTSWHLMVTFCTLHVAQRLRFFEPKAIDGQTVVLFGLLNGTSIGLLNLSLGFNSIGFYQMTKLAIIPFTVLLETIFLKKRFSETIKFSLLVLLLGVGIASVTDLKLNCLGSVLSGLAIATTCVGQILTNTIQRKLKVSSTQLLYQSAPYQAAILFATGPFVDHLLTGRSVFAHRYTFPVVGFIVLSCLIAVSVNFSTFLVIGTTSPVTYQVLGHLKTCLVLSFGYTLLHDPFTVRNILGILVAIFGMALYSIFSVREGKKKSAGDALPVSQMPDKETEPLLATKDNSDTKKANGVAHDC

SEQ ID NO: 2865 - DNA, 617 bp, Glycine max
  misc_feature (1)..(617): Ceres cDNA ID no. 16602520
  misc_feature (1)..(617): Ceres CLONE  ID no. 565385
  misc_feature (1)..(617): Also known as  Ceres CDNA ID no. 24372799
ctaaaaaaagtcgtattggttgagttaatgtgagaagatgaaaagtgttagcctgagaccagagcttcacattccaatttgttcttcaaaccctccatcatgtgtcaaaccaataaaactagtggtagtatcatcgtatgggaaaaagttgaaacatccagcttcgaaattggcaatgactcatagagagcacacaacaactttgccattactgaaacatgattctagcattgtgatgatgggagcggtgtgtgtgggaattttggtggtggttctgagcgaggaaaaggccttggctttgggcccagaaggcccacttgtggaagagttctgggacaacgtgaggagatatggactctacgctctcaccgtcagcacaggtgccctttacaccatcttccgccctatagtggaacttctcaagaatcccatttctgcaattttcatccttcttcttttcggggcttccttcttcattgtttctcaagttctctctgccatggttggtgtttctgaattttcttacgactttggatactagcctacactacctccaattatattatatgcaaaataaatccttttttatttttactcttccaaaaaaaaaaaaaaaa

SEQ ID NO: 2866 - protein, 617 aa, Glycine max
  misc_feature: GI Number: 21554319; NR Description: unknown [Arabidopsis thaliana]
CTAAAAAAAGTCGTATTGGTTGAGTTAATGTGAGAAGATGAAAAGTGTTAGCCTGAGACCAGAGCTTCACATTCCAATTTGTTCTTCAAACCCTCCATCATGTGTCAAACCAATAAAACTAGTGGTAGTATCATCGTATGGGAAAAAGTTGAAACATCCAGCTTCGAAATTGGCAATGACTCATAGAGAGCACACAACAACTTTGCCATTACTGAAACATGATTCTAGCATTGTGATGATGGGAGCGGTGTGTGTGGGAATTTTGGTGGTGGTTCTGAGCGAGGAAAAGGCCTTGGCTTTGGGCCCAGAAGGCCCACTTGTGGAAGAGTTCTGGGACAACGTGAGGAGATATGGACTCTACGCTCTCACCGTCAGCACAGGTGCCCTTTACACCATCTTCCGCCCTATAGTGGAACTTCTCAAGAATCCCATTTCTGCAATTTTCATCCTTCTTCTTTTCGGGGCTTCCTTCTTCATTGTTTCTCAAGTTCTCTCTGCCATGGTTGGTGTTTCTGAATTTTCTTACGACTTTGGATACTAGCCTACACTACCTCCAATTATATTATATGCAAAATAAATCCTTTTTTATTTTTACTCTTCCAAAAAAAAAAAAAAAA

SEQ ID NO: 2867 - DNA, 880 bp, Zea mays
  misc_feature (1)..(880): Ceres cDNA ID no. 16602718
  misc_feature (1)..(880): Ceres CLONE  ID no. 986106
  misc_feature (1)..(880): Also known as  Ceres CDNA ID no. 23841440
aaccaggcaaccagatggtagtaggttagctaagctcgggatcggaggagaggtgccccgcgaccctgacgatgacgatgcctcgccgcgcccttctcttcgccgcggtgctcctcgcggcctccgccgccgcggtctccgggttccacctcgccggggacgagagcggcctcgtgaggggcgtgctcacagcggtccgcgagcgggccgaggccgaggccgaggacgccgcgcgcttcgccgtcgcctaccacaacaggaaccagggtgctgctttggagttcactagggtgctcaaatcgaagcggcaggttgtgaccgggaccctgcatgacctgatactggaggcagctgatgctggaaaaaagagtctgtacagagcaaaagtctgggtgaagccgtgggaggatttcaagtccgttgtcgagtttcgccttgctggagactctgaatctgaacccgagccttctgttgcttctgatgaaggctctgggcaaggagttgccaagctctctcttgaagcagacatcatacacgaagaggctcacctgcacaccattgagaatgatggactttccagcgatttcgcatcatccgcttagacatacttggtgtgactaggattccaggcaaggatggaaagcgtgaaagtttaaaatgaaggtttaggtatttagaattctaatagtaggttgctgtcaagctgaaatgctttgcctctatcggaatatgtatgttttgtttggaacgtaggagcatagaactgtatatttcggtatttcacaccgttcatttccatgtctgtatataagactatctccagccatattctcccatatatatttcactacctatactttttattaaaaaaaaaaaaaaa

SEQ ID NO: 2868 - protein, 176 aa, Zea mays
  misc_feature: PFam Name: Cystatin; PFam Description: Cystatin domain
  misc_feature: GI Number: 27752377; NR Description: cysteine protease
  misc_feature: GI Number: 15795168; NR Description: cysteine proteinase inhibitor-like protein [Arabidopsis thaliana] >gi|12321971|gb|AAG51028.1| cysteine proteinase inhibitor,
  misc_feature: GI Number: 18874516; NR Description: cystatin [Sandersonia
  misc_feature: GI Number: 11139270; NR Description: PRLI-interacting factor
  misc_feature: GI Number: 585033; NR Description: Multicystatin (MC) >gi|629725|pir||S40305 multicystatin - potato
MTMPRRALLFAAVLLAASAAAVSGFHLAGDESGLVRGVLTAVRERAEAEAEDAARFAVAYHNRNQGAALEFTRVLKSKRQVVTGTLHDLILEAADAGKKSLYRAKVWVKPWEDFKSVVEFRLAGDSESEPEPSVASDEGSGQGVAKLSLEADIIHEEAHLHTIENDGLSSDFASSA

SEQ ID NO: 2869 - DNA, 742 bp, Zea mays
  misc_feature (1)..(742): Ceres cDNA ID no. 16602721
  misc_feature (1)..(742): Ceres CLONE  ID no. 988413
  misc_feature (1)..(742): Also known as  Ceres CDNA ID no. 24364802
atcgctggcaacgaagcttcagtgcttcagtgctgttcggttcatctgtgcttcagcgtagtgctactggcactggcagtgccctaactaaggtctcctcggtctcatctcatctccatgatggcttcttcctcctccttctcttccttcttcggcatcgagcctctcgacggaggcgacggcgacgcctaccgccgcgccatggacgcctgctccctctgcgggaagcgcctcgccggggaccgcgacatcttcatgtacagaggggacacgccgttctgcagcgaggagtgcaggcaccaccagatggccagggacgatttcggcgcggcgttgaagacggagccgcgtccggcaaggagaggggagcgacgccgccgcaggcacgaggctcctgccgccgccgccgccgagccggcccgtgtcccgctagcgccaaatgtgcccgccgttgtgatctagtggtgcagtggttatagctgccacagagcggcatccgaccggcttctctcaaggaaccaaccagcgaactgtccggtcgagatgagtagcggcggcagagaatacgtttgtgtgcaagcaacaaggaaccaaccacgctgttcagtatctctgtgttctttcggtttcttctgctgttgtttgccttgttggtcacttttctttctgcacgtgctgagcaaccagttgtgagagaaatggatgtacataacggcatgttcatgcaaaaaaaaaaaaaaaa

SEQ ID NO: 2870 - protein, 114 aa, Zea mays
MMASSSSFSSFFGIEPLDGGDGDAYRRAMDACSLCGKRLAGDRDIFMYRGDTPFCSEECRHHQMARDDFGAALKTEPRPARRGERRRRRHEAPAAAAAEPARVPLAPNVPAVVI

SEQ ID NO: 2871 - DNA, 1003 bp, Zea mays
  misc_feature (1)..(1003): Ceres cDNA ID no. 16602843
  misc_feature (1)..(1003): Ceres CLONE  ID no. 1347109
  misc_feature (1)..(1003): Also known as  Ceres CDNA ID no. 16602843
gtgctatccccgcccattcgtcaccagccaggtcccggaaccttatcaccaaatcctcacgtcatggcggccgcgctcttctccacctcgctctcgccccgcttcctcgacctatcctccccgaagccggccgcgcccgcggcctcggccttcctccccttcacgctgccgctgcgctctgtgtcggcgccggcgccagcgaggcgggtcttcgagcccgttgccgtcgcggtgtcgtcggagtacgggaccgagggcgcggagcagcaggacggggagttctccgaggacctcaagctgttcgtcggtaacctgccgttcagcgtcgacagtgcgcagctggccgggctcttcgagcaggcgggctccgtcgagatggtcgaggttgtatacgatagaatgactgggcggagccgtggatttggattcgtgacaatgtcttcagctgaagaagccggggctgctgtcgagcaattcaacggttatacatttcaaggaagacctctgagggtgaactgcgggccaccgccacctagagatggatccgcaccaagagcaccaaggggtggtggtggtgggggtggtggcggcagctttgtcgattcagggaacaaggtatacgtggggaaccttgcatggggcgttgacaactcgactctggagaacctattcagtgagcaaggacaggtgctggatgctaaggtcatctacgacagggatagcggcaggtcaagggggtttggtttcgtcacctatggctctgccgaggaggtcaacaatgccatatcaaaccttgatggcatcgacttggatggtagacagatccgagtcacggttgcagaatcaaagcccaggcgtgaattttgagattttgttaaggtggttttagaggtcaatagcgtgtgttcacaagttctagtttgtagcgtctattctttcttccgtatgagtaacaagaagatgctgataatgagagactggaagcaaaaaaaaaaaaaaaaaa

SEQ ID NO: 2872 - protein, 267 aa, Zea mays
MAAALFSTSLSPRFLDLSSPKPAAPAASAFLPFTLPLRSVSAPAPARRVFEPVAVAVSSEYGTEGAEQQDGEFSEDLKLFVGNLPFSVDSAQLAGLFEQAGSVEMVEVVYDRMTGRSRGFGFVTMSSAEEAGAAVEQFNGYTFQGRPLRVNCGPPPPRDGSAPRAPRGGGGGGGGGSFVDSGNKVYVGNLAWGVDNSTLENLFSEQGQVLDAKVIYDRDSGRSRGFGFVTYGSAEEVNNAISNLDGIDLDGRQIRVTVAESKPRREF

SEQ ID NO: 2873 - DNA, 1432 bp, Glycine max
  misc_feature (1)..(1432): Ceres cDNA ID no. 16621443
  misc_feature (1)..(1432): Ceres CLONE  ID no. 582727
  misc_feature (1)..(1432): Also known as  Ceres CDNA ID no. 23703120
atggagcgtttagagaacgtgatttcagacacaatcctctacgatccctccaacatagggttaggttccttggtggacactctcctctccgacttggaccaaaccatgtcgttaccctcacactaccatctctcatcagaccttcccgatttcgccaccaccgtggaagaacactccgggatacgactcattcacacgctgatgacgtgtgcggattccctgcaacgtggccacttctcattcgctgcctccctcatccagaacatgcaaggcttgttggcgcacgtcaacaccaactgcggcatcggaaaagtcgccgcctgcttcatcgacgccttgcgccgccgcatctccaacaagtttccagcatcatccgcttacgagaacgacgttctctaccacaactactacgaggcgtgtccttacttgaagttcgcgcacttcaccgcgaaccaggcgatcttggaggccttcaacggccacgattgcgtccacgtcatcgacttcaacctcatgcaggggctccagtggccagcgctgatacaggcgctggcgctccggcccggaggaccgccgctgctgaggctcaccggcatcgggcccccctcggcggaaaaccgcgacaacctccgcgaaatcgggctgagactcgccgagctggcgcgctccgtgaacgtgcggtttgcgttccgcggcgtggcggcgtggcggctggaggacgtgaagccgtggatgttacaggtgagtccgaacgaagcagtagcggtgaactcgatcatgcagctgcaccggctgacggcggtgaagtccgccgttgaagaggttctgggatggatccggattctgaaccctaaaatcgtgacggttgtggaacaagaagccaaccacaacggggaagggtttttggagcggttcacggaggctttgcattactattccagcgttttcgactcgctcgacgcgtgtccggtcgaaccggacaaggctgctttggcggagatgtatctgcagagggagatatgcaacgtggtgtgctgcgagggaccggcgcggctggagcgccacgagccgctcgctaagtggagggatcggctggggaaagccggcttcagagccttgcatttgggtttcaacgcctacaagcaagccagcatgttgctcactctcttctcagctgagggtttctgcgtccaagagaatcaaggctctttgactctgggttggcatagccgccccctaattgcagcttcggcttggcaagccgcgcctctgggagacgacgaaacgctgcgttttgagcattgaggaaaagaacagaacagaacagatcacttgtttttgtttattctagtaactagtagcagtagtagtacacgggaagagtggtgaataataataatgtggtcatttttgcgcaaaaaaaaaaaaaaaa

SEQ ID NO: 2874 - protein, 434 aa, Glycine max
  misc_feature: PFam Name: GRAS; PFam Description: GRAS family transcription
  misc_feature: GI Number: 39841619; NR Description: GAI protein [Oryza sativa]
  misc_feature: GI Number: 34911732; NR Description: putative OsGAI [Oryza sativa (japonica cultivar-group)] >gi|13603445|dbj|BAB40172.1| putative OsGAI [Oryza sativa (japonica cultivar-group)] >gi|21901982|dbj|BAC05533.1| putative OsGAI [Oryza sativa
  misc_feature: GI Number: 20334379; NR Description: GAI-like protein 1
  misc_feature: GI Number: 63054405; NR Description: GIA/RGA-like gibberellin
  misc_feature: GI Number: 60656561; NR Description: DELLA protein [Brassica rapa]
MERLENVISDTILYDPSNIGLGSLVDTLLSDLDQTMSLPSHYHLSSDLPDFATTVEEHSGIRLIHTLMTCADSLQRGHFSFAASLIQNMQGLLAHVNTNCGIGKVAACFIDALRRRISNKFPASSAYENDVLYHNYYEACPYLKFAHFTANQAILEAFNGHDCVHVIDFNLMQGLQWPALIQALALRPGGPPLLRLTGIGPPSAENRDNLREIGLRLAELARSVNVRFAFRGVAAWRLEDVKPWMLQVSPNEAVAVNSIMQLHRLTAVKSAVEEVLGWIRILNPKIVTVVEQEANHNGEGFLERFTEALHYYSSVFDSLDACPVEPDKAALAEMYLQREICNVVCCEGPARLERHEPLAKWRDRLGKAGFRALHLGFNAYKQASMLLTLFSAEGFCVQENQGSLTLGWHSRPLIAASAWQAAPLGDDETLRFEH

SEQ ID NO: 2875 - DNA, 1812 bp, Glycine max
  misc_feature (1)..(1812): Ceres cDNA ID no. 16625799
  misc_feature (1)..(1812): Ceres CLONE  ID no. 556415
  misc_feature (1)..(1812): Also known as  Ceres CDNA ID no. 23378694
taattttgtcactgtaattcttcttcttcaaagaaaaccccaatttcgaacgcttcaaattcaattcaggaaaccctagtgattaatttcgttgcgaaacggcgattcaagattatcgtgagccagaagatggtagcggaagcggaaattatctgtcagcagaacattccgatgttggacgtgaagtatcatatttgcgtggctcaagaacacaacgtgaaggttgaggtttcacccaaatcaccttcacctcctgttccgatctttggccaagcagtgagttgctctgagatcattaaagattccattttggaggcccctgcgatgaattttttcccaaatgtgcgttctggtagctatgccgagattggaccgcgcgtttctatggatgatgaacacatttgtattgatgatctgggagctcatcttggatttgtgttcaagtgtccgataccgagtgcattttatgcagtttttgatggccatggggggcctgatgcagcagcctttgttaagaggaatgctatgaggttgttttttgaagatgcagacatgctgcagtcgtatgatgctgatgcgttttttctacagaaattggaggattcccatcggagagcttttctacgggcagatcttgccttggctgatgaacaaactgttggtagttcttgtgggactactgcattgactgcccttgtgcttggaaggcatttgcttgttgctaatgctggtgactgccgagcagttctttgccggagaggtgtggctgttgagatgtctaatgatcacaggccaagttatctaccagagaagaggagggtggaggagttaggtgggttcattgatgatggatatctcaatggttatctttcagtaactcgagcccttggggattgggacttgaaatttccacttggtgctgcatcccctcttattgctgagccagatgttcggctggttacattgactgagggtgatgagttcttgatcattgggtgtgatgggatttgggatgtaatgtctagccaagttgcagttagtcttgttcgccgaggattaagaaggcatgatgacccacagcaatgtgccggagagctagtcaaggaagcattgcgcctaaatacatcagataatctcactgtaattgttgtatgcttgtcgcccattgaaagcattgttgaatcatgtccaccccaaaggagaagattcaaagcttgcagtttgtctgaagaggcccgtaatagattgaagagcttgattgagggaaattgattgtaaatgcaattcttgtgattgacaaatgttcctttcttaaaaaattaatctgttttttaggctgtttcagagagagctaaaaagcagccagcagttttgtagggatagaagggatatttggttagggggtagaaggtgtttggatttatttaattgggaggtgttttttctgggttatgtttggtacatgtagagacaattgctagctaattttggcggattagattcggtccccaccatggccgttcccattttacattgttgctgcttctgtaaataaaaatgaggggttgtctgagacataggatagccgaatgcatggttgagtttcttgtttgttgttcttggatcctccatgttatatggatggatatgcttggcccatcttatcaactggtagggctatggcctatgtcatgggacaacatcatcctttggcatcacacaaactaaatcgcttatcttatgtgatgaatttttctccgttatcctttatttattaataaaaaggagtgttaataaaaaaaaaaaaaaaaa

SEQ ID NO: 2876 - protein, 380 aa, Glycine max
  misc_feature: PFam Name: PP2C; PFam Description: Protein phosphatase 2C
  misc_feature: GI Number: 3643085; NR Description: protein phosphatase-2C; PP2C [Mesembryanthemum crystallinum] >gi|25352221|pir||T52337 phosphoprotein phosphatase (EC 3.1.3.16) 2C [imported] - common ice
  misc_feature: GI Number: 51536570; NR Description: At1g48040 [Arabidopsis thaliana] >gi|8778520|gb|AAF79528.1| F21D18.27 [Arabidopsis thaliana] >gi|12323084|gb|AAG51521.1| protein phosphatase-2C, putative; 42154-43770 [Arabidopsis thaliana]
  misc_feature: GI Number: 11994541; NR Description: protein phosphatase 2C-like protein [Arabidopsis thaliana] >gi|30684431|ref|NP_188351.2| protein phosphatase 2C-related /
  misc_feature: GI Number: 30695577; NR Description: protein phosphatase 2C,
  misc_feature: GI Number: 51972144; NR Description: At3g51470 [Arabidopsis thaliana] >gi|51536524|gb|AAU05500.1| At3g51470 [Arabidopsis thaliana] >gi|6572068|emb|CAB63011.1| protein phosphatase 2C-like protein [Arabidopsis thaliana] >gi|11358727|pir||T45778 protein
MVAEAEIICQQNIPMLDVKYHICVAQEHNVKVEVSPKSPSPPVPIFGQAVSCSEIIKDSILEAPAMNFFPNVRSGSYAEIGPRVSMDDEHICIDDLGAHLGFVFKCPIPSAFYAVFDGHGGPDAAAFVKRNAMRLFFEDADMLQSYDADAFFLQKLEDSHRRAFLRADLALADEQTVGSSCGTTALTALVLGRHLLVANAGDCRAVLCRRGVAVEMSNDHRPSYLPEKRRVEELGGFIDDGYLNGYLSVTRALGDWDLKFPLGAASPLIAEPDVRLVTLTEGDEFLIIGCDGIWDVMSSQVAVSLVRRGLRRHDDPQQCAGELVKEALRLNTSDNLTVIVVCLSPIESIVESCPPQRRRFKACSLSEEARNRLKSLIEGN
